(12) United States Patent
Hatchwell et al.

(10) Patent No.: US 10,174,376 B2
(45) Date of Patent: Jan. 8, 2019

(54) METHODS AND COMPOSITIONS FOR DIAGNOSING, PROGNOSING, AND TREATING ENDOMETRIOSIS

(71) Applicant: Population Bio, Inc., Melville, NY (US)

(72) Inventors: Eli Hatchwell, Winchester (GB); Peggy S. Eis, Fitchburg, WI (US)

(73) Assignee: Population Bio, Inc., New York, NY (US)

( * ) Notice: Subject to any disclaimer, the term of this patent is extended or adjusted under 35 U.S.C. 154(b) by 292 days.

(21) Appl. No.: 14/538,404

(22) Filed: Nov. 11, 2014

(65) Prior Publication Data

US 2015/0132295 A1  May 14, 2015

Related U.S. Application Data

(60) Provisional application No. 61/903,286, filed on Nov. 12, 2013.

(51) Int. Cl.
| | | |
|---|---|---|
| *C12Q 1/68* | (2018.01) | |
| *C12P 19/34* | (2006.01) | |
| *C12Q 1/6883* | (2018.01) | |

(52) U.S. Cl.
CPC ...... *C12Q 1/6883* (2013.01); *C12Q 2600/112* (2013.01); *C12Q 2600/156* (2013.01); *C12Q 2600/158* (2013.01)

(58) Field of Classification Search
None
See application file for complete search history.

(56) References Cited

U.S. PATENT DOCUMENTS

| | | | |
|---|---|---|---|
| 4,683,195 | A | 7/1987 | Mullis et al. |
| 5,143,854 | A | 9/1992 | Pirrung et al. |
| 5,223,409 | A | 6/1993 | Ladner et al. |
| 5,288,514 | A | 2/1994 | Ellman |
| 5,384,261 | A | 1/1995 | Winkler et al. |
| 5,424,186 | A | 6/1995 | Fodor et al. |
| 5,445,934 | A | 8/1995 | Fodor et al. |
| 5,451,683 | A | 9/1995 | Barrett et al. |
| 5,510,270 | A | 4/1996 | Fodor et al. |
| 5,527,681 | A | 6/1996 | Holmes |
| 5,700,637 | A | 12/1997 | Southern |
| 5,744,305 | A | 4/1998 | Fodor et al. |
| 5,837,832 | A | 11/1998 | Chee et al. |
| 5,858,659 | A | 1/1999 | Sapolsky et al. |
| 5,945,334 | A | 8/1999 | Besemer et al. |
| 6,040,138 | A | 3/2000 | Lockhart et al. |
| 6,207,392 | B1 | 3/2001 | Weiss et al. |
| 6,300,063 | B1 | 10/2001 | Lipshutz et al. |
| 6,429,027 | B1 | 8/2002 | Chee et al. |
| 6,858,394 | B1 | 2/2005 | Chee et al. |
| 6,858,412 | B2 | 2/2005 | Willis et al. |
| 6,916,621 | B2 | 7/2005 | Shah |
| 6,951,761 | B2 | 10/2005 | Star et al. |
| 6,969,589 | B2 | 11/2005 | Patil et al. |
| 6,977,148 | B2 | 12/2005 | Dean et al. |
| 7,011,949 | B2 | 3/2006 | Amorese et al. |
| 7,014,997 | B2 | 3/2006 | Knoll et al. |
| 7,030,231 | B1 | 4/2006 | Craik et al. |
| 7,034,144 | B2 | 4/2006 | Van Dongen et al. |
| 7,238,484 | B2 | 7/2007 | Pinkel et al. |
| 7,702,468 | B2 | 4/2010 | Chinitz et al. |
| 7,910,353 | B2 | 3/2011 | Shaffer et al. |
| 7,957,913 | B2 | 6/2011 | Chinitz et al. |
| 8,862,410 | B2 | 10/2014 | Hatchwell et al. |
| 8,932,993 | B1 | 1/2015 | Ward et al. |
| 2002/0012930 | A1 | 1/2002 | Rothberg et al. |
| 2003/0068629 | A1 | 4/2003 | Rothberg et al. |
| 2003/0100102 | A1 | 5/2003 | Rothberg et al. |
| 2003/0148344 | A1 | 8/2003 | Rothberg et al. |
| 2003/0207295 | A1 | 11/2003 | Gunderson et al. |
| 2003/0215821 | A1 | 11/2003 | Gunderson et al. |
| 2004/0018491 | A1 | 1/2004 | Gunderson et al. |
| 2004/0248161 | A1 | 12/2004 | Rothberg et al. |
| 2005/0079510 | A1 | 4/2005 | Berka et al. |
| 2005/0100893 | A1 | 5/2005 | Gunderson et al. |
| 2005/0100932 | A1 | 5/2005 | Lapidus et al. |
| 2005/0124022 | A1 | 6/2005 | Srinivasan et al. |
| 2006/0012784 | A1 | 1/2006 | Ulmer |
| 2006/0012793 | A1 | 1/2006 | Harris |
| 2006/0024678 | A1 | 2/2006 | Buzby |
| 2006/0024711 | A1 | 2/2006 | Lapidus et al. |
| 2006/0078909 | A1 | 4/2006 | Srinivasan et al. |

(Continued)

FOREIGN PATENT DOCUMENTS

| | | |
|---|---|---|
| WO | WO-9002809 A1 | 3/1990 |
| WO | WO-9117271 A1 | 11/1991 |
| WO | WO-9201047 A1 | 1/1992 |

(Continued)

OTHER PUBLICATIONS

Juppner; Bone, vol. 17; 1995, pp. 39S-40S.*
Lucentini (The Scientist; 2004, vol. 24, p. 20).*
Hegele (Arterioscler. Thromb. Vasc. Biol.; 2002, vol. 22, pp. 1058-1061).*
Fissbender, A., et al., "Biomarkers of endometriosis", Fertility and Sterility, 99(4), (Mar. 15, 2013), 1135-1145.
Suryawanshi, S., et al., "Plasma microRNAs as novel biomarkers for endometriosis and endometriosis-associated ovarian cancer", Clin Cancer Res., 19(5), (Mar. 1, 2013), 1213-24.
Agami, R. RNAi and related mechanisms and their potential use for therapy. Curr Opin Chem Biol. Dec. 2002;6(6):829-34.

(Continued)

*Primary Examiner* — Jehanne Souaya Sitton
(74) *Attorney, Agent, or Firm* — Wilson, Sonsini, Goodrich & Rosati

(57) ABSTRACT

This document provides methods and materials related to genetic variations associated with endometriosis. For example, this document provides methods for using such genetic variations to assess risk of, or susceptibility of developing or diagnosing endometriosis.

19 Claims, 75 Drawing Sheets

Specification includes a Sequence Listing.

(56) References Cited

U.S. PATENT DOCUMENTS

| | | |
|---|---|---|
| 2008/0305967 A1 | 12/2008 | Ward et al. |
| 2017/0095456 A1 | 4/2017 | Albertsen |

FOREIGN PATENT DOCUMENTS

| | | |
|---|---|---|
| WO | WO-9210092 A1 | 6/1992 |
| WO | WO-9215679 A1 | 9/1992 |
| WO | WO-9218619 A1 | 10/1992 |
| WO | WO-9220791 A1 | 11/1992 |
| WO | WO-9209690 A3 | 12/1992 |
| WO | WO-9301288 A1 | 1/1993 |
| WO | WO-9322684 A1 | 11/1993 |
| WO | WO-9511995 A1 | 5/1995 |
| WO | WO-9820019 A1 | 5/1998 |
| WO | WO-2006091254 A1 | 8/2006 |
| WO | WO-2006116873 A1 | 11/2006 |
| WO | WO-2010124101 A2 | 10/2010 |

OTHER PUBLICATIONS

Agarwal et al., Novelty in the target landscape of the pharmaceutical. Nat. Rev. Drug Discovery 12(8):575-6 (2013).

Albertson, et al. Profiling breast cancer by array CGH. Breast Cancer Res Treat. Apr. 2003;78(3):289-98.

Altschul, et al. Gapped BLAST and PSI-BLAST: a new generation of protein database search programs. Nucleic Acids Res. Sep. 1, 1997;25(17):3389-402.

Amarzguioui, et al. Approaches for chemically synthesized siRNA and vector-mediated RNAi. FEBS Lett. Oct. 31, 2005:579(26):5974-81. Epub Sep. 20, 2005.

Ausubel, et al. Current Protocols in Molecular Biology. John Wiley & Sons, New York, 1999.

Bennett, C. Efficiency of antisense oligonucleotide drug discovery. Antisense Nucleic Acid Drug Dev. Jun. 2002;12(3):215-24.

Bernstein, et al. Role for a bidentate ribonuclease in the initiation step of RNA interference. Nature. Jan. 18, 2001;409(6818):363-6.

Bier, et al. DNA microarrays. Adv Biochem Eng Biotechnol. 2008;109:433-53.

Bosher, et al. RNA interference: genetic wand and genetic watchdog. Nat Cell Biol. Feb. 2000;2(2):E31-6.

Brummelkamp, et al. A system for stable expression of short interfering RNAs in mammalian cells. Science. Apr. 19, 2002;296(5567):550-3. Epub Mar. 21, 2002.

Chan, et al., Identification of key residues essential for the structural fold and receptor selectivity within the A-chain of human gene-2 (H2) relaxin. The Journal of Biological Chemistry vol. 287, No. 49, pp. 41152-41164, Nov. 30, 2012.

Chen, et al., Identification of small molecule agonists of human relaxin family receptor 1 (RXFP1) by utilizing a homogenous cell-based cAMP assay.

Chen, et al. The evolution of gene regulation by transcription factors and microRNAs. Nat Rev Genet. Feb. 2007;8(2):93-103.

Chen, H. Clinical development of antisense oligonucleotides as anti-cancer therapeutics. Methods Mol Med. 2003;75:621-36.

Chi, et al. Genomewide view of gene silencing by small interfering RNAs. Proc Natl Acad Sci U S A. May 27, 2003;100(11):6343-6. Epub May 2, 2003.

Dias, et al. Antisense oligonucleotides: basic concepts and mechanisms. Mol Cancer Ther. Mar. 2002;1(5):347-55.

Elbashir, et al. RNA interference is mediated by 21- and 22-nucleotide RNAs. Genes Dev. Jan. 15, 2001;15(2):188-200.

Estivill, et al. Copy number variants and common disorders: filling the gaps and exploring complexity in genome-wide association studies. PLoS Genet. Oct. 2007;3(10):1787-99.

Fan, et al. Illumina universal bead arrays. Methods Enzymol. 2006;410:57-73.

Fire, et al. Potent and specific genetic interference by double-stranded RNA in Caenorhabditis elegans. Nature. Feb. 19, 1998;391(6669):806-11.

Freshney, R. I., Culture of Animal Cells: A Manual of Basic Technique. Wiley-Liss; 5th edition (2005).

Galfre. et al. Antibodies to major histocompatibility antigens produced by hybrid cell lines. Nature. 1977; 266:550-52.

Griffiths, et al. Human anti-self antibodies with high specificity from phage display libraries. EMBO J. Feb. 1993;12(2):725-34.

Hay, et al. Bacteriophage cloning and Escherichia coli expression of a human IgM Fab. Hum Antibodies Hybridomas. Apr. 1992;3(2):81-5.

Hoheisel, J. Microarray technology: beyond transcript profiling and genotype analysis. Nat Rev Genet. Mar. 2006;7(3):200-10.

Hunter, C. Genetics: a touch of elegance with RNAi. Curr Biol. Jun. 17, 1999;9(12):R440-2.

Huse, et al. Generation of a large combinatorial library of the immunoglobulin repertoire in phage lambda. Science. Dec. 8, 1989;246(4935):1275-81.

Hutvagner, et al. A microRNA in a multiple-turnover RNAi enzyme complex. Science. Sep. 20, 2002;297(5589):2056-60. Epub Aug. 1, 2002.

Kallioniemi, et al. Comparative genomic hybridization for molecular cytogenetic analysis of solid tumors. Science. Oct. 30, 1992;258(5083):818-21.

Karlin, et al. Applications and statistics for multiple high-scoring segments in molecular sequences. Proc Natl Acad Sci USA. Jun. 15, 1993;90(12):5873-7.

Kim, et al. Strategies for silencing human disease using RNA interference. Nat Rev Genet. Mar. 2007;8(3):173-84.

Kim, et al., Synthetic dsRNA dicer substrates enhance RNAi potency and efficacy. Nature biotechnology. 2005; 23(2): 222-226.

Klein, et al. Comparative genomic hybridization, loss of heterozygosity, and DNA sequence analysis of single cells. Proc Natl Acad Sci U S A. Apr. 13, 1999;96(8):4494-9.

Kohler, et al. Continuous cultures of fused cells secreting antibody of predefined specificity. Nature. Aug. 7, 1975;256(5517):495-7.

Kozbor, et al. The production of monoclonal antibodies from human lymphocytes. Immunol. Today. 1983; 4(3): 72-79.

Kraus, et al. Detection and isolation of novel protein-tyrosine kinase genes employing reduced stringency hybridization. Methods Enzymol. 1991;200:546-56.

Kurreck, J. Antisense technologies. Improvement through novel chemical modifications. Eur J Biochem. Apr. 2003;270(8):1628-44.

Kutyavin, et al. A novel endonuclease IV post-PCR genotyping system. Nucleic Acids Res. 2006;34(19):e128. Epub Sep. 29, 2006.

Lakowicz, J. (1983) Principles of fluorescence spectroscopy. Plenum Press, New York.

Lavery, et al. Antisense and RNAi: powerful tools in drug target discovery and validation. Curr Opin Drug Discov Devel. Jul. 2003;6(4):561-9.

Lerner, E. How to make a hybridoma. Yale J Biol Med. Sep.-Oct. 1981;54(5):387-402.

Maniatis, et al. Molecular Cloning: A Laboratory Manual, Cold Spring Harbor Laboratory Press, Cold Spring Harbor, N.Y., USA (1982).

Margulies, et al. Genome sequencing in microfabricated high-density picolitre reactors. Nature. Sep. 15, 2005;437(7057):376-80. Epub Jul. 31, 2005.

Marques, et al. A structural basis for discriminating between self and nonself double-stranded RNAs in mammalian cells. Nat Biotechnol. May 2006;24(5):559-65. Epub Apr. 30, 2006.

Martinez et al. Single-stranded antisense siRNAs guide target RNA cleavage in RNAi. Cell 110(5):563-574 (2002).

May et al., Endometrial alterations in endometriosis: a systematic review of putative biomarkers. Hum. Reprod. Update, 17(5); 637-53:2011.

McManus, et al. Gene silencing in mammals by small interfering RNAs. Nat Rev Genet. Oct. 2002;3(10):737-47.

Mockler, et al. Applications of DNA tiling arrays for whole-genome analysis. Genomics. Jan. 2005;85(1):1-15.

National Center for Biotechnology Information. NCBI. Available at: https://www.ncbi.nlm.nih.gov/. Accessed on: Jun. 8, 2017.

Nielsen, et al. Sequence-selective recognition of DNA by strand displacement with a thymine-substituted polyamide. Science. Dec. 6, 1991;254(5037):1497-500.

(56) References Cited

OTHER PUBLICATIONS

Nykanen, et al. ATP requirements and small interfering RNA structure in the RNA interference pathway. Cell. Nov. 2, 2001;107(3):309-21.
Perkel, J. SNP genotyping: six technologies that keyed a revolution. Nature Methods. 2008; 5:447-453.
Plasterk, et al. The silence of the genes. Curr Opin Genet Dev. Oct. 2000;10(5):562-7.
Probe Reports from the NIH Molecular Libraries Program [Internet]. Bethesda (MD): National Center for Biotechnology Information (US); 2010. Available from: https://www.ncbi.nlm.nih.gov/books/NBK47352/.
Provost, et al. Ribonuclease activity and RNA binding of recombinant human Dicer. EMBO J. Nov. 1, 2002;21(21):5864-74.
Ragoussis, et al. Affymetrix GeneChip system: moving from research to the clinic. Expert Rev Mol Diagn. Mar. 2006;6(2):145-52.
Redon, et al. Global variation in copy number in the human genome. Nature. Nov. 23, 2006;444(7118):444-54.
Revised American society for reproductive medicine classification of endometriosis: 1996. Fertility and Sterility. 67: 1997; 817-21.
Reynold, et al. Rational siRNA design for RNA interference. Nat Biotechnol. Mar. 2004;22(3):326-30. Epub Feb. 1, 2004.
Sambrook et al., Molecular Cloning: A Laboratory Manual (2 ed.), Cold Spring Harbor Laboratory Press, Cold Spring Harbor, N.Y., USA (1989).
Santa Cruz Human Genome Browser Gateway. 2017. Available at: http://genome.ucsc.edu/cgi-bin/hgGateway. Accessed on: Jun. 8, 2017.
Schwarz, et al. Asymmetry in the assembly of the RNAi enzyme complex. Cell. Oct. 17, 2003;115(2):199-208.
Seshan VE and Olshen A (2017). DNAcopy: DNA copy number data analysis. R package version 1.50.1. Available at: http://www.bioconductor.org/packages/release/bioc/html/DNAcopy.html.
Sharp, P. RNA interference—2001. Genes Dev. Mar. 1, 2001;15(5):485-90.
Shi, Y. Mammalian RNAi for the masses. Trends Genet. Jan. 2003;19(1):9-12.
Shuey, et al. RNAi: gene-silencing in therapeutic intervention. Drug Discov Today. Oct. 15, 2002;7(20):1040-6.
Siolas, et al. Synthetic shRNAs as potent RNAi triggers. Nat Biotechnol. Feb. 2005;23(2):227-31. Epub Dec. 26, 2004.
Smith, et al. A high-density admixture map for disease gene discovery in african americans. Am J Hum Genet. May 2004;74(5):1001-13. Epub Apr. 14, 2004.
Snijders, et al. Assembly of microarrays for genome-wide measurement of DNA copy number. Nat Genet. Nov. 2001;29(3):263-4.
Snijders, et al. BAC microarray-based comparative genomic hybridization. Methods Mol Biol. 2004;256:39-56.
Stephens, et al. Antisense oligonucleotide therapy in cancer. Curr Opin Mol Ther. Apr. 2003;5 (2):118-22.
String. Search single protein by name/identifier. String consortium 2017. Available at:https://string-db.org/.
Tabara, et al. The dsRNA binding protein RDE-4 interacts with RDE-1, DCR-1, and a DExH-box helicase to direct RNAi in C. elegans. Cell. Jun. 28, 2002;109(7):861-71.
The Merck Manual of Diagnosis and Therapy, 18th Edition, published by Merck Research Laboratories, 2006 (ISBN 0-911910-18-2).
Thompson. Applications of antisense and siRNAs during preclinical drug development. Drug Discov Today. Sep. 1, 2002;7(17):912-7.
Thorpe, et al. Improved antitumor effects of immunotoxins prepared with deglycosylated ricin A-chain and hindered disulfide linkages. Cancer Res. Nov. 15, 1988;48(22):6396-403.
Vickers, et al. Efficient reduction of target RNAs by small interfering RNA and RNase H-dependent antisense agents. A comparative analysis. J Biol Chem. Feb. 28, 2003;278(9):7108-18. Epub Dec. 23, 2002.
Wang, et al. Antisense anticancer oligonucleotide therapeutics. Curr Cancer Drug Targets. Nov. 2001;1(3):177-96.
Xia, et al. siRNA-mediated gene silencing in vitro and in vivo. Nat Biotechnol. Oct. 2000;20(10):1006-10. Epub Sep. 16, 2002.
Xiao, et al., Identification and optimization of small-molecule agonists of the human relaxin hormone receptor RXFP1. Nat Commun. 2013;4:1953. doi:10.1038/ncomms2953.
Zhao et al. (eds), Bacterial Artificial Chromosomes: Methods Protocols Methods in Molecular Biology, Humana Press, 2004.
Antisense Drug Technology: Principles, Strategies, and Applications, Crooke, Marcel Dekker Inc., New York (2001) (BOOK).
Berger, et al., Methods in Enzymology: Guide to Molecular Cloning Techniques vol. 152, Academic Press Inc., San Diego, USA (1987).
Cole et al., Monoclonal Antibodies and Cancer Therapy, Alan R. Liss (1985) Inc., pp. 77-96.
Current Protocols in Immunology (1994) Coligan et al., (eds.) John Wiley & Sons, Inc., New York, NY.
Current Protocols in Protein Science (CPPS), 2009; (John E. Coligan, et. al., ed., John Wiley and Sons, Inc.).
Davis et al., Basic Methods in Molecular Biology, Elsevier Science Publishing, Inc., New York, USA (1986).
European Search Report dated Jun. 9, 2015 for European Patent Application No. 14192587.5.
Fuchs et al., Targetting recombinant antibodies to the surface of escherichia coli: Fusion to a peptidoglycan associated lipoprotein. Bio/Technology, 1991; 9: 1370-1372.
Kendrew et al. (eds.), The Encyclopedia of Molecular Biology, published by Blackwell Science Ltd., 1994 (ISBN 0-632-02182-9).
Kenneth, R.H., in Monoclonal Antibodies: A New Dimension in Biological Analyses, Plenum Publishing Corp., New York, New York (1980).
Lewin, B., Genes IX, published by Jones & Bartlett Publishing, 2007 (ISBN-13:9780763740634).
Mather, J.P. et al., Animal Cell Culture Methods (Methods in Cell Biology, vol. 57, Academic Press, 1st edition, 1998.
Robert A. Meyers (ed.), Molecular Biology and Biotechnology: a Comprehensive Desk Reference, published by VCH Publishers, Inc., 1995 (ISBN 1-56081-569-8).

\* cited by examiner

| Chromosome | Original CNV Start | Original CNV Stop | Original CNV Size | CNV Type | Endo Case ID | RefSeq Gene Symbol | SEQ ID |
|---|---|---|---|---|---|---|---|
| 1 | 92013887 | 92020793 | 6806 | loss | 2883 | TGFBR3 | 1 |
| 1 | 92013887 | 92020793 | 6806 | loss | 2923 | TGFBR3 | 1 |
| 1 | 92013987 | 92020793 | 6806 | loss | 2971 | TGFBR3 | 1 |
| 23 | 149901706 | 149904265 | 2559 | gain | 2898 | HMGB3 | 2 |
| 23 | 149901706 | 149904265 | 2559 | gain | 2899 | HMGB3 | 2 |
| 23 | 149901706 | 149904265 | 2559 | gain | 2907 | HMGB3 | 2 |
| 23 | 149901706 | 149904265 | 2559 | gain | 2909 | HMGB3 | 2 |
| 23 | 149902702 | 149904265 | 1563 | gain | 2883 | HMGB3 | 3 |
| 23 | 149901706 | 149904265 | 2559 | gain | 2898 | HMGB3 | 2 |
| 23 | 149901706 | 149904265 | 2559 | gain | 2899 | HMGB3 | 2 |
| 23 | 149901706 | 149904265 | 2559 | gain | 2907 | HMGB3 | 2 |
| 23 | 149901706 | 149904265 | 2559 | gain | 2909 | HMGB3 | 2 |
| 6 | 96110680 | 96625609 | 14929 | gain | 2905 | FUT9 | 4 |
| 6 | 96610680 | 96629872 | 19192 | gain | 2910 | FUT9 | 5 |
| 6 | 96610680 | 96625609 | 14929 | gain | 2916 | FUT9 | 4 |
| 6 | 96610680 | 96625609 | 14929 | gain | 2924 | FUT9 | 4 |
| 7 | 31844634 | 31851158 | 6724 | gain | 2883 | PDE1C | 6 |
| 7 | 31844634 | 31851158 | 6724 | gain | 2973 | PDE1C | 6 |
| 7 | 31844634 | 31851158 | 6724 | gain | 2978 | PDE1C | 6 |
| 10 | 59618047 | 59630493 | 12446 | gain | 2955 | IPMK | 7 |
| 10 | 59618047 | 59630493 | 12446 | gain | 2977 | IPMK | 7 |
| 10 | 59618047 | 59630493 | 12446 | gain | 2978 | IPMK | 7 |
| 2 | 233285559 | 233298735 | 12676 | gain | 2924 | GIGYF2 | 8 |
| 2 | 233285559 | 233300736 | 15177 | gain | 2950 | GIGYF2 | 9 |
| 2 | 233285559 | 233311246 | 25687 | gain | 2999 | GIGYF2 | 9 |
| 6 | 1385169944 | 1385122800 | 5856 | gain | 2968 | | 10 |
| 6 | 1385169944 | 1385120155 | 3211 | gain | 2971 | | 11 |
| 6 | 1385169944 | 1385122800 | 5856 | gain | 2978 | | 11 |
| 11 | 44056551 | 44062111 | 5550 | loss | 2883 | ACCS | 13 |
| 11 | 44056561 | 44058123 | 1562 | loss | 2948 | ACCS | 14 |
| 11 | 44056561 | 44058123 | 1562 | loss | 2950 | ACCS | 14 |
| 7 | 153645525 | 153647352 | 1827 | loss | 2923 | DPP6 | 15 |
| 7 | 153645525 | 153647352 | 1827 | loss | 2976 | DPP6 | 15 |
| 7 | 153645525 | 153647352 | 1827 | loss | 2977 | DPP6 | 15 |
| 6 | 120674750 | 120685941 | 11191 | loss | 2882 | | 16 |

FIG. 1A

| Chromosome | Original_CNV_Start | Original_CNV_Stop | Original_CNV_Size | CNV_Type | Endo_Case_ID | RefSeq_Gene_Symbol | SEQ_ID |
|---|---|---|---|---|---|---|---|
| 6 | 120674750 | 120685941 | 11191 | loss | 2922 | | 16 |
| 6 | 120674750 | 120680729 | 5979 | loss | 2951 | | 17 |
| 16 | 31356038 | 31434641 | 78603 | gain | 2975 | TGFB1I1,SLC5A2,ZNF843,C16orf58,ARMC5 | 18 |
| 8 | 142060703 | 142065735 | 5032 | loss | 2954 | PTK2 | 19 |
| 4 | 128895909 | 129451283 | 455374 | gain | 3001 | LARP1B,PGRMC2 | 20 |
| 19 | 41532062 | 41538649 | 6587 | gain | 2885 | ZFP14 | 21 |
| 19 | 41532062 | 41538649 | 6587 | gain | 2925 | ZFP14 | 21 |
| 19 | 41532062 | 41538649 | 6587 | gain | 2969 | ZFP14 | 21 |
| 19 | 41532062 | 41538649 | 6587 | gain | 2977 | ZFP14 | 21 |
| 19 | 41532062 | 41538649 | 6587 | gain | 3000 | ZFP14 | 21 |
| 1 | 65627570 | 65727987 | 100417 | gain | 2942 | DNAJC6,LEPR,LEPROT | 22 |
| 3 | 196990225 | 197065398 | 75163 | gain | 2997 | MUC4 | 23 |
| 23 | 148575584 | 148653616 | 78032 | gain | 2901 | MAGEA11 | 24 |
| 2 | 242109998 | 242169452 | 59454 | gain | 2959 | BOK,BOK-AS1 | 25 |
| 14 | 80613390 | 80649875 | 36486 | gain | 2981 | TSHR | 26 |
| 23 | 64731495 | 64811828 | 80333 | gain | 2932 | MSN | 27 |
| 2 | 337738800 | 339034436 | 1296636 | loss | 2913 | MYADML | 28 |
| 10 | 104414680 | 104810431 | 395751 | gain | 2921 | CNNM2,C10orf32,ARL3,CYP17A1,WBP1L,SFXN2,C10D rf32-AS3MT,AS3MT | 29 |
| 4 | 153674653 | 153683362 | 8709 | loss | 2934 | RXFP1 | 30 |
| 7 | 30668343 | 30681882 | 13739 | loss | 2968 | CRHR2 | 31 |
| 19 | 53252457 | 53257305 | 4848 | loss | 2985 | PLA2G4C | 32 |
| 2 | 247981190 | 248006680 | 8490 | gain | 2971 | NCOA1 | 33 |
| 7 | 139728639 | 139853019 | 130400 | gain | 2946 | RAB19,SLC37A3,MKRN1 | 34 |
| 9 | 16567785 | 16576265 | 8480 | gain | 2988 | BNC2 | 35 |
| 1 | 16713074 | 17148592 | 435518 | gain | 2887 | NBPF1 | 36 |
| 1 | 16713074 | 17148592 | 435518 | gain | 2913 | NBPF1 | 36 |
| 1 | 16713074 | 16926444 | 213370 | gain | 2920 | NBPF3 | 37 |
| 1 | 16713074 | 17170039 | 419965 | gain | 2925 | NBPF1 | 38 |
| 1 | 16713074 | 16926444 | 213370 | gain | 2930 | NBPF3 | 37 |
| 1 | 16713074 | 17148592 | 435518 | gain | 2933 | NBPF1 | 36 |
| 1 | 16713074 | 16926444 | 213370 | gain | 2936 | NBPF3 | 37 |
| 1 | 16713074 | 17148592 | 435518 | gain | 2941 | NBPF1 | 36 |
| 1 | 16713074 | 17148592 | 435518 | gain | 2943 | NBPF1 | 36 |
| 1 | 16713074 | 17148592 | 435518 | gain | 2958 | NBPF1 | 36 |

FIG. 1B

| Chromosome | Original CNV Start | Original CNV Stop | Original CNV Size | CNV Type | Endo_Case ID | RefSeq Gene Symbol | SEQ ID |
|---|---|---|---|---|---|---|---|
| 1 | 16713074 | 16926444 | 213370 | gain | 2969 | NBPF1 | 37 |
| 1 | 16713074 | 17127039 | 413965 | gain | 2978 | NBPF1 | 38 |
| 1 | 16713074 | 17148592 | 435518 | gain | 2981 | NBPF1 | 36 |
| 1 | 16713074 | 17148592 | 435518 | gain | 2991 | NBPF1 | 36 |
| 1 | 16713074 | 17127039 | 413965 | gain | 2994 | NBPF1 | 38 |
| 1 | 16713074 | 16926444 | 213370 | gain | 2996 | NBPF1 | 37 |
| 1 | 16713074 | 17148592 | 435518 | gain | 2998 | NBPF1 | 36 |
| 1 | 16704522 | 16963812 | 259290 | loss | 3001 | NBPF1 | 39 |
| 1 | 16713074 | 17148592 | 435518 | gain | 3002 | NBPF1 | 36 |
| 1 | 16713074 | 17127039 | 413965 | gain | 3003 | NBPF1 | 38 |
| 15 | 86941339 | 86944414 | 3075 | gain | 2901 | | 40 |
| 15 | 86943691 | 86944414 | 723 | gain | 2913 | | 41 |
| 15 | 86941339 | 86944968 | 3629 | gain | 2923 | | 42 |
| 15 | 86941339 | 86944414 | 3075 | gain | 2925 | | 40 |
| 15 | 86941339 | 86944414 | 3075 | gain | 2937 | | 40 |
| 15 | 86943691 | 86944414 | 723 | gain | 2946 | | 41 |
| 15 | 86941339 | 86944414 | 3075 | gain | 2975 | | 40 |
| 15 | 86941339 | 86944414 | 3075 | gain | 2976 | | 40 |
| 15 | 86941339 | 86944414 | 3075 | gain | 2982 | | 40 |
| 15 | 86941339 | 86944968 | 3629 | gain | 2995 | | 42 |
| 15 | 86941339 | 86944968 | 3629 | gain | 2996 | | 42 |
| 15 | 86941339 | 86944414 | 3075 | gain | 3002 | | 40 |
| 15 | 86941339 | 86944414 | 3075 | gain | 2901 | | 40 |
| 15 | 86941339 | 86944968 | 3629 | gain | 2923 | | 42 |
| 15 | 86941339 | 86944414 | 3075 | gain | 2926 | | 40 |
| 15 | 86941339 | 86944414 | 3075 | gain | 2937 | | 40 |
| 15 | 86941339 | 86944414 | 3075 | gain | 2975 | | 40 |
| 15 | 86941339 | 86944414 | 3075 | gain | 2976 | | 40 |
| 15 | 86941339 | 86944414 | 3075 | gain | 2982 | | 40 |
| 15 | 86941339 | 86944968 | 3629 | gain | 2995 | | 42 |
| 15 | 86941339 | 86944968 | 3629 | gain | 2996 | | 42 |
| 15 | 86941339 | 86944414 | 3075 | gain | 3002 | | 40 |
| 2 | 191869063 | 191874236 | 5173 | loss | 2883 | MYO1B | 43 |
| 2 | 191869063 | 191874236 | 5173 | loss | 2899 | MYO1B | 43 |
| 2 | 191869063 | 191874236 | 5173 | loss | 2903 | MYO1B | 43 |

FIG. 1C

| Chromosome | Original_CNV_Start | Original_CNV_Stop | Original_CNV_Size | CNV_Type | Endo_Case_ID | RefSeq_Gene_Symbol | SEQ_ID |
|---|---|---|---|---|---|---|---|
| 2 | 191869063 | 191874236 | 5173 | loss | 2915 | MYO1B | 43 |
| 2 | 191869063 | 191874236 | 5173 | loss | 2922 | MYO1B | 43 |
| 2 | 191869063 | 191874236 | 5173 | loss | 2926 | MYO1B | 43 |
| 2 | 191869063 | 191874236 | 5173 | loss | 2938 | MYO1B | 43 |
| 2 | 191869063 | 191874236 | 5173 | loss | 2945 | MYO1B | 43 |
| 2 | 191869063 | 191874236 | 5173 | loss | 2953 | MYO1B | 43 |
| 2 | 191869063 | 191874236 | 5173 | loss | 2954 | MYO1B | 43 |
| 2 | 191869063 | 191874236 | 5173 | loss | 2962 | MYO1B | 43 |
| 2 | 191867698 | 191874236 | 6538 | loss | 2965 | MYO1B | 44 |
| 2 | 191869063 | 191874236 | 5173 | loss | 2966 | MYO1B | 43 |
| 2 | 191869063 | 191874236 | 5173 | loss | 2973 | MYO1B | 43 |
| 2 | 191869063 | 191874236 | 5173 | loss | 2974 | MYO1B | 43 |
| 2 | 191869063 | 191874236 | 5173 | loss | 2978 | MYO1B | 43 |
| 2 | 191869063 | 191875965 | 6902 | loss | 2979 | MYO1B | 45 |
| 2 | 191869063 | 191874236 | 5173 | loss | 2986 | MYO1B | 43 |
| 2 | 191869063 | 191874236 | 5173 | loss | 2992 | MYO1B | 43 |
| 2 | 191869063 | 191874236 | 5173 | loss | 3003 | MYO1B | 43 |
| 2 | 191869063 | 191874236 | 5173 | loss | 2883 | MYO1B | 43 |
| 2 | 191869063 | 191874236 | 5173 | loss | 2899 | MYO1B | 43 |
| 2 | 191869063 | 191874236 | 5173 | loss | 2903 | MYO1B | 43 |
| 2 | 191869063 | 191874236 | 5173 | loss | 2915 | MYO1B | 43 |
| 2 | 191869063 | 191874236 | 5173 | loss | 2922 | MYO1B | 43 |
| 2 | 191869063 | 191874236 | 5173 | loss | 2926 | MYO1B | 43 |
| 2 | 191869063 | 191874236 | 5173 | loss | 2938 | MYO1B | 43 |
| 2 | 191869063 | 191874236 | 5173 | loss | 2945 | MYO1B | 43 |
| 2 | 191869063 | 191874236 | 5173 | loss | 2953 | MYO1B | 43 |
| 2 | 191869063 | 191874236 | 5173 | loss | 2954 | MYO1B | 43 |
| 2 | 191867698 | 191874236 | 6538 | loss | 2962 | MYO1B | 44 |
| 2 | 191869063 | 191874236 | 5173 | loss | 2965 | MYO1B | 43 |
| 2 | 191869063 | 191874236 | 5173 | loss | 2966 | MYO1B | 43 |
| 2 | 191869063 | 191874236 | 5173 | loss | 2973 | MYO1B | 43 |
| 2 | 191869063 | 191874236 | 5173 | loss | 2974 | MYO1B | 43 |
| 2 | 191869063 | 191874236 | 5173 | loss | 2978 | MYO1B | 43 |
| 2 | 191869063 | 191875965 | 6902 | loss | 2979 | MYO1B | 45 |
| 2 | 191869063 | 191874236 | 5173 | loss | 2996 | MYO1B | 43 |

FIG. 1D

| Chromosome | Original_CNV_Start | Original_CNV_Stop | Original_CNV_Size | CNV_Type | Endo_Case_ID | RefSeq_Gene_Symbol | SEQ_ID |
|---|---|---|---|---|---|---|---|
| 2 | 191869063 | 191874236 | 5173 | loss | 2999 | MYO1B | 43 |
| 2 | 191869063 | 191874236 | 5173 | loss | 3003 | MYO1B | 43 |
| 6 | 47731384 | 47734315 | 2931 | loss | 2905 | GPR111 | 46 |
| 6 | 47731384 | 47734315 | 2931 | loss | 2909 | GPR111 | 46 |
| 6 | 47731384 | 47734315 | 2931 | loss | 2915 | GPR111 | 46 |
| 6 | 47731384 | 47734315 | 2931 | loss | 2917 | GPR111 | 46 |
| 6 | 47731384 | 47734315 | 2931 | loss | 2919 | GPR111 | 46 |
| 6 | 47731384 | 47734315 | 2931 | loss | 2924 | GPR111 | 46 |
| 6 | 47731384 | 47734315 | 2931 | loss | 2926 | GPR111 | 46 |
| 6 | 47731384 | 47734315 | 2931 | loss | 2930 | GPR111 | 46 |
| 6 | 47731384 | 47734315 | 2931 | loss | 2933 | GPR111 | 46 |
| 6 | 47731384 | 47734315 | 2931 | loss | 2946 | GPR111 | 46 |
| 6 | 47731384 | 47734315 | 2931 | loss | 2951 | GPR111 | 46 |
| 6 | 47731384 | 47734315 | 2931 | loss | 2961 | GPR111 | 46 |
| 6 | 47731384 | 47734315 | 2931 | loss | 2976 | GPR111 | 46 |
| 6 | 47731384 | 47734315 | 2931 | loss | 2983 | GPR111 | 46 |
| 6 | 47731384 | 47734315 | 2931 | loss | 2985 | GPR111 | 46 |
| 6 | 70290311 | 70295413 | 5102 | gain | 2910 | | 47 |
| 6 | 70290311 | 70295413 | 5102 | gain | 2914 | | 47 |
| 6 | 70290311 | 70295413 | 5102 | gain | 2919 | | 47 |
| 6 | 70290311 | 70295413 | 5102 | gain | 2921 | | 47 |
| 6 | 70290311 | 70295413 | 5102 | gain | 2923 | | 47 |
| 6 | 70290311 | 70295413 | 5102 | gain | 2924 | | 47 |
| 6 | 70290311 | 70295413 | 5102 | gain | 2937 | | 47 |
| 6 | 70290311 | 70295413 | 5102 | gain | 2943 | | 47 |
| 6 | 70290311 | 70295413 | 5102 | gain | 2948 | | 47 |
| 6 | 70290311 | 70295413 | 5102 | gain | 2959 | | 47 |
| 6 | 70290311 | 70295413 | 5102 | gain | 2979 | | 47 |
| 6 | 70290311 | 70295413 | 5102 | gain | 2981 | | 47 |
| 6 | 70290311 | 70295413 | 5102 | gain | 2982 | | 47 |
| 6 | 70290311 | 70295413 | 5102 | gain | 2983 | | 47 |
| 6 | 70290311 | 70295413 | 5102 | gain | 2985 | | 47 |

FIG. 1E

| SRN | Chromosome | CNV_Subregion_Start | CNV_Subregion_Stop | CNV_Sub region_Size | CNV_Type | Endo_Case_ID(s) | RefSeq_Gene_Symbol | Exon_overlap | NVE_cases | End_cases | FET | OR | Category |
|---|---|---|---|---|---|---|---|---|---|---|---|---|---|
| 1 | 1 | 92013987 | 92020793 | 6806 | loss | 2883 | TGFBR3 | N | 0 | 3 | 6.80E-05 | 72.19 | stats_biology |
| 2 | 1 | 92013987 | 92020793 | 6806 | loss | 2923 | TGFBR3 | N | 0 | 3 | 6.80E-05 | 72.19 | stats_biology |
| 3 | 1 | 92013987 | 92020793 | 6806 | loss | 2971 | TGFBR3 | N | 0 | 3 | 6.80E-05 | 72.19 | stats_biology |
| 4 | 23 | 149901706 | 149902701 | 995 | gain | 2898 | HMGB3 | Y | 0 | 4 | 6.32E-05 | 93.78 | stats_biology |
| 5 | 23 | 149901706 | 149902701 | 995 | gain | 2899 | HMGB3 | Y | 0 | 4 | 6.32E-05 | 93.78 | stats_biology |
| 6 | 23 | 149901706 | 149902701 | 995 | gain | 2907 | HMGB3 | Y | 0 | 4 | 6.32E-05 | 93.78 | stats_biology |
| 7 | 23 | 149901706 | 149902701 | 995 | gain | 2909 | HMGB3 | Y | 0 | 4 | 6.32E-05 | 93.78 | stats_biology |
| 8 | 23 | 149902702 | 149904265 | 1563 | gain | 2883 | HMGB3 | N | 2 | 5 | 1.00E-04 | 26.39 | biology |
| 9 | 23 | 149902702 | 149904265 | 1563 | gain | 2898 | HMGB3 | N | 2 | 5 | 1.00E-04 | 26.39 | biology |
| 10 | 23 | 149902702 | 149904265 | 1563 | gain | 2899 | HMGB3 | N | 2 | 5 | 1.00E-04 | 26.39 | biology |
| 11 | 23 | 149902702 | 149904265 | 1563 | gain | 2907 | HMGB3 | N | 2 | 5 | 1.00E-04 | 26.39 | biology |
| 12 | 23 | 149902702 | 149904265 | 1563 | gain | 2909 | HMGB3 | N | 2 | 5 | 1.00E-04 | 26.39 | biology |
| 13 | 6 | 96610680 | 96625609 | 14929 | gain | 2905 | FUT9 | N | 0 | 4 | 6.32E-05 | 93.78 | stats_biology |
| 14 | 6 | 96610680 | 96625609 | 14929 | gain | 2910 | FUT9 | N | 0 | 4 | 6.32E-05 | 93.78 | stats_biology |
| 15 | 6 | 96610680 | 96625609 | 14929 | gain | 2916 | FUT9 | N | 0 | 4 | 6.32E-05 | 93.78 | stats_biology |
| 16 | 6 | 96610680 | 96625609 | 14929 | gain | 2924 | FUT9 | N | 0 | 4 | 6.32E-05 | 93.78 | stats_biology |
| 17 | 7 | 31844434 | 31851158 | 6724 | gain | 2883 | PDE1C | N | 0 | 3 | 6.80E-05 | 72.19 | stats_biology |
| 18 | 7 | 31844434 | 31851158 | 6724 | gain | 2973 | PDE1C | N | 0 | 3 | 6.80E-05 | 72.19 | stats_biology |
| 19 | 7 | 31844434 | 31851158 | 6724 | gain | 2978 | PDE1C | N | 0 | 3 | 6.80E-05 | 72.19 | stats |

FIG. 2A

| SRN | Chromo some | CNV_ Subregion_ Start | CNV_ Subregion_ Stop | CNV_Sub region_Si ze | CNV_ Type | Endo_ Case_ ID(s) | RefSeq_ Gene_ Symbol | Exon_ over- lap | NVE_ cases | End_ cases | FET | OR | Category |
|---|---|---|---|---|---|---|---|---|---|---|---|---|---|
| 20 | 10 | 59620764 | 59630493 | 9729 | gain | 2955 | IPMK | Y | 0 | 3 | 6.80E-05 | 72.19 | stats_ biology |
| 21 | 10 | 59620764 | 59630493 | 9729 | gain | 2977 | IPMK | Y | 0 | 3 | 6.80E-05 | 72.19 | stats_ biology |
| 22 | 10 | 59620764 | 59630493 | 9729 | gain | 2978 | IPMK | Y | 0 | 3 | 6.80E-05 | 72.19 | stats_ biology |
| 23 | 2 | 233285559 | 233298235 | 12676 | gain | 2924 | GIGYF2 | N | 0 | 3 | 6.80E-05 | 72.19 | stats_ biology |
| 24 | 2 | 233285559 | 233298235 | 12676 | gain | 2950 | GIGYF2 | N | 0 | 3 | 6.80E-05 | 72.19 | stats_ biology |
| 25 | 2 | 233285559 | 233298235 | 12676 | gain | 2999 | GIGYF2 | N | 0 | 3 | 6.80E-05 | 72.19 | stats_ biology |
| 26 | 6 | 138516944 | 138520155 | 3211 | gain | 2968 | | N | 0 | 3 | 6.80E-05 | 72.19 | stats_ biology |
| 27 | 6 | 138516944 | 138520155 | 3211 | gain | 2971 | | N | 0 | 3 | 6.80E-05 | 72.19 | stats_ biology |
| 28 | 6 | 138516944 | 138520155 | 3211 | gain | 2978 | | N | 0 | 3 | 6.80E-05 | 72.19 | stats_ biology |
| 29 | 11 | 44056561 | 44058123 | 1562 | loss | 2883 | ACCS | Y | 0 | 3 | 6.80E-05 | 72.19 | stats |
| 30 | 11 | 44056561 | 44058123 | 1562 | loss | 2948 | ACCS | Y | 0 | 3 | 6.80E-05 | 72.19 | stats |
| 31 | 11 | 44056561 | 44058123 | 1562 | loss | 2950 | ACCS | Y | 0 | 3 | 6.80E-05 | 72.19 | stats |
| 32 | 7 | 153645525 | 153647352 | 1827 | loss | 2923 | DPP6 | N | 0 | 3 | 6.80E-05 | 72.19 | stats |
| 33 | 7 | 153645525 | 153647352 | 1827 | loss | 2976 | DPP6 | N | 0 | 3 | 6.80E-05 | 72.19 | stats |
| 34 | 7 | 153645525 | 153647352 | 1827 | loss | 2977 | DPP6 | N | 0 | 3 | 6.80E-05 | 72.19 | stats |
| 35 | 6 | 120674750 | 120680729 | 5979 | loss | 2882 | | N | 0 | 3 | 6.80E-05 | 72.19 | stats |
| 36 | 6 | 120674750 | 120680729 | 5979 | loss | 2922 | | N | 0 | 3 | 6.80E-05 | 72.19 | stats |
| 37 | 6 | 120674750 | 120680729 | 5979 | loss | 2951 | | N | 0 | 3 | 6.80E-05 | 72.19 | stats |
| 38 | 16 | 31356038 | 31434641 | 78603 | gain | 2975 | ARMC5, C16o rf58,SL C5A2, | Y | 0 | 1 | 8.40E-03 | 30.32 | biology |

FIG. 2B

| SRN | Chromo some | CNV_ Subregion_ Start | CNV_ Subregion_ Stop | CNV_Sub region_SI ze | CNV_ Type | Endo_ Case_ ID(s) | RefSeq_ Gene_ Symbol | Exon_ over- lap | NVE_ cases | End_ cases | FET | OR | Category |
|---|---|---|---|---|---|---|---|---|---|---|---|---|---|
|  |  |  |  |  |  |  | TGFB11 1,ZNF 843 |  |  |  |  |  |  |
| 39 | 8 | 142060703 | 142065735 | 5032 | loss | 2954 | PTK2 | Y | 0 | 1 | 8.40E-03 | 30.32 | biology |
| 40 | 4 | 129189476 | 129451283 | 261807 | gain | 3001 | LARP1B, PGR MC2 | Y | 0 | 1 | 8.40E-03 | 30.32 | biology |
| 41 | 19 | 41532062 | 41533404 | 1342 | gain | 2885 | ZFP14 | N | 1 | 5 | 3.08E-05 | 52.84 | stats |
| 42 | 19 | 41532062 | 41533404 | 1342 | gain | 2925 | ZFP14 | N | 1 | 5 | 3.08E-05 | 52.84 | stats |
| 43 | 19 | 41532062 | 41533404 | 1342 | gain | 2969 | ZFP14 | N | 1 | 5 | 3.08E-05 | 52.84 | stats |
| 44 | 19 | 41532062 | 41533404 | 1342 | gain | 2977 | ZFP14 | N | 1 | 5 | 3.08E-05 | 52.84 | stats |
| 45 | 19 | 41532062 | 41533404 | 1342 | gain | 3000 | ZFP14 | N | 1 | 5 | 3.08E-05 | 52.84 | stats |
| 46 | 1 | 65627570 | 65696043 | 68473 | gain | 2942 | DNAJC6 ,LEPR,L EPROT | Y | 1 | 1 | 1.73E-01 | 10.14 | biology |
| 47 | 3 | 197001562 | 197065388 | 63826 | gain | 2997 | MUC4 | Y | 1 | 1 | 1.73E-01 | 10.14 | biology |
| 48 | 23 | 148575584 | 148608166 | 32582 | gain | 2901 | MAGEA1 1 | Y | 1 | 1 | 1.73E-01 | 10.14 | biology |
| 49 | 2 | 242109998 | 242153935 | 43937 | gain | 2959 | BOK,BO K-AS1 | Y | 0 | 1 | 8.40E-03 | 30.32 | biology |
| 50 | 14 | 80613390 | 80649876 | 36486 | gain | 2981 | TSHR | Y | 0 | 1 | 8.40E-03 | 30.32 | biology |
| 51 | 23 | 64731495 | 64811828 | 80333 | gain | 2932 | MSN | Y | 0 | 1 | 8.40E-03 | 30.32 | biology |
| 52 | 2 | 33773800 | 33903436 | 129636 | loss | 2913 | MYADM L | Y | 0 | 1 | 8.40E-03 | 30.32 | biology |

FIG. 2C

| SRN | Chromosome | CNV_Subregion_Start | CNV_Subregion_Stop | CNV_Subregion_Size | CNV_Type | Endo_Case_ID(s) | RefSeq_Gene_Symbol | Exon_overlap | IVE_cases | Endo_cases | FET | OR | Category |
|---|---|---|---|---|---|---|---|---|---|---|---|---|---|
| 53 | 10 | 104571485 | 104810431 | 238946 | gain | 2921 | AS3MT, C10orf32,C10orf32-AS3MT, CNNM2,CYP17A1 | Y | 0 | 1 | 8.40E-03 | 30.32 | biology |
| 54 | 4 | 159674653 | 159683362 | 8709 | loss | 2934 | RXFP1 | N | 0 | 1 | 0.00839913 | 30.32 | biology |
| 55 | 7 | 30668143 | 30681882 | 13739 | loss | 2968 | CRHR2 | Y | 0 | 1 | 0.00839913 | 30.32 | biology |
| 56 | 19 | 53252457 | 53257305 | 4848 | loss | 2985 | PLA2G4C | Y | 0 | 1 | 0.00839913 | 30.32 | biology |
| 57 | 2 | 24798190 | 24806680 | 8490 | gain | 2971 | NCOA1 | Y | 0 | 1 | 0.00839913 | 30.32 | biology |
| 58 | 7 | 139757225 | 139828667 | 71442 | gain | 2946 | MKRN1, RAB19 | Y | 0 | 1 | 0.00839913 | 30.32 | biology |
| 59 | 9 | 16557785 | 16576265 | 8480 | gain | 2968 | BNC2 | Y | 0 | 1 | 0.00839913 | 30.32 | biology |
| 60 | 1 | 16713074 | 16799710 | 86636 | gain | 2887 | NBPF1 | Y | 42 | 20 | 8.70E-08 | 5.73 | stats_biology |
| 61 | 1 | 16713074 | 16799710 | 86636 | gain | 2913 | NBPF1 | Y | 42 | 20 | 8.70E-08 | 5.73 | stats_biology |
| 62 | 1 | 16713074 | 16799710 | 86636 | gain | 2920 | NBPF1 | Y | 42 | 20 | 8.70E-08 | 5.73 | stats_biology |
| 63 | 1 | 16713074 | 16799710 | 86636 | gain | 2925 | NBPF1 | Y | 42 | 20 | 8.70E-08 | 5.73 | stats_biology |
| 64 | 1 | 16713074 | 16799710 | 86636 | gain | 2930 | NBPF1 | Y | 42 | 20 | 8.70E-08 | 5.73 | stats_biology |
| 65 | 1 | 16713074 | 16799710 | 86636 | gain | 2933 | NBPF1 | Y | 42 | 20 | 8.70E-08 | 5.73 | stats_biology |
| 66 | 1 | 16713074 | 16799710 | 86636 | gain | 2936 | NBPF1 | Y | 42 | 20 | 8.70E-08 | 5.73 | stats |

FIG. 2D

| SRN | Chromosome | CNV_Subregion_Start | CNV_Subregion_Stop | CNV_Subregion_Size | CNV_Type | Endo_Case_ID(s) | RefSeq_Gene_Symbol | Exon_overlap | NVE_cases | End_cases | FET | OR | Category |
|---|---|---|---|---|---|---|---|---|---|---|---|---|---|
| 67 | 1 | 16713074 | 16799710 | 86636 | gain | 2941 | NBPF1 | Y | 42 | 20 | 8.70E-08 | 5.73 | stats_biology |
| 68 | 1 | 16713074 | 16799710 | 86636 | gain | 2943 | NBPF1 | Y | 42 | 20 | 8.70E-08 | 5.73 | stats_biology |
| 69 | 1 | 16713074 | 16799710 | 86636 | gain | 2968 | NBPF1 | Y | 42 | 20 | 8.70E-08 | 5.73 | stats_biology |
| 70 | 1 | 16713074 | 16799710 | 86636 | gain | 2969 | NBPF1 | Y | 42 | 20 | 8.70E-08 | 5.73 | stats_biology |
| 71 | 1 | 16713074 | 16799710 | 86636 | gain | 2978 | NBPF1 | Y | 42 | 20 | 8.70E-08 | 5.73 | stats_biology |
| 72 | 1 | 16713074 | 16799710 | 86636 | gain | 2981 | NBPF1 | Y | 42 | 20 | 8.70E-08 | 5.73 | stats_biology |
| 73 | 1 | 16713074 | 16799710 | 86636 | gain | 2991 | NBPF1 | Y | 42 | 20 | 8.70E-08 | 5.73 | stats_biology |
| 74 | 1 | 16713074 | 16799710 | 86636 | gain | 2994 | NBPF1 | Y | 42 | 20 | 8.70E-08 | 5.73 | stats_biology |
| 75 | 1 | 16713074 | 16799710 | 86636 | gain | 2996 | NBPF1 | Y | 42 | 20 | 8.70E-08 | 5.73 | stats_biology |
| 76 | 1 | 16713074 | 16799710 | 86636 | gain | 2998 | NBPF1 | Y | 42 | 20 | 8.70E-08 | 5.73 | stats_biology |
| 77 | 1 | 16713074 | 16799710 | 86636 | gain | 3001 | NBPF1 | Y | 42 | 20 | 8.70E-08 | 5.73 | stats_biology |
| 78 | 1 | 16713074 | 16799710 | 86636 | gain | 3002 | NBPF1 | Y | 42 | 20 | 8.70E-08 | 5.73 | stats_biology |
| 79 | 1 | 16713074 | 16799710 | 86636 | gain | 3003 | NBPF1 | Y | 42 | 20 | 8.70E-08 | 5.73 | stats_biology |
| 80 | 15 | 86943691 | 86944414 | 723 | gain | 2901 | | N | 20 | 12 | 7.73E-06 | 6.72 | stats_biology |
| 81 | 15 | 86943691 | 86944414 | 723 | gain | 2913 | | N | 20 | 12 | 7.73E-06 | 6.72 | stats_biology |
| 82 | 15 | 86943691 | 86944414 | 723 | gain | 2923 | | N | 20 | 12 | 7.73E-06 | 6.72 | stats_biology |

FIG. 2E

| SRN | Chromosome | CNV_Subregion_Start | CNV_Subregion_Stop | CNV_Subregion_Size | CNV_Type | Endo_Case_ID(s) | RefSeq_Gene_Symbol | Exon_overlap | NVE_cases | End_cases | FET | OR | Category |
|---|---|---|---|---|---|---|---|---|---|---|---|---|---|
| 83 | 15 | 86943691 | 86944414 | 723 | gain | 2926 | | N | 20 | 12 | 7.73E-06 | 6.72 | stats_biology |
| 84 | 15 | 86943691 | 86944414 | 723 | gain | 2937 | | N | 20 | 12 | 7.73E-06 | 6.72 | stats_biology |
| 85 | 15 | 86943691 | 86944414 | 723 | gain | 2946 | | N | 20 | 12 | 7.73E-06 | 6.72 | stats_biology |
| 86 | 15 | 86943691 | 86944414 | 723 | gain | 2975 | | N | 20 | 12 | 7.73E-06 | 6.72 | stats_biology |
| 87 | 15 | 86943691 | 86944414 | 723 | gain | 2976 | | N | 20 | 12 | 7.73E-06 | 6.72 | stats_biology |
| 88 | 15 | 86943691 | 86944414 | 723 | gain | 2982 | | N | 20 | 12 | 7.73E-06 | 6.72 | stats_biology |
| 89 | 15 | 86943691 | 86944414 | 723 | gain | 2995 | | N | 20 | 12 | 7.73E-06 | 6.72 | stats_biology |
| 90 | 15 | 86943691 | 86944414 | 723 | gain | 2996 | | N | 20 | 12 | 7.73E-06 | 6.72 | stats_biology |
| 91 | 15 | 86943691 | 86944414 | 723 | gain | 3002 | | N | 20 | 12 | 7.73E-06 | 6.72 | stats_biology |
| 92 | 15 | 86941339 | 86943690 | 2351 | gain | 2901 | | N | 17 | 10 | 5.43E-05 | 6.46 | stats_biology |
| 93 | 15 | 86941339 | 86943690 | 2351 | gain | 2923 | | N | 17 | 10 | 5.43E-05 | 6.46 | stats_biology |
| 94 | 15 | 86941339 | 86943690 | 2351 | gain | 2926 | | N | 17 | 10 | 5.43E-05 | 6.46 | stats_biology |
| 95 | 15 | 86941339 | 86943690 | 2351 | gain | 2937 | | N | 17 | 10 | 5.43E-05 | 6.46 | stats_biology |
| 96 | 15 | 86941339 | 86943690 | 2351 | gain | 2975 | | N | 17 | 10 | 5.43E-05 | 6.46 | stats_biology |
| 97 | 15 | 86941339 | 86943690 | 2351 | gain | 2976 | | N | 17 | 10 | 5.43E-05 | 6.46 | stats_biology |
| 98 | 15 | 86941339 | 86943690 | 2351 | gain | 2982 | | N | 17 | 10 | 5.43E-05 | 6.46 | stats_biology |
| 99 | 15 | 86941339 | 86943690 | 2351 | gain | 2995 | | N | 17 | 10 | 5.43E-05 | 6.46 | stats |

FIG. 2F

| SRN | Chromo some | CNV_ Subregion_ Start | CNV_ Subregion_ Stop | CNV_Sub region_Si ze | CNV_ Type | Endo_ Case_ ID(s) | RefSeq_ Gene_ Symbol | Exon over- lap | NVE_ cases | End_ cases | FET | OR | Category |
|---|---|---|---|---|---|---|---|---|---|---|---|---|---|
|  |  |  |  |  |  |  |  |  |  |  |  |  | biology |
| 100 | 15 | 86941339 | 86943690 | 2351 | gain | 2996 |  | N | 17 | 10 | 5.43E-05 | 6.46 | stats_ biology |
| 101 | 15 | 86941339 | 86943690 | 2351 | gain | 3002 |  | N | 17 | 10 | 5.43E-05 | 6.46 | stats_ biology |
| 102 | 2 | 191869063 | 191873037 | 3974 | loss | 2883 | MYO1B | Y | 22 | 20 | 2.15E-11 | 11.17 | stats |
| 103 | 2 | 191869063 | 191873037 | 3974 | loss | 2899 | MYO1B | Y | 22 | 20 | 2.15E-11 | 11.17 | stats |
| 104 | 2 | 191869063 | 191873037 | 3974 | loss | 2903 | MYO1B | Y | 22 | 20 | 2.15E-11 | 11.17 | stats |
| 105 | 2 | 191869063 | 191873037 | 3974 | loss | 2915 | MYO1B | Y | 22 | 20 | 2.15E-11 | 11.17 | stats |
| 106 | 2 | 191869063 | 191873037 | 3974 | loss | 2922 | MYO1B | Y | 22 | 20 | 2.15E-11 | 11.17 | stats |
| 107 | 2 | 191869063 | 191873037 | 3974 | loss | 2926 | MYO1B | Y | 22 | 20 | 2.15E-11 | 11.17 | stats |
| 108 | 2 | 191869063 | 191873037 | 3974 | loss | 2938 | MYO1B | Y | 22 | 20 | 2.15E-11 | 11.17 | stats |
| 109 | 2 | 191869063 | 191873037 | 3974 | loss | 2945 | MYO1B | Y | 22 | 20 | 2.15E-11 | 11.17 | stats |
| 110 | 2 | 191869063 | 191873037 | 3974 | loss | 2953 | MYO1B | Y | 22 | 20 | 2.15E-11 | 11.17 | stats |
| 111 | 2 | 191869063 | 191873037 | 3974 | loss | 2954 | MYO1B | Y | 22 | 20 | 2.15E-11 | 11.17 | stats |
| 112 | 2 | 191869063 | 191873037 | 3974 | loss | 2962 | MYO1B | Y | 22 | 20 | 2.15E-11 | 11.17 | stats |
| 113 | 2 | 191869063 | 191873037 | 3974 | loss | 2965 | MYO1B | Y | 22 | 20 | 2.15E-11 | 11.17 | stats |
| 114 | 2 | 191869063 | 191873037 | 3974 | loss | 2966 | MYO1B | Y | 22 | 20 | 2.15E-11 | 11.17 | stats |
| 115 | 2 | 191869063 | 191873037 | 3974 | loss | 2973 | MYO1B | Y | 22 | 20 | 2.15E-11 | 11.17 | stats |
| 116 | 2 | 191869063 | 191873037 | 3974 | loss | 2974 | MYO1B | Y | 22 | 20 | 2.15E-11 | 11.17 | stats |
| 117 | 2 | 191869063 | 191873037 | 3974 | loss | 2978 | MYO1B | Y | 22 | 20 | 2.15E-11 | 11.17 | stats |
| 118 | 2 | 191869063 | 191873037 | 3974 | loss | 2979 | MYO1B | Y | 22 | 20 | 2.15E-11 | 11.17 | stats |
| 119 | 2 | 191869063 | 191873037 | 3974 | loss | 2996 | MYO1B | Y | 22 | 20 | 2.15E-11 | 11.17 | stats |
| 120 | 2 | 191869063 | 191873037 | 3974 | loss | 2999 | MYO1B | Y | 22 | 20 | 2.15E-11 | 11.17 | stats |
| 121 | 2 | 191869063 | 191873037 | 3974 | loss | 3003 | MYO1B | Y | 22 | 20 | 2.15E-11 | 11.17 | stats |
| 122 | 2 | 191873038 | 191874236 | 1198 | loss | 2883 | MYO1B | N | 28 | 20 | 4.49E-10 | 8.72 | stats |
| 123 | 2 | 191873038 | 191874236 | 1198 | loss | 2899 | MYO1B | N | 28 | 20 | 4.49E-10 | 8.72 | stats |
| 124 | 2 | 191873038 | 191874236 | 1198 | loss | 2903 | MYO1B | N | 28 | 20 | 4.49E-10 | 8.72 | stats |
| 125 | 2 | 191873038 | 191874236 | 1198 | loss | 2915 | MYO1B | N | 28 | 20 | 4.49E-10 | 8.72 | stats |
| 126 | 2 | 191873038 | 191874236 | 1198 | loss | 2922 | MYO1B | N | 28 | 20 | 4.49E-10 | 8.72 | stats |

FIG. 2G

| SRN | Chromosome | CNV_Subregion_Start | CNV_Subregion_Stop | CNV_Subregion_Size | CNV_Type | Endo_Case_ID(s) | RefSeq_Gene_Symbol | Exon_overlap | NVE_cases | End_cases | FET | OR | Category |
|---|---|---|---|---|---|---|---|---|---|---|---|---|---|
| 127 | 2 | 191873038 | 191874236 | 1198 | loss | 2926 | MYO1B | N | 28 | 20 | 4.49E-10 | 8.72 | stats |
| 128 | 2 | 191873038 | 191874236 | 1198 | loss | 2938 | MYO1B | N | 28 | 20 | 4.49E-10 | 8.72 | stats |
| 129 | 2 | 191873038 | 191874236 | 1198 | loss | 2945 | MYO1B | N | 28 | 20 | 4.49E-10 | 8.72 | stats |
| 130 | 2 | 191873038 | 191874236 | 1198 | loss | 2953 | MYO1B | N | 28 | 20 | 4.49E-10 | 8.72 | stats |
| 131 | 2 | 191873038 | 191874236 | 1198 | loss | 2954 | MYO1B | N | 28 | 20 | 4.49E-10 | 8.72 | stats |
| 132 | 2 | 191873038 | 191874236 | 1198 | loss | 2962 | MYO1B | N | 28 | 20 | 4.49E-10 | 8.72 | stats |
| 133 | 2 | 191873038 | 191874236 | 1198 | loss | 2965 | MYO1B | N | 28 | 20 | 4.49E-10 | 8.72 | stats |
| 134 | 2 | 191873038 | 191874236 | 1198 | loss | 2966 | MYO1B | N | 28 | 20 | 4.49E-10 | 8.72 | stats |
| 135 | 2 | 191873038 | 191874236 | 1198 | loss | 2973 | MYO1B | N | 28 | 20 | 4.49E-10 | 8.72 | stats |
| 136 | 2 | 191873038 | 191874236 | 1198 | loss | 2974 | MYO1B | N | 28 | 20 | 4.49E-10 | 8.72 | stats |
| 137 | 2 | 191873038 | 191874236 | 1198 | loss | 2978 | MYO1B | N | 28 | 20 | 4.49E-10 | 8.72 | stats |
| 138 | 2 | 191873038 | 191874236 | 1198 | loss | 2979 | MYO1B | N | 28 | 20 | 4.49E-10 | 8.72 | stats |
| 139 | 2 | 191873038 | 191874236 | 1198 | loss | 2996 | MYO1B | N | 28 | 20 | 4.49E-10 | 8.72 | stats |
| 140 | 2 | 191873038 | 191874236 | 1198 | loss | 2999 | MYO1B | N | 28 | 20 | 4.49E-10 | 8.72 | stats |
| 141 | 2 | 191873038 | 191874236 | 1198 | loss | 3003 | MYO1B | N | 28 | 20 | 4.49E-10 | 8.72 | stats |
| 142 | 6 | 47731384 | 47734315 | 2931 | loss | 2905 | GPR111 | Y | 23 | 15 | 2.18E-07 | 7.53 | stats |
| 143 | 6 | 47731384 | 47734315 | 2931 | loss | 2909 | GPR111 | Y | 23 | 15 | 2.18E-07 | 7.53 | stats |
| 144 | 6 | 47731384 | 47734315 | 2931 | loss | 2915 | GPR111 | Y | 23 | 15 | 2.18E-07 | 7.53 | stats |
| 145 | 6 | 47731384 | 47734315 | 2931 | loss | 2917 | GPR111 | Y | 23 | 15 | 2.18E-07 | 7.53 | stats |
| 146 | 6 | 47731384 | 47734315 | 2931 | loss | 2919 | GPR111 | Y | 23 | 15 | 2.18E-07 | 7.53 | stats |
| 147 | 6 | 47731384 | 47734315 | 2931 | loss | 2924 | GPR111 | Y | 23 | 15 | 2.18E-07 | 7.53 | stats |
| 148 | 6 | 47731384 | 47734315 | 2931 | loss | 2926 | GPR111 | Y | 23 | 15 | 2.18E-07 | 7.53 | stats |
| 149 | 6 | 47731384 | 47734315 | 2931 | loss | 2930 | GPR111 | Y | 23 | 15 | 2.18E-07 | 7.53 | stats |
| 150 | 6 | 47731384 | 47734315 | 2931 | loss | 2933 | GPR111 | Y | 23 | 15 | 2.18E-07 | 7.53 | stats |
| 151 | 6 | 47731384 | 47734315 | 2931 | loss | 2946 | GPR111 | Y | 23 | 15 | 2.18E-07 | 7.53 | stats |
| 152 | 6 | 47731384 | 47734315 | 2931 | loss | 2951 | GPR111 | Y | 23 | 15 | 2.18E-07 | 7.53 | stats |
| 153 | 6 | 47731384 | 47734315 | 2931 | loss | 2961 | GPR111 | Y | 23 | 15 | 2.18E-07 | 7.53 | stats |
| 154 | 6 | 47731384 | 47734315 | 2931 | loss | 2976 | GPR111 | Y | 23 | 15 | 2.18E-07 | 7.53 | stats |
| 155 | 6 | 47731384 | 47734315 | 2931 | loss | 2983 | GPR111 | Y | 23 | 15 | 2.18E-07 | 7.53 | stats |
| 156 | 6 | 47731384 | 47734315 | 2931 | loss | 2985 | GPR111 | Y | 23 | 15 | 2.18E-07 | 7.53 | stats |

FIG. 2H

| SRN | Chromosome | CNV_Subregion_Start | CNV_Subregion_Stop | CNV_Sub region_Size | CNV_Type | Endo_Case_ID(s) | RefSeq_Gene_Symbol | Exon_overlap | AVE_cases | End_cases | FET | OR | Category |
|---|---|---|---|---|---|---|---|---|---|---|---|---|---|
| 157 | 6 | 70290311 | 70295413 | 5102 | gain | 2910 | | N | 45 | 16 | 4.16E-05 | 4.06 | stats |
| 158 | 6 | 70290311 | 70295413 | 5102 | gain | 2914 | | N | 45 | 16 | 4.16E-05 | 4.06 | stats |
| 159 | 6 | 70290311 | 70295413 | 5102 | gain | 2919 | | N | 45 | 16 | 4.16E-05 | 4.06 | stats |
| 160 | 6 | 70290311 | 70295413 | 5102 | gain | 2921 | | N | 45 | 16 | 4.16E-05 | 4.06 | stats |
| 161 | 6 | 70290311 | 70295413 | 5102 | gain | 2923 | | N | 45 | 16 | 4.16E-05 | 4.06 | stats |
| 162 | 6 | 70290311 | 70295413 | 5102 | gain | 2924 | | N | 45 | 16 | 4.16E-05 | 4.06 | stats |
| 163 | 6 | 70290311 | 70295413 | 5102 | gain | 2937 | | N | 45 | 16 | 4.16E-05 | 4.06 | stats |
| 164 | 6 | 70290311 | 70295413 | 5102 | gain | 2943 | | N | 45 | 16 | 4.16E-05 | 4.06 | stats |
| 165 | 6 | 70290311 | 70295413 | 5102 | gain | 2944 | | N | 45 | 16 | 4.16E-05 | 4.06 | stats |
| 166 | 6 | 70290311 | 70295413 | 5102 | gain | 2948 | | N | 45 | 16 | 4.16E-05 | 4.06 | stats |
| 167 | 6 | 70290311 | 70295413 | 5102 | gain | 2959 | | N | 45 | 16 | 4.16E-05 | 4.06 | stats |
| 168 | 6 | 70290311 | 70295413 | 5102 | gain | 2979 | | N | 45 | 16 | 4.16E-05 | 4.06 | stats |
| 169 | 6 | 70290311 | 70295413 | 5102 | gain | 2981 | | N | 45 | 16 | 4.16E-05 | 4.06 | stats |
| 170 | 6 | 70290311 | 70295413 | 5102 | gain | 2982 | | N | 45 | 16 | 4.16E-05 | 4.06 | stats |
| 171 | 6 | 70290311 | 70295413 | 5102 | gain | 2983 | | N | 45 | 16 | 4.16E-05 | 4.06 | stats |
| 172 | 6 | 70290311 | 70295413 | 5102 | gain | 2985 | | N | 45 | 16 | 4.16E-05 | 4.06 | stats |

FIG. 2I

| RefSeq Gene Symbol | Exon_o verlap | NCBI_Gene ID | Gene_Description | RefSeq_Summary |
|---|---|---|---|---|
| ACCS | exonic | 84680 | 1-aminocyclopropane-1-carboxylate synthase-like protein 1 | N/A |
| ARMC5 | exonic | 79798 | armadillo repeat-containing protein 5 isoform a precursor | N/A |
| AS3MT | exonic | 57412 | arsenite methyltransferase | AS3MT catalyzes the transfer of a methyl group from S-adenosyl-L-methionine (AdoMet) to trivalent arsenical and may play a role in arsenic metabolism. Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: BC119637.1, BC119637.1 [ECO:0000332] RNAseq introns :: single sample supports all introns ERS025084, ERS025085 [ECO:0000348] ##Evidence-Data-END## |
| BNC2 | exonic | 54796 | zinc finger protein basonuclin-2 | N/A |

FIG. 3A

| RefSeq Gene Symbol | Exon_o verlap | NCBI_Gene ID | Gene Description | RefSeq_Summary |
|---|---|---|---|---|
| BOK | exonic | 100379249 | bcl-2-related ovarian killer protein | The protein encoded by this gene belongs to the BCL2 family, members of which form homo- or heterodimers, and act as anti- or proapoptotic regulators that are involved in a wide variety of cellular processes. Studies in rat show that this protein has restricted expression in reproductive tissues, interacts strongly with some antiapoptotic BCL2 proteins, not at all with proapoptotic BCL2 proteins, and induces apoptosis in transfected cells. Thus, this protein represents a proapoptotic member of the BCL2 family. ##Evidence-Data-START## Transcript exon combination :: BX460019.2, BX334491.2 [ECO:0000332] RNAseq introns :: single sample supports all introns ERS025081, ERS025082 [ECO:0000348] ##Evidence-Data-END## |
| BOK-AS1 | exonic | 100379249 | N/A | N/A |
| C10orf32 | exonic | 119032 | UPF0693 protein C10orf32 | N/A |

FIG. 3B

| RefSeq Gene Symbol | Exon_overlap | NCBI_Gene ID | Gene_Description | RefSeq_Summary |
|---|---|---|---|---|
| C10orf32-AS3MT | exonic | 100528007 | readthrough transcript :: This locus represents naturally occurring read-through transcription between the neighboring C10orf32 (chromosome 10 open reading frame 32) and AS3MT (arsenic, +3 oxidation state, methyltransferase) genes. The read-through transcript is a candidate for nonsense-mediated mRNA decay (NMD), and is therefore unlikely to produce a protein product. Sequence Note: This RefSeq record was created from transcript and genomic sequence data to make the sequence consistent with the reference genome assembly. The genomic coordinates used for the transcript record were based on transcript alignments. ##RefSeq-Attributes-START## | This locus represents naturally occurring read-through transcription between the neighboring C10orf32 (chromosome 10 open reading frame 32) and AS3MT (arsenic, +3 oxidation state, methyltransferase) genes. The read-through transcript is a candidate for nonsense-mediated mRNA decay (NMD), and is therefore unlikely to produce a protein product. Sequence Note: This RefSeq record was created from transcript and genomic sequence data to make the sequence consistent with the reference genome assembly. The genomic coordinates used for the transcript record were based on transcript alignments. ##RefSeq-Attributes-START## readthrough transcript :: includes exons from GeneID 57412, 119032 ##RefSeq-Attributes-END## ##Evidence-Data-START## [ECO:0000332] Transcript exon combination :: BC040069.1 [ECO:0000332] RNAseq introns :: mixed/partial sample support ERS025083, ERS025084 [ECO:0000350] ##Evidence-Data-END## |

FIG. 3C

| RefSeq Gene Symbol | Exon_o verlap | NCBI_Gene ID | Gene_Description | RefSeq_Summary |
|---|---|---|---|---|
| C16orf58 | exonic | 64755 | UPF0420 protein C16orf58 | This gene encodes a putative transmembrane protein containing a conserved DUF647 domain that may be involved in protein-protein interaction. The encoded protein is related to a plant protein that participates in ultraviolet B light-sensing during root morphogenesis. ##Evidence-Data-START## Transcript exon combination :: AK023930.1, AK222913.1 [ECO:0000332] RNAseq introns :: mixed/partial sample support ERS025081, ERS025082 [ECO:0000350] ##Evidence-Data-END## |
| CNNM2 | exonic | 54805 | metal transporter CNNM2 isoform 1 | This gene encodes a member of the ancient conserved domain containing protein family. Members of this protein family contain a cyclin box motif and have structural similarity to the cyclins. The encoded protein may play an important role in magnesium homeostasis by mediating the epithelial transport and renal reabsorption of Mg2+. Mutations in this gene are associated with renal hypomagnesemia. Alternatively spliced transcript variants encoding multiple isoforms have been observed for this gene. Transcript Variant: This variant (1) represents the longest transcript and encodes the longest isoform (1). ##Evidence-Data-START## Transcript exon combination :: AF216962.1, AK023066.1 [ECO:0000332] RNAseq introns :: single sample supports all introns ERS025081, ERS025082 [ECO:0000348] ##Evidence-Data-END## |

FIG. 3D

| RefSeq Gene Symbol | Exon_o verlap | NCBI_Gene ID | Gene Description | RefSeq_Summary |
|---|---|---|---|---|
| CRHR2 | exonic | 1395 | corticotropin-releasing factor receptor 2 isoform 1 | The protein encoded by this gene belongs to the G-protein coupled receptor 2 family, and the subfamily of corticotropin releasing hormone receptor. This receptor shows high affinity for corticotropin releasing hormone (CRH), and also binds CRH-related peptides such as urocortin. CRH is synthesized in the hypothalamus, and plays an important role in coordinating the endocrine, autonomic, and behavioral responses to stress and immune challenge. Studies in mice suggest that this receptor maybe involved in mediating cardiovascular homeostasis. Alternatively spliced transcript variants encoding different isoforms have been described for this gene. Transcript Variant: This variant (1) represents the predominant transcript, and encodes isoform 1 (also known as alpha isoform). ##Evidence-Data-START## Transcript exon combination :: U34587.1, AK313661.1 [ECO:0000332] RNAseq introns :: mixed/partial sample support ERS025082, ERS025083 [ECO:0000350] ##Evidence-Data-END## |

FIG. 3E

| RefSeq Gene Symbol | Exon_overlap | NCBI_Gene ID | Gene_Description | RefSeq_Summary |
|---|---|---|---|---|
| CYP17A1 | exonic | 1586 | steroid 17-alpha-hydroxylase/17,20 lyase precursor | This gene encodes a member of the cytochrome P450 superfamily of enzymes. The cytochrome P450 proteins are monooxygenases which catalyze many reactions involved in drug metabolism and synthesis of cholesterol, steroids and other lipids. This protein localizes to the endoplasmic reticulum. It has both 17alpha-hydroxylase and 17,20-lyase activities and is a key enzyme in the steroidogenic pathway that produces progestins, mineralocorticoids, glucocorticoids, androgens, and estrogens. Mutations in this gene are associated with isolated steroid-17 alpha-hydroxylase deficiency, 17-alpha-hydroxylase/17,20-lyase deficiency, pseudohermaphroditism, and adrenal hyperplasia. ##Evidence-Data-START## Transcript exon combination :: BC062997.1, AK289898.1 [ECO:0000332] RNAseq introns :: single sample supports all introns ERS025098 [ECO:0000348] ##Evidence-Data-END## |

FIG. 3F

| RefSeq Gene Symbol | Exon_overlap | NCBI_Gene ID | Gene_Description | RefSeq_Summary |
|---|---|---|---|---|
| DNAJC6 | exonic | 9829 | putative tyrosine-protein phosphatase auxilin isoform 1 | DNAJC6 belongs to the evolutionarily conserved DNAJ/HSP40 family of proteins, which regulate molecular chaperone activity by stimulating ATPase activity. DNAJ proteins may have up to 3 distinct domains: a conserved 70-amino acid J domain, usually at the N terminus, a glycine/phenylalanine (G/F)-rich region, and a cysteine-rich domain containing 4 motifs resembling a zinc finger domain. Transcript Variant: This variant (1) represents the longest transcript and encodes the longest isoform (1). Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: BX647203.1, BC109280.1 [ECO:0000332] ##Evidence-Data-END## |

FIG. 3G

| RefSeq Gene Symbol | Exon_overlap | NCBI_Gene_ID | Gene_Description | RefSeq_Summary |
|---|---|---|---|---|
| DPP6 | intronic | 1804 | dipeptidyl aminopeptidase-like protein 6 isoform 1 | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Alternate transcriptional splice variants, encoding different isoforms, have been characterized. Transcript Variant: This variant (1) encodes the longest isoform (1, also referred to as L). Sequence Note: This RefSeq record was created from transcript and genomic sequence data to make the sequence consistent with the reference genome assembly. The genomic coordinates used for the transcript record were based on transcript alignments. |

FIG. 3H

| RefSeq Gene Symbol | Exon_o verlap | NCBI_Gene ID | Gene Description | RefSeq_Summary |
|---|---|---|---|---|
| FUT9 | intronic | 10690 | alpha-(1,3)-fucosyltransferase | The protein encoded by this gene belongs to the glycosyltransferase family. It is localized to the golgi, and catalyzes the last step in the biosynthesis of Lewis X (LeX) antigen, the addition of a fucose to precursor polysaccharides. This protein is one of the few fucosyltransferases that synthesizes the LeX oligosaccharide (CD15) expressed in the organ buds progressing in mesenchyma during embryogenesis. It is also responsible for the expression of CD15 in mature granulocytes. A common haplotype of this gene has also been associated with susceptibility to placental malaria infection. The RefSeq was created from transcript and genomic sequence data because no single transcript was available for the full length of the gene. The extent of this transcript is supported by transcript alignments. ##Evidence-Data-START## Transcript exon combination :: CK904220.1, AB023021.1 [ECO:0000332] RNAseq introns :: single sample supports all introns ERS025082, ERS025098 [ECO:0000348] ##Evidence-Data-END## |

FIG. 31

| RefSeq Gene Symbol | Exon_overlap | MCBI_Gene ID | Gene_Description | RefSeq_Summary |
|---|---|---|---|---|
| GIGYF2 | intronic | 26058 | PERQ amino acid-rich with GYF domain-containing protein 2 isoform a | This gene contains CAG trinucleotide repeats and encodes a protein containing several stretches of polyglutamine residues. The encoded protein may be involved in the regulation of tyrosine kinase receptor signaling. This gene is located in a chromosomal region that was genetically linked to Parkinson disease type 11, and mutations in this gene were thought to be causative for this disease. However, more recent studies in different populations have been unable to replicate this association. Alternative splicing results in multiple transcript variants. Transcript Variant: This variant (1) encodes the longest isoform (a). Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: BC146775.1, AB014542.2 [ECO:0000332] RNAseq introns :: single sample supports all introns ERS025084, ERS025088 [ECO:0000348] ##Evidence-Data-END## |
| GPR111 | exonic | 222611 | probable G-protein coupled receptor 111 precursor | N/A |

FIG. 3J

| RefSeq Gene Symbol | Exon_o verlap | NCBI_Gene ID | Gene Description | RefSeq_Summary |
|---|---|---|---|---|
| HMGB3 | both | 3149 | high mobility group protein B3 | HMGB3 belongs to the high mobility group (HMG) protein superfamily. Like HMG1 (MIM 163905) and HMG2 (MIM 163906), HMGB3 contains DNA-binding HMG box domains and is classified into the HMG box subfamily. Members of the HMG box subfamily are thought to play a fundamental role in DNA replication, nucleosome assembly and transcription. ##Evidence-Data-START## Transcript exon combination :: Y10043.1, BG176733.1 [ECO:0000332] RNAseq introns :: single sample supports all introns ERS025081, ERS025082 [ECO:0000348] ##Evidence-Data-END## |
| IPMK | exonic | 253430 | inositol polyphosphate multikinase | This gene encodes a member of the inositol phosphokinase family. The encoded protein has 3-kinase, 5-kinase and 6-kinase activities on phosphorylated inositol substrates. The encoded protein plays an important role in the biosynthesis of inositol 1,3,4,5,6-pentakisphosphate, and has a preferred 5-kinase activity. This gene may play a role in nuclear mRNA export. Pseudogenes of this gene are located on the long arm of chromosome 13 and the short arm of chromosome 19. [provided by RefSeq, Dec 2010]. Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: BC065709.1, BC016612.1 [ECO:0000332] RNAseq introns :: single sample supports all introns ERS025081, ERS025084 [ECO:0000348] ##Evidence-Data-END## |

FIG. 3K

| RefSeq Gene Symbol | Exon_overlap | NCBI_Gene ID | Gene_Description | RefSeq_Summary |
|---|---|---|---|---|
| LARP1B | exonic | 55132 | la-related protein 1B isoform 1 | This gene encodes a protein containing domains found in the La related protein of Drosophila melanogaster. La motif-containing proteins are thought to be RNA-binding proteins, where the La motif and adjacent amino acids fold into an RNA recognition motif. The La motif is also found in proteins unrelated to the La protein. Alternative splicing has been observed at this locus and multiple variants, encoding distinct isoforms, are described. Additional splice variation has been identified but the full-length nature of these transcripts has not been determined. Transcript Variant: This variant (1) represents the longest transcript and encodes the longest isoform (1). ##Evidence-Data-START## RNAseq introns :: mixed/partial sample support ERS025085 [ECO:0000350] ##Evidence-Data-END## |

FIG. 3L

| RefSeq Gene Symbol | Exon_o verlap | NCBI_Gene ID | Gene_Description | RefSeq_Summary |
|---|---|---|---|---|
| LEPR | exonic | 3953 | leptin receptor isoform 1 precursor | The protein encoded by this gene belongs to the gp130 family of cytokine receptors that are known to stimulate gene transcription via activation of cytosolic STAT proteins. This protein is a receptor for leptin (an adipocyte-specific hormone that regulates body weight), and is involved in the regulation of fat metabolism, as well as in a novel hematopoietic pathway that is required for normal lymphopoiesis. Mutations in this gene have been associated with obesity and pituitary dysfunction. Alternatively spliced transcript variants encoding different isoforms have been described for this gene. It is noteworthy that this gene and LEPROT gene (GeneID:54741) share the same promoter and the first 2 exons, however, encode distinct proteins (PMID:9207021).[provided by RefSeq, Nov 2010]. Transcript Variant: This variant (1) encodes the longest isoform (1). ##Evidence-Data-START## Transcript exon combination :: U43168.1 [ECO:0000332] RNAseq introns :: single sample supports all introns ERS025084, ERS025088 [ECO:0000348] ##Evidence-Data-END## |

FIG. 3M

| RefSeq Gene Symbol | Exon_o verlap | NCBI_Gene ID | Gene_Description | RefSeq_Summary |
|---|---|---|---|---|
| LEPROT | exonic | 54741 | leptin receptor gene-related protein isoform 1 | LEPROT is associated with the Golgi complex and endosomes and has a role in cell surface expression of growth hormone receptor (GHR; MIM 600946) and leptin receptor (OBR, or LEPR; MIM 601007), thereby altering receptor-mediated cell signaling. Transcript Variant: This variant (1) is dominant and encodes the shorter isoform (1). Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: Y12670.1, AK074841.1 [ECO:0000332] RNAseq introns :: single sample supports all introns ERS025081, ERS025082 [ECO:0000348] ##Evidence-Data-END## |
| MAGEA11 | exonic | 4110 | melanoma-associated antigen 11 isoform a | This gene is a member of the MAGEA gene family. The members of this family encode proteins with 50 to 80% sequence identity to each other. The promoters and first exons of the MAGEA genes show considerable variability, suggesting that the existence of this gene family enables the same function to be expressed under different transcriptional controls. The MAGEA genes are clustered at chromosomal location Xq28. They have been implicated in some hereditary disorders, such as dyskeratosis congenita. Two transcript variants encoding different isoforms have been found for this gene. Transcript Variant: This variant (1) encodes the longer isoform (a). ##Evidence-Data-END## |

FIG. 3N

| RefSeq Gene Symbol | Exon_overlap | NCBI_Gene ID | Gene_Description | RefSeq Summary |
|---|---|---|---|---|
| MKRN1 | exonic | 23608 | E3 ubiquitin-protein ligase makorin-1 isoform 1 | The Makorin ring finger protein-1 gene (MKRN1) is a highly transcribed, intron-containing source for a family of intronless mammalian genes encoding a novel class of zinc finger proteins. Phylogenetic analyses indicate that the MKRN1 gene is the ancestral founder of this gene family. Transcript Variant: This variant (1) represents the longer transcript and encodes the longer isoform (1). ##Evidence-Data-START## Transcript exon combination :: BC025955.1, AL136812.1 [ECO:0000332] RNAseq introns :: mixed/partial sample support ERS025081, ERS025082 [ECO:0000350] ##Evidence-Data-END## |
| MSN | exonic | 4478 | moesin | Moesin (for membrane-organizing extension spike protein) is a member of the ERM family which includes ezrin and radixin. ERM proteins appear to function as cross-linkers between plasma membranes and actin-based cytoskeletons. Moesin is localized to filopodia and other membranous protrusions that are important for cell-cell recognition and signaling and for cell movement. ##Evidence-Data-START## Transcript exon combination :: M69066.1, BC017293.2 [ECO:0000332] RNAseq introns :: single sample supports all introns ERS025081, ERS025082 [ECO:0000348] ##Evidence-Data-END## |

FIG. 30

| RefSeq Gene Symbol | Exon_overlap | NCBI_Gene ID | Gene_Description | RefSeq_Summary |
|---|---|---|---|---|
| MUC4 | exonic | 4585 | mucin-4 isoform a precursor | The major constituents of mucus, the viscous secretion that covers epithelial surfaces such as those in the trachea, colon, and cervix, are highly glycosylated proteins called mucins. These glycoproteins play important roles in the protection of the epithelial cells and have been implicated in epithelial renewal and differentiation. This gene encodes an integral membrane glycoprotein found on the cell surface, although secreted isoforms may exist. At least two dozen transcript variants of this gene have been found, although for many of them the full-length transcript has not been determined or they are found only in tumor tissues. This gene contains a region in the coding sequence which has a variable number (>100) of 48 nt tandem repeats. [provided by RefSeq, Jul 2008]. Transcript Variant: This variant (1), also called sv0, is the longest transcript and encodes the full-length isoform (a). Isoform a is thought to be a membrane-bound protein. ##Evidence-Data-START## RNAseq introns :: mixed/partial sample support ERS025084, ERS025085 [ECO:0000350] ##Evidence-Data-END## |
| MYADML | exonic | 151325 | N/A | N/A |
| MYO1B | both | 4430 | unconventional myosin-Ib isoform 1 | N/A |

FIG. 3P

| RefSeq Gene Symbol | Exon_overlap | NCBI_Gene ID | Gene Description | RefSeq_Summary |
|---|---|---|---|---|
| NBPF1 | exonic | 55672 | neuroblastoma breakpoint family member 1 | This gene is a member of the neuroblastoma breakpoint family (NBPF) which consists of dozens of recently duplicated genes primarily located in segmental duplications on human chromosome 1. This gene family has experienced its greatest expansion within the human lineage and has expanded, to a lesser extent, among primates in general. Members of this gene family are characterized by tandemly repeated copies of DUF1220 protein domains. Gene copy number variations in the human chromosomal region 1q21.1, where most DUF1220 domains are located, have been implicated in a number of developmental and neurogenetic diseases such as microcephaly, macrocephaly, autism, schizophrenia, mental retardation, congenital heart disease, neuroblastoma, and congenital kidney and urinary tract anomalies. Altered expression of some gene family members is associated with several types of cancer. This gene family contains numerous pseudogenes. ##Evidence-Data-START## RNAseq introns :: mixed/partial sample support ERS025081, ERS025082 [ECO:0000350] ##Evidence-Data-END## |

FIG. 3Q

| RefSeq Gene Symbol | Exon_overlap | NCBI Gene ID | Gene_Description | RefSeq_Summary |
|---|---|---|---|---|
| NCOA1 | exonic | 8648 | nuclear receptor coactivator 1, isoform 1 | The protein encoded by this gene acts as a transcriptional coactivator for steroid and nuclear hormone receptors. It is a member of the p160/steroid receptor coactivator (SRC) family and like other family members has histone acetyltransferase activity and contains a nuclear localization signal, as well as bHLH and PAS domains. The product of this gene binds nuclear receptors directly and stimulates the transcriptional activities in a hormone-dependent fashion. Alternatively spliced transcript variants encoding different isoforms have been identified. [provided by RefSeq, Jul 2008]. Transcript Variant: This variant (1), also known as SRC1a, encodes the longest isoform (1). ##Evidence-Data-START## CDS exon combination :: AJ000881.1, U90661.1 [ECO:0000331] RNAseq introns :: single sample supports all introns ERS025081, ERS025082 [ECO:0000348] ##Evidence-Data-END## |

FIG. 3R

| RefSeq Gene Symbol | Exon_overlap | NCBI_Gene ID | Gene_Description | RefSeq_Summary |
|---|---|---|---|---|
| PDE1C | intronic | 5137 | calcium/calmodulin-dependent 3',5'-cyclic nucleotide phosphodiesterase 1C isoform 1 | Cyclic nucleotide phosphodiesterases (PDEs) catalyze hydrolysis of the cyclic nucleotides cAMP and cGMP to the corresponding nucleoside 5-prime-monophosphates. Mammalian PDEs have been classified into several families based on their biochemical properties. Members of the PDE1 family, such as PDE1C, are calmodulin (see MIM 114180)-dependent PDEs (CaM-PDEs) that are stimulated by a calcium-calmodulin complex (Repaske et al., 1992 [PubMed 1326532]).[supplied by OMIM, Oct 2009]. Transcript Variant: This variant (1) differs in the 5' and 3' UTR and has multiple coding region differences, compared to variant 3. These differences result in an isoform (1) with distinct N- and C-termini, compared to isoform 3. Variants 1 and 4 encode the same protein. Isoform 1 is also known as HCam-3B. This record was created from transcript and genomic sequence data to make the sequence consistent with the reference genome assembly. The genomic coordinates used for the transcript record were based on transcript alignments. ##Evidence-Data-START## Transcript exon combination :: BC022479.1 [ECO:0000332] RNAseq introns :: mixed/partial sample support ERS025081, ERS025082 [ECO:0000350] ##Evidence-Data-END## |
| PGRMC2 | exonic | 10424 | membrane-associated progesterone receptor component 2 | N/A |

FIG. 3S

| RefSeq Gene Symbol | Exon_overlap | NCBI_Gene_ID | Gene_Description | RefSeq_Summmary |
|---|---|---|---|---|
| PLA2G4C | exonic | 8605 | cytosolic phospholipase A2 gamma isoform 1 precursor | This gene encodes a protein which is a member of the phospholipase A2 enzyme family which hydrolyzes glycerophospholipids to produce free fatty acids and lysophospholipids, both of which serve as precursors in the production of signaling molecules. The encoded protein has been shown to be a calcium-independent and membrane-bound enzyme. Multiple transcript variants encoding different isoforms have been found for this gene. Transcript Variant: This variant (1) encodes the predominant isoform (1). ##Evidence-Data-START## Transcript exon combination :: AF065214.1, AF065214.1, AF058921.1 [ECO:0000332] RNAseq introns :: single sample supports all introns ERS025084, ERS025088 [ECO:0000348] ##Evidence-Data-END## |

FIG. 3T

| RefSeq Gene Symbol | Exon_o verlap | NCBI_Gene ID | Gene_Description | RefSeq_Summary |
|---|---|---|---|---|
| PTK2 | both | 5747 | focal adhesion kinase 1 isoform a | This gene encodes a cytoplasmic protein tyrosine kinase which is found concentrated in the focal adhesions that form between cells growing in the presence of extracellular matrix constituents. The encoded protein is a member of the FAK subfamily of protein tyrosine kinases but lacks significant sequence similarity to kinases from other subfamilies. Activation of this gene may be an important early step in cell growth and intracellular signal transduction pathways triggered in response to certain neural peptides or to cell interactions with the extracellular matrix. Several transcript variants encoding different isoforms have been found for this gene, but the full-length natures of only three of them have been determined. Transcript Variant: This variant (1) differs in the 5' UTR and coding sequence compared to variant 2. The resulting isoform (a) is shorter at the N-terminus compared to isoform b. ##Evidence-Data-START## Transcript exon combination :: L13616.1 [ECO:0000332] RNAseq introns :: mixed/partial sample support ERS025081, ERS025082 [ECO:0000350] ##Evidence-Data-END## |
| RAB19 | exonic | 401409 | ras-related protein Rab-19 | N/A |

FIG. 3U

| RefSeq Gene Symbol | Exon_overlap | NCBI_Gene ID | Gene Description | RefSeq_Summary |
|---|---|---|---|---|
| RXFP1 | intronic | 59350 | This gene encodes a member of the leucine-rich repeat-containing subgroup of the G protein-coupled 7-transmembrane receptor superfamily. The encoded protein plays a critical role in sperm motility, pregnancy and parturition as a receptor for the protein hormone relaxin. Decreased expression of this gene may play a role in endometriosis. Alternatively spliced transcript variants encoding multiple isoforms have been observed for this gene. [provided by RefSeq, Dec 2011]. Transcript Variant: This variant (10) uses an alternate internal splice site, compared to variant 1. This variant is represented as non-coding due to the presence of an upstream ORF that is predicted to interfere with translation of the longest ORF; translation of | This gene encodes a member of the leucine-rich repeat-containing subgroup of the G protein-coupled 7-transmembrane receptor superfamily. The encoded protein plays a critical role in sperm motility, pregnancy and parturition as a receptor for the protein hormone relaxin. Decreased expression of this gene may play a role in endometriosis. Alternatively spliced transcript variants encoding multiple isoforms have been observed for this gene. Transcript Variant: This variant (10) uses an alternate internal splice site, compared to variant 1. This variant is represented as non-coding due to the presence of an upstream ORF that is predicted to interfere with translation of the longest ORF; translation of the upstream ORF renders the transcript a candidate for nonsense-mediated mRNA decay (NMD). ##Evidence-Data-START## RNAseq introns :: mixed/partial sample support ERS025081, ERS025082 [ECO:0000350] ##Evidence-Data-END## |

FIG. 3V

| RefSeq Gene Symbol | Exon_overlap | NCBI_Gene ID | Gene_Description | RefSeq_Summary |
|---|---|---|---|---|
| SLC5A2 | exonic | 6524 | sodium/glucose cotransporter 2 | This gene encodes a member of the sodium glucose cotransporter family which are sodium-dependent glucose transport proteins. The encoded protein is the major cotransporter involved in glucose reabsorption in the kidney. Mutations in this gene are associated with renal glucosuria . ##Evidence-Data-START## Transcript exon combination :: M95549.1 [ECO:0000332] RNAseq introns :: single sample supports all introns ERS025084, ERS025088 [ECO:0000348] ##Evidence-Data-END## |
| TGFB1I1 | exonic | 7041 | transforming growth factor beta-1-induced transcript 1 protein isoform 1 | This gene encodes a coactivator of the androgen receptor, a transcription factor which is activated by androgen and has a key role in male sexual differentiation. The encoded protein is thought to regulate androgen receptor activity and may have a role to play in the treatment of prostate cancer. Multiple transcript variants encoding different isoforms have been found for this gene. Transcript Variant: This variant (1) represents the longest transcript and encodes the longer protein (isoform 1). Sequence Note: This RefSeq record was created from transcript and genomic sequence data to make the sequence consistent with the reference genome assembly. The genomic coordinates used for the transcript record were based on transcript alignments. ##Evidence-Data-START## Transcript exon combination :: AK313327.1, AB007836.1 [ECO:0000332] RNAseq introns :: single sample supports all introns ERS025081, ERS025083 [ECO:0000348] ##Evidence-Data-END## |

FIG. 3W

| RefSeq Gene Symbol | Exon_o verlap | NCBI Gene ID | Gene_Description | RefSeq_Summary |
|---|---|---|---|---|
| TGFBR3 | intronic | 7049 | 5'-most supported transforming growth factor (TGF)-beta type III receptor. The encoded receptor is a membrane proteoglycan that often functions as a co-receptor with other TGF-beta receptor superfamily members. Ectodomain shedding produces soluble TGFBR3, which may inhibit TGFB signaling. Decreased expression of this receptor has been observed in various cancers. Alternatively spliced transcript variants encoding different isoforms have been identified for this gene.[provided by RefSeq, Sep 2010] Transcript Variant: This variant (4) contains an alternate internal exon, compared to variant 1. This variant is represented as non-coding because the use of the | This locus encodes the transforming growth factor (TGF)-beta type III receptor. The encoded receptor is a membrane proteoglycan that often functions as a co-receptor with other TGF-beta receptor superfamily members. Ectodomain shedding produces soluble TGFBR3, which may inhibit TGFB signaling. Decreased expression of this receptor has been observed in various cancers. Alternatively spliced transcript variants encoding different isoforms have been identified for this gene. Transcript Variant: This variant (4) contains an alternate internal exon, compared to variant 1. This variant is represented as non-coding because the use of the 5'-most supported translational start codon, as used in variant 1, renders the transcript a candidate for nonsense-mediated mRNA decay (NMD). Sequence Note: This RefSeq record was created from transcript and genomic sequence data to make the sequence consistent with the reference genome assembly. The genomic coordinates used for the transcript record were based on transcript alignments. ##Evidence-Data-START## RNAseq introns :: mixed/partial sample support ERS025081, ERS025082 [ECO:0000350] ##Evidence-Data-END## |

FIG. 3X

| RefSeq Gene Symbol | Exon_overlap | NCBI_Gene ID | Gene_Description | RefSeq_Summary |
|---|---|---|---|---|
| TSHR | exonic | 7253 | thyrotropin receptor isoform 1 precursor | The protein encoded by this gene is a membrane protein and a major controller of thyroid cell metabolism. The encoded protein is a receptor for thyrotropin and thyrostimulin, and its activity is mediated by adenylate cyclase. Defects in this gene are a cause of several types of hyperthyroidism. Three transcript variants encoding different isoforms have been found for this gene. Transcript Variant: This variant (1) represents the longer transcript and it encodes the longer protein (isoform 1). ##Evidence-Data-START## Transcript exon combination :: AB209207.1, M31774.1 [ECO:0000332] RNAseq introns :: single sample supports all introns ERS025084, ERS025088 [ECO:0000348] ##Evidence-Data-END## |
| ZFP14 | intronic | 57677 | zinc finger protein 14 homolog | N/A |
| ZNF843 | exonic | 283933 | zinc finger protein 843 | N/A |

FIG. 3Y

| RefSeq_Gene_Symbol | Exon_overlap | RefSeq_Accession Number | mRNA_Description | SEQ ID |
|---|---|---|---|---|
| TGFBR3 | intronic | NM_001195683 | Homo sapiens transforming growth factor, beta receptor III (TGFBR3), transcript variant 2, mRNA. | 48 |
| TGFBR3 | intronic | NM_003243 | Homo sapiens transforming growth factor, beta receptor III (TGFBR3), transcript variant 1, mRNA. | 49 |
| TGFBR3 | intronic | NR_036634 | Homo sapiens transforming growth factor, beta receptor III (TGFBR3), transcript variant 4, non-coding RNA. | 50 |
| TGFBR3 | intronic | NM_001195684 | Homo sapiens transforming growth factor, beta receptor III (TGFBR3), transcript variant 3, mRNA. | 51 |
| HMGB3 | both | NM_005342 | Homo sapiens high mobility group box 3 (HMGB3), mRNA. | 52 |
| FUT9 | intronic | NM_006581 | Homo sapiens fucosyltransferase 9 (alpha (1,3) fucosyltransferase) (FUT9), mRNA. | 53 |
| PDE1C | intronic | NM_001191057 | Homo sapiens phosphodiesterase 1C, calmodulin-dependent 70kDa (PDE1C), transcript variant 2, mRNA. | 54 |
| PDE1C | intronic | NM_001191059 | Homo sapiens phosphodiesterase 1C, calmodulin-dependent 70kDa (PDE1C), transcript variant 5, mRNA. | 55 |
| PDE1C | intronic | NM_001191058 | Homo sapiens phosphodiesterase 1C, calmodulin-dependent 70kDa (PDE1C), transcript variant 3, mRNA. | 56 |

FIG. 4A

| RefSeq_Gene_Symbol | Exon_overlap | RefSeq_Accession Number | mRNA_Description | SEQ ID |
|---|---|---|---|---|
| PDE1C | intronic | NM_001191056 | Homo sapiens phosphodiesterase 1C, calmodulin-dependent 70kDa (PDE1C), transcript variant 1, mRNA. | 57 |
| PDE1C | intronic | NM_005020 | Homo sapiens phosphodiesterase 1C, calmodulin-dependent 70kDa (PDE1C), transcript variant 4, mRNA. | 58 |
| IPMK | exonic | NM_152230 | Homo sapiens inositol polyphosphate multikinase (IPMK), mRNA. | 59 |
| GIGYF2 | intronic | NM_001103146 | Homo sapiens GRB10 interacting GYF protein 2 (GIGYF2), transcript variant 3, mRNA. | 60 |
| GIGYF2 | intronic | NM_001103147 | Homo sapiens GRB10 interacting GYF protein 2 (GIGYF2), transcript variant 1, mRNA. | 61 |
| GIGYF2 | intronic | NM_001103148 | Homo sapiens GRB10 interacting GYF protein 2 (GIGYF2), transcript variant 4, mRNA. | 62 |
| GIGYF2 | intronic | NM_015575 | Homo sapiens GRB10 interacting GYF protein 2 (GIGYF2), transcript variant 2, mRNA. | 63 |
| ACCS | exonic | NM_001127219 | Homo sapiens 1-aminocyclopropane-1-carboxylate synthase homolog (Arabidopsis)(non-functional) (ACCS), transcript variant 2, mRNA. | 64 |
| ACCS | exonic | NM_032592 | Homo sapiens 1-aminocyclopropane-1-carboxylate synthase homolog (Arabidopsis)(non-functional) (ACCS), transcript variant 1, mRNA. | 65 |
| DPP6 | intronic | NM_001039350 | Homo sapiens dipeptidyl-peptidase 6 (DPP6), transcript variant 3, mRNA. | 66 |

FIG. 4B

| RefSeq_Gene_Symbol | Exon_overlap | RefSeq_Accession Number | mRNA_Description | SEQ ID |
|---|---|---|---|---|
| DPP6 | intronic | NM_130797 | Homo sapiens dipeptidyl-peptidase 6 (DPP6), transcript variant 1, mRNA. | 67 |
| DPP6 | intronic | NM_001936 | Homo sapiens dipeptidyl-peptidase 6 (DPP6), transcript variant 2, mRNA. | 68 |
| ZNF843 | exonic | NM_001136509 | Homo sapiens zinc finger protein 843 (ZNF843), mRNA. | 69 |
| ARMC5 | exonic | NM_001105247 | Homo sapiens armadillo repeat containing 5 (ARMC5), transcript variant 1, mRNA. | 70 |
| ARMC5 | exonic | NM_024742 | Homo sapiens armadillo repeat containing 5 (ARMC5), transcript variant 2, mRNA. | 71 |
| TGFB1I1 | exonic | NM_001042454 | Homo sapiens transforming growth factor beta 1 induced transcript 1 (TGFB1I1), transcript variant 1, mRNA. | 72 |
| TGFB1I1 | exonic | NM_001164719 | Homo sapiens transforming growth factor beta 1 induced transcript 1 (TGFB1I1), transcript variant 3, mRNA. | 73 |
| TGFB1I1 | exonic | NM_015927 | Homo sapiens transforming growth factor beta 1 induced transcript 1 (TGFB1I1), transcript variant 2, mRNA. | 74 |
| SLC5A2 | exonic | NM_003041 | Homo sapiens solute carrier family 5 (sodium/glucose cotransporter), member 2 (SLC5A2), mRNA. | 75 |
| C16orf58 | exonic | NM_022744 | Homo sapiens chromosome 16 open reading frame 58 (C16orf58), mRNA. | 76 |
| PTK2 | intronic | NM_001199649 | Homo sapiens protein tyrosine kinase 2 (PTK2), transcript variant 3, mRNA. | 77 |

FIG. 4C

| RefSeq_Gene_Symbol | Exon_overlap | RefSeq_Accession Number | mRNA_Description | SEQ ID |
|---|---|---|---|---|
| PTK2 | exonic | NM_005607 | Homo sapiens protein tyrosine kinase 2 (PTK2), transcript variant 2, mRNA. | 78 |
| PTK2 | intronic | NM_153831 | Homo sapiens protein tyrosine kinase 2 (PTK2), transcript variant 1, mRNA. | 79 |
| LARP1B | exonic | NM_032239 | Homo sapiens La ribonucleoprotein domain family, member 1B (LARP1B), transcript variant 3, mRNA. | 80 |
| LARP1B | exonic | NM_178043 | Homo sapiens La ribonucleoprotein domain family, member 1B (LARP1B), transcript variant 2, mRNA. | 81 |
| LARP1B | exonic | NM_018078 | Homo sapiens La ribonucleoprotein domain family, member 1B (LARP1B), transcript variant 1, mRNA. | 82 |
| PGRMC2 | exonic | NM_006320 | Homo sapiens progesterone receptor membrane component 2 (PGRMC2), mRNA. | 83 |
| ZFP14 | intronic | NM_020917 | Homo sapiens ZFP14 zinc finger protein (ZFP14), mRNA. | 84 |
| DNAJC6 | exonic | NM_001256865 | Homo sapiens DnaJ (Hsp40) homolog, subfamily C, member 6 (DNAJC6), transcript variant 3, mRNA. | 85 |
| DNAJC6 | exonic | NM_014787 | Homo sapiens DnaJ (Hsp40) homolog, subfamily C, member 6 (DNAJC6), transcript variant 2, mRNA. | 86 |
| DNAJC6 | exonic | NM_001256864 | Homo sapiens DnaJ (Hsp40) homolog, subfamily C, member 6 (DNAJC6), transcript variant 1, mRNA. | 87 |

FIG. 4D

| RefSeq_Gene_Symbol | Exon_overlap | RefSeq_Accession Number | mRNA_Description | SEQ ID |
|---|---|---|---|---|
| LEPROT | exonic | NM_001198683 | Homo sapiens leptin receptor overlapping transcript (LEPROT), transcript variant 3, mRNA. | 88 |
| LEPROT | exonic | NM_017526 | Homo sapiens leptin receptor overlapping transcript (LEPROT), transcript variant 1, mRNA. | 89 |
| LEPR | exonic | NM_001003680 | Homo sapiens leptin receptor (LEPR), transcript variant 2, mRNA. | 90 |
| LEPR | exonic | NM_001003679 | Homo sapiens leptin receptor (LEPR), transcript variant 3, mRNA. | 91 |
| LEPR | exonic | NM_002303 | Homo sapiens leptin receptor (LEPR), transcript variant 1, mRNA. | 92 |
| LEPROT | exonic | NM_001198681 | Homo sapiens leptin receptor overlapping transcript (LEPROT), transcript variant 2, mRNA. | 93 |
| LEPR | intronic | NM_001198688 | Homo sapiens leptin receptor (LEPR), transcript variant 5, mRNA. | 94 |
| LEPR | intronic | NM_001198687 | Homo sapiens leptin receptor (LEPR), transcript variant 4, mRNA. | 95 |
| LEPR | intronic | NM_001198689 | Homo sapiens leptin receptor (LEPR), transcript variant 6, mRNA. | 96 |
| MUC4 | exonic | NM_004532 | Homo sapiens mucin 4, cell surface associated (MUC4), transcript variant 4, mRNA. | 97 |
| MUC4 | exonic | NM_018406 | Homo sapiens mucin 4, cell surface associated (MUC4), transcript variant 1, mRNA. | 98 |
| MUC4 | exonic | NM_138297 | Homo sapiens mucin 4, cell surface associated (MUC4), transcript variant 5, mRNA. | 99 |
| MAGEA11 | exonic | NM_005366 | Homo sapiens melanoma antigen family A, 11 (MAGEA11), transcript variant 1, mRNA. | 100 |

FIG. 4E

| RefSeq_Gene_Symbol | Exon_overlap | RefSeq_Accession Number | mRNA_Description | SEQ ID |
|---|---|---|---|---|
| MAGEA11 | exonic | NM_001011544 | Homo sapiens melanoma antigen family A, 11 (MAGEA11), transcript variant 2, mRNA. | 101 |
| BOK-AS1 | exonic | NR_033346 | Homo sapiens BOK antisense RNA 1 (BOK-AS1), antisense RNA. | 102 |
| BOK | exonic | NM_032515 | Homo sapiens BCL2-related ovarian killer (BOK), mRNA. | 103 |
| TSHR | exonic | NM_001018036 | Homo sapiens thyroid stimulating hormone receptor (TSHR), transcript variant 2, mRNA. | 104 |
| TSHR | exonic | NM_001142626 | Homo sapiens thyroid stimulating hormone receptor (TSHR), transcript variant 3, mRNA. | 105 |
| TSHR | exonic | NM_000369 | Homo sapiens thyroid stimulating hormone receptor (TSHR), transcript variant 1, mRNA. | 106 |
| MSN | exonic | NM_002444 | Homo sapiens moesin (MSN), mRNA. | 107 |
| MYADML | exonic | NR_003143 | Homo sapiens myeloid-associated differentiation marker-like (pseudogene) (MYADML), non-coding RNA. | 108 |
| CYP17A1 | exonic | NM_000102 | Homo sapiens cytochrome P450, family 17, subfamily A, polypeptide 1 (CYP17A1), mRNA. | 109 |
| C10orf32 | exonic | NM_001136200 | Homo sapiens chromosome 10 open reading frame 32 (C10orf32), transcript variant 1, mRNA. | 110 |
| C10orf32 | exonic | NM_144591 | Homo sapiens chromosome 10 open reading frame 32 (C10orf32), transcript variant 2, mRNA. | 111 |
| C10orf32-AS3MT | exonic | NR_037644 | Homo sapiens C10orf32-AS3MT readthrough (C10orf32-AS3MT), non-coding RNA. | 112 |

FIG. 4F

| RefSeq_Gene_Symbol | Exon_overlap | RefSeq_Accession Number | mRNA_Description | SEQ ID |
|---|---|---|---|---|
| AS3MT | exonic | NM_020682 | Homo sapiens arsenic (+3 oxidation state) methyltransferase (AS3MT), mRNA. | 113 |
| CNNM2 | exonic | NM_199077 | Homo sapiens cyclin M2 (CNNM2), transcript variant 3, mRNA. | 114 |
| CNNM2 | exonic | NM_017649 | Homo sapiens cyclin M2 (CNNM2), transcript variant 1, mRNA. | 115 |
| CNNM2 | exonic | NM_199076 | Homo sapiens cyclin M2 (CNNM2), transcript variant 2, mRNA. | 116 |
| RXFP1 | intronic | NR_045584 | Homo sapiens relaxin/insulin-like family peptide receptor 1 (RXFP1), transcript variant 13, non-coding RNA. | 117 |
| RXFP1 | intronic | NM_001253727 | Homo sapiens relaxin/insulin-like family peptide receptor 1 (RXFP1), transcript variant 2, mRNA. | 118 |
| RXFP1 | intronic | NM_001253728 | Homo sapiens relaxin/insulin-like family peptide receptor 1 (RXFP1), transcript variant 3, mRNA. | 119 |
| RXFP1 | intronic | NM_001253729 | Homo sapiens relaxin/insulin-like family peptide receptor 1 (RXFP1), transcript variant 4, mRNA. | 120 |
| RXFP1 | intronic | NM_001253730 | Homo sapiens relaxin/insulin-like family peptide receptor 1 (RXFP1), transcript variant 5, mRNA. | 121 |
| RXFP1 | intronic | NM_001253732 | Homo sapiens relaxin/insulin-like family peptide receptor 1 (RXFP1), transcript variant 6, mRNA. | 122 |

| RefSeq_Gene_Symbol | Exon_overlap | RefSeq_Accession Number | mRNA_Description | SEQ ID |
|---|---|---|---|---|
| RXFP1 | intronic | NM_001253733 | Homo sapiens relaxin/insulin-like family peptide receptor 1 (RXFP1), transcript variant 7, mRNA. | 123 |
| RXFP1 | intronic | NM_021634 | Homo sapiens relaxin/insulin-like family peptide receptor 1 (RXFP1), transcript variant 1, mRNA. | 124 |
| RXFP1 | intronic | NR_045579 | Homo sapiens relaxin/insulin-like family peptide receptor 1 (RXFP1), transcript variant 8, non-coding RNA. | 125 |
| RXFP1 | intronic | NR_045580 | Homo sapiens relaxin/insulin-like family peptide receptor 1 (RXFP1), transcript variant 9, non-coding RNA. | 126 |
| RXFP1 | intronic | NR_045581 | Homo sapiens relaxin/insulin-like family peptide receptor 1 (RXFP1), transcript variant 10, non-coding RNA. | 127 |
| RXFP1 | intronic | NR_045582 | Homo sapiens relaxin/insulin-like family peptide receptor 1 (RXFP1), transcript variant 11, non-coding RNA. | 128 |
| RXFP1 | intronic | NR_045583 | Homo sapiens relaxin/insulin-like family peptide receptor 1 (RXFP1), transcript variant 12, non-coding RNA. | 129 |
| CRHR2 | exonic | NM_001202482 | Homo sapiens corticotropin releasing hormone receptor 2 (CRHR2), transcript variant 4, mRNA. | 130 |
| CRHR2 | exonic | NM_001202483 | Homo sapiens corticotropin releasing hormone receptor 2 (CRHR2), transcript variant 5, mRNA. | 131 |
| CRHR2 | exonic | NM_001883 | Homo sapiens corticotropin releasing hormone receptor 2 (CRHR2), transcript variant 1, mRNA. | 132 |

| RefSeq_Gene_Symbol | Exon_overlap | RefSeq_Accession Number | mRNA_Description | SEQ ID |
|---|---|---|---|---|
| CRHR2 | exonic | NM_001202475 | Homo sapiens corticotropin releasing hormone receptor 2 (CRHR2), transcript variant 2, mRNA. | 133 |
| CRHR2 | exonic | NM_001202481 | Homo sapiens corticotropin releasing hormone receptor 2 (CRHR2), transcript variant 3, mRNA. | 134 |
| PLA2G4C | exonic | NM_001159322 | Homo sapiens phospholipase A2, group IVC (cytosolic, calcium-independent) (PLA2G4C), transcript variant 2, mRNA. | 135 |
| PLA2G4C | exonic | NM_001159323 | Homo sapiens phospholipase A2, group IVC (cytosolic, calcium-independent) (PLA2G4C), transcript variant 3, mRNA. | 136 |
| PLA2G4C | exonic | NM_003706 | Homo sapiens phospholipase A2, group IVC (cytosolic, calcium-independent) (PLA2G4C), transcript variant 1, mRNA. | 137 |
| NCOA1 | exonic | NM_003743 | Homo sapiens nuclear receptor coactivator 1 (NCOA1), transcript variant 1, mRNA. | 138 |
| NCOA1 | exonic | NM_147223 | Homo sapiens nuclear receptor coactivator 1 (NCOA1), transcript variant 2, mRNA. | 139 |
| NCOA1 | exonic | NM_147233 | Homo sapiens nuclear receptor coactivator 1 (NCOA1), transcript variant 3, mRNA. | 140 |
| RAB19 | exonic | NM_001008749 | Homo sapiens RAB19, member RAS oncogene family (RAB19), mRNA. | 141 |
| MKRN1 | exonic | NM_013446 | Homo sapiens makorin ring finger protein 1 (MKRN1), transcript variant 1, mRNA. | 142 |
| MKRN1 | exonic | NM_001145125 | Homo sapiens makorin ring finger protein 1 (MKRN1), transcript variant 2, mRNA. | 143 |
| BNC2 | exonic | NM_017637 | Homo sapiens basonuclin 2 (BNC2), mRNA. | 144 |

FIG. 41

| RefSeq_Gene_Symbol | Exon_overlap | RefSeq_Accession Number | mRNA_Description | SEQ ID |
|---|---|---|---|---|
| NBPF1 | exonic | NM_017940 | Homo sapiens neuroblastoma breakpoint family, member 1 (NBPF1), mRNA. | 145 |
| MYO1B | both | NM_001130158 | Homo sapiens myosin IB (MYO1B), transcript variant 1, mRNA. | 146 |
| MYO1B | both | NM_012223 | Homo sapiens myosin IB (MYO1B), transcript variant 2, mRNA. | 147 |
| MYO1B | both | NM_001161819 | Homo sapiens myosin IB (MYO1B), transcript variant 3, mRNA. | 148 |
| GPR111 | exonic | NM_153839 | Homo sapiens G protein-coupled receptor 111 (GPR111), mRNA. | 149 |

FIG. 4J

| Category | Gene | Latest Phase | Competition |
|---|---|---|---|
| Novel | AADAT | Preclinical | 1 |
| Novel | ABCA4 | Phase II Clinical Trial | 1 |
| Novel | ABCC1 | Preclinical | 1 |
| Novel | ABCD1 | Phase II Clinical Trial | 1 |
| Novel | ACACB | Preclinical | 1 |
| Proven | ACE | Launched | 5+ |
| Novel | ACE2 | Phase II Clinical Trial | 2 |
| Proven | ACHE | Launched | 5+ |
| Novel | ACLY | Phase II Clinical Trial | 1 |
| Proven | ACPP | Launched | 1 |
| Novel | ACVR2A | Phase II Clinical Trial | 1 |
| Novel | ACVR2B | Preclinical | 2 |
| Novel | ACVRL1 | Phase II Clinical Trial | 3 |
| Proven | ADA | Launched | 5+ |
| Novel | ADAM15 | Phase II Clinical Trial | 1 |
| Novel | ADAM17 | Preclinical | 1 |
| Novel | ADAM8 | Preclinical | 1 |
| Novel | ADAMTS13 | Preclinical | 1 |
| Novel | ADM | Preclinical | 1 |
| Novel | ADNP | Preclinical | 1 |
| Proven | ADORA1 | Launched | 5+ |
| Proven | ADORA2A | Launched | 5+ |
| Novel | ADORA2B | Preclinical | 2 |
| Novel | ADORA3 | Phase III Clinical Trial | 5+ |
| Proven | ADRA1A | Launched | 5+ |
| Proven | ADRA2A | Launched | 5+ |
| Proven | ADRB1 | Launched | 5+ |
| Proven | ADRB2 | Launched | 5+ |
| Proven | ADRB3 | Launched | 5+ |
| Novel | AFP | Preclinical | 1 |
| Novel | AGER | Phase II Clinical Trial | 3 |
| Novel | AGRN | Preclinical | 1 |
| Novel | AGT | Preclinical | 3 |
| Proven | AGTR1 | Launched | 5+ |
| Novel | AGTR2 | Phase II Clinical Trial | 2 |
| Novel | AHR | Preclinical | 1 |
| Novel | AIFM1 | Phase II Clinical Trial | 1 |
| Proven | AKR1B1 | Launched | 3 |
| Novel | AKR1C3 | Preclinical | 1 |
| Novel | AKT1 | Phase II Clinical Trial | 5+ |
| Novel | AKT2 | Phase I Clinical Trial | 2 |
| Novel | ALAS1 | Preclinical | 1 |
| Novel | ALDH1A1 | Preclinical | 1 |
| Novel | ALDH2 | Phase II Clinical Trial | 2 |
| Proven | ALK | Launched | 5+ |
| Proven | ALOX5 | Launched | 4 |
| Novel | ALOX5AP | Phase II Clinical Trial | 2 |
| Novel | ALPL | Phase III Clinical Trial | 1 |

FIG. 10A

| | | | |
|---|---|---|---|
| Novel | ALS3 | Phase I Clinical Trial | 1 |
| Novel | AMHR2 | Preclinical | 1 |
| Novel | ANGPT1 | Preclinical | 2 |
| Novel | ANGPT2 | Phase II Clinical Trial | 5+ |
| Novel | ANPEP | Phase III Clinical Trial | 1 |
| Novel | ANXA5 | Preclinical | 2 |
| Novel | AOC3 | Phase I Clinical Trial | 5+ |
| Novel | APCS | Phase II Clinical Trial | 3 |
| Novel | APEX1 | Phase I Clinical Trial | 1 |
| Novel | APOA1 | Phase II Clinical Trial | 5+ |
| Novel | APOA4 | Preclinical | 1 |
| Novel | APOB | Phase III Clinical Trial | 4 |
| Novel | APOC3 | Phase II Clinical Trial | 2 |
| Novel | APOE | Preclinical | 1 |
| Proven | APP | Launched | 5+ |
| Proven | AR | Launched | 5+ |
| Novel | ARG1 | Phase II Clinical Trial | 1 |
| Novel | ARSA | Phase II Clinical Trial | 2 |
| Proven | ARSB | Launched | 1 |
| Novel | ASIC1 | Phase I Clinical Trial | 1 |
| Novel | ASIC3 | Preclinical | 1 |
| Novel | ATOH1 | Preclinical | 1 |
| Proven | ATP1A1 | Launched | 5+ |
| Novel | ATP2A2 | Phase II Clinical Trial | 3 |
| Proven | ATP4A | Launched | 5+ |
| Novel | ATR | Preclinical | 2 |
| Novel | AURKA | Phase III Clinical Trial | 4 |
| Novel | AURKB | Phase II Clinical Trial | 2 |
| Proven | AVPR2 | Launched | 5+ |
| Novel | AXL | Preclinical | 5+ |
| Novel | BACE1 | Phase III Clinical Trial | 5+ |
| Novel | BAGE | Preclinical | 1 |
| Proven | BBOX1 | Launched | 1 |
| Novel | BCL2 | Phase II Clinical Trial | 5+ |
| Novel | BCL2L1 | Preclinical | 1 |
| Novel | BDKRB1 | Phase I Clinical Trial | 5+ |
| Proven | BDKRB2 | Launched | 4 |
| Novel | BGN | Preclinical | 1 |
| Novel | BIRC3 | Phase I Clinical Trial | 1 |
| Novel | BIRC5 | Phase II Clinical Trial | 4 |
| Novel | BMP1 | Preclinical | 1 |
| Proven | BMP2 | Launched | 4 |
| Proven | BMP7 | Launched | 1 |
| Novel | BPI | Phase I Clinical Trial | 1 |
| Proven | BRAF | Launched | 5+ |
| Novel | BRD4 | Phase II Clinical Trial | 1 |
| Novel | BST2 | Preclinical | 2 |
| Novel | BTK | Phase III Clinical Trial | 5+ |
| Novel | C3 | Phase II Clinical Trial | 4 |
| Proven | C5 | Launched | 3 |

FIG. 10B

| | | | |
|---|---|---|---|
| Novel | C5AR1 | Phase II Clinical Trial | 5+ |
| Proven | CA2 | Launched | 5+ |
| Novel | CA9 | Phase III Clinical Trial | 5+ |
| Proven | CACNA1B | Launched | 5+ |
| Proven | CACNA1C | Launched | 5+ |
| Proven | CACNA1G | Launched | 4 |
| Proven | CACNA2D1 | Launched | 5+ |
| Novel | CACNB3 | Preclinical | 1 |
| Proven | CALCA | Launched | 3 |
| Proven | CALCR | Launched | 5+ |
| Novel | CALCRL | Phase II Clinical Trial | 3 |
| Novel | CAPRIN1 | Preclinical | 1 |
| Novel | CASP1 | Preclinical | 1 |
| Novel | CASP2 | Phase I Clinical Trial | 2 |
| Novel | CASP3 | Phase II Clinical Trial | 2 |
| Novel | CASP6 | Preclinical | 2 |
| Novel | CASP8 | Phase II Clinical Trial | 2 |
| Novel | CASP9 | Phase I Clinical Trial | 2 |
| Proven | CASR | Launched | 5+ |
| Novel | CBLB | Preclinical | 2 |
| Proven | CCKAR | Launched | 1 |
| Proven | CCKBR | Launched | 3 |
| Novel | CCL11 | Phase II Clinical Trial | 1 |
| Novel | CCL2 | Phase II Clinical Trial | 1 |
| Proven | CCNG1 | Launched | 1 |
| Novel | CCR1 | Phase II Clinical Trial | 3 |
| Novel | CCR2 | Phase II Clinical Trial | 5+ |
| Novel | CCR3 | Phase II Clinical Trial | 2 |
| Proven | CCR4 | Launched | 5+ |
| Proven | CCR5 | Launched | 5+ |
| Novel | CCR6 | Preclinical | 1 |
| Novel | CCR9 | Phase III Clinical Trial | 2 |
| Novel | CD163 | Preclinical | 1 |
| Novel | CD19 | Phase II Clinical Trial | 5+ |
| Novel | CD200 | Phase II Clinical Trial | 3 |
| Novel | CD209 | Preclinical | 1 |
| Novel | CD22 | Phase III Clinical Trial | 5+ |
| Novel | CD248 | Phase II Clinical Trial | 1 |
| Novel | CD27 | Phase I Clinical Trial | 3 |
| Novel | CD274 | Phase I Clinical Trial | 3 |
| Novel | CD276 | Phase I Clinical Trial | 2 |
| Novel | CD28 | Phase II Clinical Trial | 3 |
| Proven | CD33 | Launched | 5+ |
| Novel | CD36 | Preclinical | 2 |
| Novel | CD37 | Phase II Clinical Trial | 2 |
| Novel | CD38 | Phase II Clinical Trial | 5+ |
| Novel | CD3E | Phase III Clinical Trial | 3 |
| Novel | CD4 | Phase II Clinical Trial | 5+ |
| Novel | CD40 | Phase II Clinical Trial | 5+ |
| Novel | CD40LG | Phase I Clinical Trial | 2 |

FIG. 10C

| | | | |
|---|---|---|---|
| Proven | CD44 | Launched | 5+ |
| Novel | CD47 | Preclinical | 1 |
| Novel | CD52 | Phase III Clinical Trial | 3 |
| Novel | CD55 | Phase II Clinical Trial | 2 |
| Novel | CD6 | Phase III Clinical Trial | 1 |
| Novel | CD70 | Phase I Clinical Trial | 4 |
| Novel | CD74 | Phase II Clinical Trial | 3 |
| Novel | CD79B | Phase II Clinical Trial | 1 |
| Novel | CD83 | Preclinical | 1 |
| Novel | CD8A | Preclinical | 1 |
| Novel | CDC7 | Preclinical | 4 |
| Novel | CDH11 | Preclinical | 1 |
| Novel | CDH5 | Phase III Clinical Trial | 1 |
| Novel | CDK4 | Phase I Clinical Trial | 2 |
| Novel | CDK5 | Preclinical | 1 |
| Novel | CDK7 | Preclinical | 1 |
| Novel | CDK9 | Preclinical | 2 |
| Novel | CDKN1A | Preclinical | 1 |
| Novel | CDKN1B | Preclinical | 1 |
| Novel | CDKN2A | Phase II Clinical Trial | 1 |
| Novel | CDNF | Preclinical | 1 |
| Novel | CEACAM1 | Preclinical | 1 |
| Proven | CEACAM5 | Launched | 5+ |
| Novel | CEL | Phase III Clinical Trial | 1 |
| Novel | CELA1 | Phase II Clinical Trial | 1 |
| Novel | CENPE | Phase I Clinical Trial | 1 |
| Novel | CETP | Phase III Clinical Trial | 5+ |
| Novel | CFB | Phase I Clinical Trial | 1 |
| Novel | CFD | Phase II Clinical Trial | 1 |
| Novel | CFH | Preclinical | 1 |
| Proven | CFTR | Launched | 5+ |
| Novel | CGB | Phase I Clinical Trial | 1 |
| Novel | CHAT | Phase II Clinical Trial | 2 |
| Novel | CHEK1 | Phase II Clinical Trial | 5+ |
| Novel | CHEK2 | Preclinical | 2 |
| Novel | CHKA | Phase I Clinical Trial | 3 |
| Proven | CHRM1 | Launched | 5+ |
| Proven | CHRM3 | Launched | 5+ |
| Novel | CHRNA7 | Phase III Clinical Trial | 5+ |
| Proven | CLCA1 | Launched | 1 |
| Proven | CLCN2 | Launched | 3 |
| Novel | CLU | Phase III Clinical Trial | 3 |
| Novel | CMA1 | Phase II Clinical Trial | 1 |
| Novel | CNGB3 | Preclinical | 1 |
| Proven | CNR1 | Launched | 5+ |
| Novel | CNTFR | Phase III Clinical Trial | 1 |
| Proven | COL18A1 | Launched | 4 |
| Novel | COL2A1 | Preclinical | 1 |
| Proven | COMT | Launched | 5+ |
| Novel | CPB2 | Phase I Clinical Trial | 3 |

FIG. 10D

| | | | |
|---|---|---|---|
| Proven | CPS1 | Launched | 1 |
| Novel | CPT1A | Phase I Clinical Trial | 4 |
| Novel | CR1 | Phase I Clinical Trial | 1 |
| Proven | CRAT | Launched | 1 |
| Novel | CRP | Phase II Clinical Trial | 2 |
| Proven | CSF1 | Launched | 4 |
| Novel | CSF1R | Phase I Clinical Trial | 5+ |
| Novel | CSF2 | Phase III Clinical Trial | 5+ |
| Proven | CSF2RA | Launched | 5+ |
| Proven | CSF3 | Launched | 5+ |
| Proven | CSF3R | Launched | 5+ |
| Novel | CSNK1D | Preclinical | 1 |
| Novel | CSNK2A1 | Preclinical | 1 |
| Novel | CSNK2B | Phase III Clinical Trial | 1 |
| Novel | CSPG4 | Preclinical | 2 |
| Novel | CTAG1B | Phase I Clinical Trial | 5+ |
| Novel | CTF1 | Phase I Clinical Trial | 1 |
| Novel | CTGF | Phase II Clinical Trial | 3 |
| Proven | CTLA4 | Launched | 3 |
| Novel | CTNNB1 | Phase II Clinical Trial | 1 |
| Novel | CTSC | Preclinical | 1 |
| Novel | CTSK | Phase III Clinical Trial | 3 |
| Novel | CTSS | Preclinical | 4 |
| Proven | CUBN | Launched | 2 |
| Novel | CXCL10 | Phase II Clinical Trial | 3 |
| Novel | CXCL12 | Phase II Clinical Trial | 2 |
| Novel | CXCL13 | Preclinical | 1 |
| Novel | CXCR2 | Phase I Clinical Trial | 1 |
| Proven | CXCR4 | Launched | 5+ |
| Novel | CXCR5 | Phase I Clinical Trial | 1 |
| Novel | CXCR6 | Preclinical | 1 |
| Novel | CXCR7 | Preclinical | 1 |
| Novel | CYBB | Preclinical | 1 |
| Novel | CYP11B2 | Phase II Clinical Trial | 3 |
| Proven | CYP17A1 | Launched | 5+ |
| Proven | CYP19A1 | Launched | 5+ |
| Novel | CYP24A1 | Preclinical | 1 |
| Novel | CYP2B6 | Phase II Clinical Trial | 1 |
| Novel | CYP51A1 | Preclinical | 1 |
| Proven | CYSLTR1 | Launched | 5+ |
| Novel | DAO | Preclinical | 2 |
| Novel | DCLRE1C | Preclinical | 1 |
| Novel | DCPS | Phase I Clinical Trial | 1 |
| Novel | DCT | Phase II Clinical Trial | 2 |
| Proven | DDC | Launched | 5+ |
| Novel | DDIT4 | Phase II Clinical Trial | 1 |
| Novel | DDX5 | Preclinical | 1 |
| Novel | DGAT1 | Phase III Clinical Trial | 5+ |
| Novel | DGAT2 | Preclinical | 1 |
| Proven | DHFR | Launched | 4 |

FIG. 10E

| | | | |
|---|---|---|---|
| Proven | DHODH | Launched | 4 |
| Novel | DIABLO | Phase II Clinical Trial | 1 |
| Novel | DKK1 | Phase II Clinical Trial | 3 |
| Novel | DKK2 | Preclinical | 1 |
| Novel | DLL4 | Phase I Clinical Trial | 4 |
| Novel | DMD | Phase III Clinical Trial | 5+ |
| Novel | DMPK | Preclinical | 1 |
| Proven | DNASE1 | Launched | 1 |
| Proven | DNMT1 | Launched | 5+ |
| Novel | DOT1L | Phase I Clinical Trial | 1 |
| Proven | DPP4 | Launched | 5+ |
| Novel | DPYD | Phase II Clinical Trial | 1 |
| Proven | DRD1 | Launched | 2 |
| Proven | DRD2 | Launched | 5+ |
| Proven | DRD3 | Launched | 5+ |
| Novel | DUT | Preclinical | 1 |
| Novel | DYRK1A | Preclinical | 2 |
| Novel | DYSF | Preclinical | 1 |
| Novel | EDA | Phase I Clinical Trial | 1 |
| Proven | EDNRA | Launched | 3 |
| Novel | EEF1A1 | Preclinical | 1 |
| Proven | EGF | Launched | 1 |
| Novel | EGFL7 | Phase II Clinical Trial | 1 |
| Proven | EGFR | Launched | 5+ |
| Novel | EGLN2 | Phase II Clinical Trial | 5+ |
| Novel | EGR1 | Phase II Clinical Trial | 1 |
| Novel | EIF4E | Phase II Clinical Trial | 1 |
| Novel | EIF5A | Phase II Clinical Trial | 1 |
| Proven | ELANE | Launched | 5+ |
| Novel | ELN | Preclinical | 1 |
| Novel | ENG | Phase II Clinical Trial | 1 |
| Novel | ENPEP | Phase I Clinical Trial | 1 |
| Novel | EPHA3 | Phase I Clinical Trial | 1 |
| Novel | EPHX2 | Phase I Clinical Trial | 1 |
| Novel | EPO | Preclinical | 2 |
| Proven | EPOR | Launched | 5+ |
| Proven | ERBB2 | Launched | 5+ |
| Novel | ERBB3 | Phase II Clinical Trial | 5+ |
| Novel | ERN1 | Preclinical | 1 |
| Novel | ERVW-1 | Phase II Clinical Trial | 2 |
| Proven | ESR1 | Launched | 5+ |
| Novel | ESRRA | Preclinical | 4 |
| Novel | EXOG | Phase II Clinical Trial | 1 |
| Novel | EZH2 | Preclinical | 4 |
| Proven | F10 | Launched | 5+ |
| Novel | F11 | Phase II Clinical Trial | 5+ |
| Proven | F13A1 | Launched | 3 |
| Proven | F2 | Launched | 5+ |
| Novel | F2RL1 | Preclinical | 2 |
| Novel | F3 | Phase II Clinical Trial | 5+ |

FIG. 10F

| | | | |
|---|---|---|---|
| Proven | F7 | Launched | 5+ |
| Proven | F8 | Launched | 5+ |
| Proven | F9 | Launched | 5+ |
| Novel | FAAH | Phase I Clinical Trial | 5+ |
| Novel | FAP | Preclinical | 2 |
| Novel | FAS | Phase II Clinical Trial | 3 |
| Novel | FASLG | Phase II Clinical Trial | 2 |
| Novel | FASN | Preclinical | 1 |
| Novel | FCAR | Preclinical | 1 |
| Novel | FCER2 | Preclinical | 1 |
| Novel | FCGR2B | Phase II Clinical Trial | 3 |
| Novel | FCGRT | Preclinical | 1 |
| Novel | FCRL5 | Preclinical | 1 |
| Novel | FDFT1 | Preclinical | 1 |
| Novel | FFAR1 | Phase III Clinical Trial | 5+ |
| Novel | FFAR2 | Phase I Clinical Trial | 2 |
| Novel | FFAR4 | Phase III Clinical Trial | 2 |
| Novel | FGF18 | Phase II Clinical Trial | 1 |
| Novel | FGF2 | Phase II Clinical Trial | 3 |
| Novel | FGF21 | Preclinical | 3 |
| Novel | FGF23 | Phase II Clinical Trial | 1 |
| Novel | FGF4 | Phase III Clinical Trial | 1 |
| Proven | FGFR1 | Launched | 5+ |
| Proven | FGFR2 | Launched | 3 |
| Novel | FIGF | Phase II Clinical Trial | 4 |
| Proven | FKBP1A | Launched | 5+ |
| Novel | FN1 | Phase II Clinical Trial | 1 |
| Proven | FNTA | Launched | 5+ |
| Proven | FOLH1 | Launched | 5+ |
| Novel | FOLR1 | Phase III Clinical Trial | 5+ |
| Novel | FOXA1 | Preclinical | 1 |
| Novel | FOXP3 | Preclinical | 1 |
| Novel | FPR2 | Preclinical | 1 |
| Novel | FRMD4A | Preclinical | 1 |
| Proven | FSHR | Launched | 5+ |
| Novel | FZD7 | Phase I Clinical Trial | 1 |
| Proven | GAA | Launched | 5+ |
| Proven | GABBR1 | Launched | 5+ |
| Proven | GABRA1 | Launched | 5+ |
| Novel | GAD1 | Preclinical | 1 |
| Novel | GALNS | Phase III Clinical Trial | 1 |
| Novel | GALR1 | Preclinical | 1 |
| Novel | GALR3 | Phase II Clinical Trial | 1 |
| Novel | GAPDH | Phase I Clinical Trial | 1 |
| Proven | GAST | Launched | 5+ |
| Novel | GATA3 | Phase II Clinical Trial | 2 |
| Proven | GBA | Launched | 5+ |
| Novel | GCG | Phase III Clinical Trial | 5+ |
| Proven | GCGR | Launched | 5+ |
| Novel | GCK | Phase II Clinical Trial | 5+ |

FIG. 10G

| | | | |
|---|---|---|---|
| Novel | GDE1 | Preclinical | 1 |
| Novel | GDF5 | Phase II Clinical Trial | 2 |
| Novel | GDNF | Preclinical | 5+ |
| Novel | GFRA1 | Preclinical | 2 |
| Novel | GFRA3 | Phase I Clinical Trial | 1 |
| Proven | GHR | Launched | 5+ |
| Novel | GHRH | Phase I Clinical Trial | 1 |
| Proven | GHRHR | Launched | 5+ |
| Novel | GHSR | Phase III Clinical Trial | 5+ |
| Proven | GLA | Launched | 5+ |
| Proven | GLP1R | Launched | 5+ |
| Proven | GLP2R | Launched | 3 |
| Novel | GNRH1 | Preclinical | 1 |
| Proven | GNRHR | Launched | 5+ |
| Novel | GP1BA | Phase II Clinical Trial | 1 |
| Novel | GP6 | Phase II Clinical Trial | 4 |
| Novel | GPBAR1 | Preclinical | 5+ |
| Novel | GPC3 | Phase II Clinical Trial | 2 |
| Novel | GPNMB | Phase II Clinical Trial | 1 |
| Novel | GPR119 | Phase II Clinical Trial | 5+ |
| Novel | GPR142 | Preclinical | 1 |
| Novel | GPR39 | Preclinical | 1 |
| Novel | GPR55 | Preclinical | 1 |
| Novel | GRB2 | Phase I Clinical Trial | 1 |
| Proven | GRIA1 | Launched | 5+ |
| Proven | GRIN1 | Launched | 5+ |
| Novel | GRIN2A | Preclinical | 1 |
| Novel | GRIN2B | Phase II Clinical Trial | 5+ |
| Novel | GRIN2D | Preclinical | 1 |
| Novel | GRM1 | Preclinical | 1 |
| Novel | GRM2 | Phase II Clinical Trial | 5+ |
| Novel | GRM3 | Preclinical | 2 |
| Novel | GRM4 | Preclinical | 5+ |
| Novel | GRM5 | Phase III Clinical Trial | 5+ |
| Novel | GRM7 | Preclinical | 1 |
| Novel | GRPR | Phase I Clinical Trial | 1 |
| Novel | GSG2 | Preclinical | 1 |
| Novel | GSK3B | Phase II Clinical Trial | 5+ |
| Novel | GSTP1 | Phase II Clinical Trial | 1 |
| Proven | GUCY2C | Launched | 5+ |
| Proven | GUSB | Launched | 2 |
| Novel | GZMB | Preclinical | 4 |
| Novel | HAMP | Phase II Clinical Trial | 3 |
| Novel | HAO2 | Preclinical | 1 |
| Novel | HAVCR1 | Preclinical | 1 |
| Novel | HBB | Phase II Clinical Trial | 2 |
| Novel | HBEGF | Phase I Clinical Trial | 2 |
| Proven | HCAR2 | Launched | 4 |
| Novel | HCRTR1 | Preclinical | 1 |
| Novel | HDAC10 | Phase II Clinical Trial | 1 |

FIG. 10H

| | | | |
|---|---|---|---|
| Novel | HDAC3 | Phase I Clinical Trial | 1 |
| Novel | HDAC4 | Preclinical | 1 |
| Novel | HDAC6 | Phase II Clinical Trial | 4 |
| Novel | HDAC8 | Preclinical | 1 |
| Novel | HDC | Phase II Clinical Trial | 1 |
| Novel | HDGFRP3 | Preclinical | 1 |
| Novel | HGF | Phase III Clinical Trial | 5+ |
| Novel | HIF1A | Phase I Clinical Trial | 5+ |
| Novel | HIST1H1D | Phase II Clinical Trial | 1 |
| Novel | HLA-B | Phase III Clinical Trial | 1 |
| Novel | HMBS | Phase I Clinical Trial | 1 |
| Novel | HMGB1 | Preclinical | 4 |
| Proven | HMGCR | Launched | 5+ |
| Novel | HMOX1 | Preclinical | 1 |
| Proven | HPD | Launched | 1 |
| Proven | HPGD | Launched | 1 |
| Proven | HPRT1 | Launched | 1 |
| Novel | HPSE | Phase III Clinical Trial | 3 |
| Novel | HRAS | Preclinical | 1 |
| Proven | HRH1 | Launched | 5+ |
| Proven | HRH2 | Launched | 5+ |
| Novel | HRH3 | Phase III Clinical Trial | 5+ |
| Novel | HRH4 | Phase II Clinical Trial | 5+ |
| Novel | HSD11B1 | Phase II Clinical Trial | 5+ |
| Novel | HSD17B3 | Preclinical | 1 |
| Novel | HSP90AA1 | Phase II Clinical Trial | 5+ |
| Novel | HSP90B1 | Preclinical | 1 |
| Novel | HSPA5 | Phase II Clinical Trial | 2 |
| Novel | HSPB1 | Phase II Clinical Trial | 3 |
| Novel | HSPD1 | Phase III Clinical Trial | 1 |
| Novel | HSPE1 | Phase I Clinical Trial | 1 |
| Proven | HTR1A | Launched | 5+ |
| Proven | HTR1D | Launched | 5+ |
| Proven | HTR2A | Launched | 5+ |
| Proven | HTR3A | Launched | 5+ |
| Proven | HTR4 | Launched | 5+ |
| Novel | HTT | Preclinical | 3 |
| Proven | HYAL1 | Launched | 3 |
| Novel | IAPP | Preclinical | 4 |
| Novel | ICAM1 | Phase III Clinical Trial | 2 |
| Novel | ICMT | Preclinical | 1 |
| Novel | ICOS | Phase I Clinical Trial | 1 |
| Novel | ICOSLG | Phase I Clinical Trial | 1 |
| Novel | IDH1 | Preclinical | 1 |
| Novel | IDH2 | Preclinical | 1 |
| Novel | IDO1 | Phase II Clinical Trial | 4 |
| Proven | IDS | Launched | 3 |
| Proven | IDUA | Launched | 2 |
| Novel | IFNA1 | Phase II Clinical Trial | 2 |
| Novel | IFNA2 | Phase II Clinical Trial | 4 |

FIG. 10I

| | | | |
|---|---|---|---|
| Proven | IFNAR1 | Launched | 5+ |
| Proven | IFNAR2 | Launched | 5+ |
| Novel | IFNB1 | Preclinical | 2 |
| Proven | IFNG | Launched | 4 |
| Proven | IFNGR1 | Launched | 5+ |
| Novel | IFNLR1 | Phase III Clinical Trial | 2 |
| Novel | IGF1 | Phase II Clinical Trial | 3 |
| Proven | IGF1R | Launched | 5+ |
| Novel | IGF2R | Phase II Clinical Trial | 1 |
| Novel | IGFBP3 | Phase II Clinical Trial | 1 |
| Proven | IGHE | Launched | 5+ |
| Novel | IKBKB | Phase II Clinical Trial | 2 |
| Novel | IL10 | Preclinical | 2 |
| Novel | IL10RA | Phase II Clinical Trial | 3 |
| Proven | IL11RA | Launched | 5+ |
| Novel | IL12A | Preclinical | 1 |
| Proven | IL12B | Launched | 4 |
| Novel | IL12RB1 | Phase II Clinical Trial | 1 |
| Novel | IL13 | Phase III Clinical Trial | 5+ |
| Novel | IL13RA2 | Phase II Clinical Trial | 1 |
| Novel | IL15RA | Preclinical | 3 |
| Novel | IL17A | Phase III Clinical Trial | 5+ |
| Novel | IL17RA | Phase III Clinical Trial | 1 |
| Novel | IL17RB | Preclinical | 1 |
| Novel | IL18 | Phase II Clinical Trial | 2 |
| Novel | IL1A | Phase III Clinical Trial | 1 |
| Proven | IL1B | Launched | 5+ |
| Proven | IL1R1 | Launched | 1 |
| Novel | IL1RAP | Preclinical | 1 |
| Proven | IL1RN | Launched | 2 |
| Proven | IL2 | Launched | 2 |
| Novel | IL20 | Phase II Clinical Trial | 2 |
| Novel | IL21R | Phase II Clinical Trial | 2 |
| Novel | IL22RA1 | Phase I Clinical Trial | 2 |
| Novel | IL23A | Phase III Clinical Trial | 4 |
| Novel | IL27 | Phase III Clinical Trial | 1 |
| Proven | IL2RA | Launched | 5+ |
| Novel | IL31 | Phase I Clinical Trial | 1 |
| Novel | IL3RA | Phase II Clinical Trial | 4 |
| Novel | IL4R | Preclinical | 1 |
| Novel | IL5 | Phase III Clinical Trial | 2 |
| Novel | IL5RA | Phase II Clinical Trial | 1 |
| Novel | IL6 | Phase III Clinical Trial | 5+ |
| Proven | IL6R | Launched | 5+ |
| Novel | IL7R | Phase II Clinical Trial | 3 |
| Proven | IL8 | Launched | 3 |
| Novel | ILK | Preclinical | 1 |
| Proven | IMPDH1 | Launched | 5+ |
| Novel | INPP5D | Phase II Clinical Trial | 4 |
| Novel | INS | Phase I Clinical Trial | 3 |

FIG. 10J

| | | | |
|---|---|---|---|
| Proven | INSR | Launched | 5+ |
| Novel | IRAK1 | Preclinical | 1 |
| Novel | IRAK4 | Preclinical | 2 |
| Novel | IRS1 | Phase III Clinical Trial | 1 |
| Novel | ITGA1 | Phase I Clinical Trial | 1 |
| Novel | ITGA2 | Phase II Clinical Trial | 1 |
| Novel | ITGAL | Phase II Clinical Trial | 2 |
| Novel | ITGB1BP2 | Preclinical | 1 |
| Novel | ITK | Phase I Clinical Trial | 1 |
| Novel | JAG1 | Preclinical | 1 |
| Novel | KCNA5 | Phase I Clinical Trial | 3 |
| Proven | KCNH2 | Launched | 1 |
| Proven | KCNMA1 | Launched | 2 |
| Novel | KCNN4 | Preclinical | 1 |
| Novel | KDM1A | Preclinical | 4 |
| Novel | KHK | Preclinical | 1 |
| Novel | KIF11 | Phase II Clinical Trial | 5+ |
| Novel | KIR3DL2 | Preclinical | 1 |
| Proven | KIT | Launched | 5+ |
| Novel | KLK1 | Preclinical | 1 |
| Novel | KLRC1 | Phase I Clinical Trial | 1 |
| Novel | KMO | Preclinical | 1 |
| Proven | KRAS | Launched | 3 |
| Novel | KSR1 | Preclinical | 1 |
| Novel | LAG3 | Phase II Clinical Trial | 3 |
| Novel | LCAT | Phase I Clinical Trial | 1 |
| Novel | LDLR | Preclinical | 1 |
| Novel | LEP | Preclinical | 1 |
| Novel | LEPR | Phase III Clinical Trial | 5+ |
| Novel | LGALS1 | Phase I Clinical Trial | 1 |
| Novel | LGALS3 | Phase III Clinical Trial | 4 |
| Proven | LHCGR | Launched | 5+ |
| Novel | LILRA4 | Preclinical | 1 |
| Novel | LIMK2 | Phase II Clinical Trial | 1 |
| Novel | LINGO1 | Phase II Clinical Trial | 1 |
| Novel | LIPA | Phase III Clinical Trial | 1 |
| Novel | LNPEP | Preclinical | 1 |
| Novel | LOXL2 | Phase II Clinical Trial | 1 |
| Novel | LPA | Preclinical | 1 |
| Novel | LPAR1 | Phase II Clinical Trial | 2 |
| Proven | LPL | Launched | 5+ |
| Novel | LRP1 | Preclinical | 1 |
| Novel | LRRK2 | Preclinical | 3 |
| Novel | LTA | Phase II Clinical Trial | 2 |
| Novel | LTA4H | Phase I Clinical Trial | 2 |
| Novel | LTBR | Preclinical | 1 |
| Novel | LTC4S | Preclinical | 1 |
| Novel | LTF | Phase II Clinical Trial | 2 |
| Novel | LY75 | Phase I Clinical Trial | 1 |
| Novel | MADCAM1 | Phase II Clinical Trial | 1 |

FIG. 10K

| | | | |
|---|---|---|---|
| Novel | MAG | Phase II Clinical Trial | 1 |
| Novel | MAGEA3 | Phase III Clinical Trial | 3 |
| Novel | MALAT1 | Preclinical | 1 |
| Novel | MAN2B1 | Phase III Clinical Trial | 1 |
| Novel | MANF | Preclinical | 1 |
| Proven | MAOA | Launched | 3 |
| Proven | MAOB | Launched | 5+ |
| Novel | MAP3K5 | Preclinical | 1 |
| Novel | MAPK8 | Preclinical | 1 |
| Novel | MAPK8IP1 | Phase II Clinical Trial | 1 |
| Novel | MAPKAPK2 | Preclinical | 1 |
| Novel | MAPT | Phase III Clinical Trial | 5+ |
| Novel | MARCKS | Phase II Clinical Trial | 1 |
| Novel | MAS1 | Phase II Clinical Trial | 3 |
| Novel | MASP2 | Preclinical | 1 |
| Proven | MBP | Launched | 3 |
| Novel | MC1R | Phase III Clinical Trial | 3 |
| Proven | MC2R | Launched | 1 |
| Novel | MC4R | Phase II Clinical Trial | 2 |
| Novel | MC5R | Phase II Clinical Trial | 1 |
| Novel | MCAM | Preclinical | 1 |
| Novel | MCHR1 | Preclinical | 1 |
| Novel | MCL1 | Preclinical | 2 |
| Novel | MDK | Preclinical | 2 |
| Novel | MDM2 | Phase I Clinical Trial | 5+ |
| Novel | MELK | Preclinical | 1 |
| Novel | METAP2 | Phase II Clinical Trial | 3 |
| Novel | MGEA5 | Preclinical | 1 |
| Novel | MGMT | Phase I Clinical Trial | 2 |
| Novel | MIA | Preclinical | 2 |
| Novel | MIEN1 | Preclinical | 1 |
| Novel | MIR10B | Preclinical | 1 |
| Novel | MIR122 | Phase II Clinical Trial | 2 |
| Novel | MIR145 | Preclinical | 1 |
| Novel | MIR195 | Preclinical | 1 |
| Novel | MIR206 | Preclinical | 1 |
| Novel | MIR21 | Preclinical | 1 |
| Novel | MIR29A | Preclinical | 1 |
| Novel | MIR33A | Preclinical | 1 |
| Novel | MIR34A | Preclinical | 1 |
| Novel | MIR378A | Preclinical | 1 |
| Novel | MIR451A | Preclinical | 1 |
| Novel | MIRLET7A1 | Preclinical | 1 |
| Novel | MLANA | Phase II Clinical Trial | 1 |
| Novel | MLNR | Phase II Clinical Trial | 4 |
| Proven | MME | Launched | 1 |
| Proven | MMP1 | Launched | 1 |
| Novel | MMP12 | Phase I Clinical Trial | 1 |
| Novel | MMP13 | Preclinical | 1 |
| Novel | MMP14 | Preclinical | 1 |

FIG. 10L

| | | | |
|---|---|---|---|
| Novel | MMP2 | Preclinical | 1 |
| Proven | MMP8 | Launched | 2 |
| Novel | MMP9 | Preclinical | 2 |
| Proven | MPL | Launched | 5+ |
| Novel | MPO | Phase II Clinical Trial | 3 |
| Novel | MRGPRD | Preclinical | 1 |
| Proven | MS4A1 | Launched | 5+ |
| Novel | MSLN | Phase II Clinical Trial | 3 |
| Novel | MSTN | Phase II Clinical Trial | 5+ |
| Novel | MTF1 | Phase I Clinical Trial | 2 |
| Proven | MTOR | Launched | 5+ |
| Proven | MTTP | Launched | 2 |
| Proven | MUC1 | Launched | 5+ |
| Novel | MUC16 | Phase III Clinical Trial | 1 |
| Novel | MYB | Preclinical | 1 |
| Novel | MYC | Preclinical | 2 |
| Novel | MYLIP | Preclinical | 1 |
| Novel | MYO7A | Phase II Clinical Trial | 1 |
| Novel | NAGLU | Preclinical | 3 |
| Novel | NAMPT | Preclinical | 1 |
| Novel | NCAM1 | Phase II Clinical Trial | 2 |
| Novel | NCL | Phase II Clinical Trial | 5+ |
| Novel | NCR1 | Preclinical | 2 |
| Novel | ND2 | Preclinical | 1 |
| Novel | NEDD4 | Preclinical | 1 |
| Proven | NFE2L2 | Launched | 3 |
| Proven | NFKB1 | Launched | 5+ |
| Novel | NFKBIA | Preclinical | 1 |
| Novel | NGF | Phase II Clinical Trial | 5+ |
| Novel | NGFR | Phase II Clinical Trial | 3 |
| Proven | NISCH | Launched | 2 |
| Novel | NLN | Preclinical | 1 |
| Novel | NOS1 | Phase II Clinical Trial | 3 |
| Novel | NOS2 | Phase II Clinical Trial | 2 |
| Novel | NOS3 | Phase II Clinical Trial | 1 |
| Novel | NOTCH1 | Phase I Clinical Trial | 4 |
| Proven | NPC1L1 | Launched | 3 |
| Proven | NPR1 | Launched | 5+ |
| Novel | NPY2R | Phase I Clinical Trial | 2 |
| Novel | NPY5R | Phase II Clinical Trial | 3 |
| Novel | NR1H2 | Preclinical | 1 |
| Novel | NR1H4 | Phase III Clinical Trial | 3 |
| Proven | NR3C1 | Launched | 5+ |
| Proven | NR3C2 | Launched | 5+ |
| Novel | NR4A2 | Preclinical | 1 |
| Novel | NR5A1 | Preclinical | 1 |
| Novel | NRG1 | Phase III Clinical Trial | 2 |
| Novel | NRP1 | Phase I Clinical Trial | 2 |
| Novel | NRTN | Phase II Clinical Trial | 1 |
| Novel | NTN1 | Preclinical | 1 |

FIG. 10M

| | | | |
|---|---|---|---|
| Novel | NTRK1 | Phase II Clinical Trial | 5+ |
| Novel | NTRK2 | Preclinical | 1 |
| Proven | ODC1 | Launched | 2 |
| Novel | OGFR | Preclinical | 1 |
| Proven | OPRK1 | Launched | 5+ |
| Novel | OPRL1 | Phase II Clinical Trial | 5+ |
| Proven | OPRM1 | Launched | 5+ |
| Proven | OXTR | Launched | 5+ |
| Novel | P2RX3 | Phase II Clinical Trial | 4 |
| Novel | P2RX7 | Phase I Clinical Trial | 5+ |
| Novel | P2RY1 | Preclinical | 1 |
| Proven | P2RY12 | Launched | 5+ |
| Proven | P2RY2 | Launched | 2 |
| Novel | P4HA1 | Phase II Clinical Trial | 2 |
| Novel | PABPN1 | Preclinical | 1 |
| Novel | PAK1 | Preclinical | 1 |
| Novel | PAK4 | Preclinical | 1 |
| Novel | PARK2 | Preclinical | 1 |
| Novel | PARP1 | Phase III Clinical Trial | 5+ |
| Novel | PASD1 | Preclinical | 1 |
| Novel | PAX2 | Preclinical | 2 |
| Novel | PCNA | Preclinical | 1 |
| Novel | PCSK6 | Preclinical | 1 |
| Novel | PCSK9 | Phase III Clinical Trial | 5+ |
| Novel | PDCD1 | Phase III Clinical Trial | 5+ |
| Proven | PDE1A | Launched | 1 |
| Novel | PDE2A | Preclinical | 1 |
| Proven | PDE3A | Launched | 5+ |
| Proven | PDE4A | Launched | 5+ |
| Proven | PDE5A | Launched | 5+ |
| Novel | PDE8B | Preclinical | 1 |
| Proven | PDGFRB | Launched | 5+ |
| Novel | PDHA1 | Phase II Clinical Trial | 1 |
| Novel | PDPK1 | Phase I Clinical Trial | 1 |
| Novel | PDX1 | Preclinical | 1 |
| Novel | PDYN | Phase II Clinical Trial | 1 |
| Novel | PECAM1 | Preclinical | 1 |
| Novel | PFKFB3 | Preclinical | 2 |
| Proven | PGR | Launched | 5+ |
| Novel | PHB | Phase I Clinical Trial | 1 |
| Novel | PI3 | Phase II Clinical Trial | 2 |
| Novel | PIK3C3 | Preclinical | 1 |
| Novel | PIK3CA | Phase III Clinical Trial | 5+ |
| Novel | PIK3CB | Phase II Clinical Trial | 2 |
| Novel | PIK3CD | Phase I Clinical Trial | 5+ |
| Novel | PIK3CG | Preclinical | 4 |
| Novel | PIKFYVE | Preclinical | 1 |
| Novel | PION | Preclinical | 1 |
| Novel | PKM | Preclinical | 4 |
| Novel | PKN3 | Phase I Clinical Trial | 1 |

FIG. 10N

| | | | |
|---|---|---|---|
| Novel | PLA2G10 | Preclinical | 1 |
| Novel | PLA2G4A | Phase I Clinical Trial | 1 |
| Novel | PLA2G7 | Phase III Clinical Trial | 4 |
| Proven | PLAT | Launched | 5+ |
| Proven | PLAU | Launched | 5+ |
| Novel | PLAUR | Preclinical | 2 |
| Proven | PLG | Launched | 5+ |
| Novel | PLK1 | Phase III Clinical Trial | 5+ |
| Novel | PLK2 | Preclinical | 2 |
| Novel | PMEL | Phase I Clinical Trial | 1 |
| Proven | PNLIP | Launched | 5+ |
| Novel | PNP | Phase II Clinical Trial | 2 |
| Novel | PORCN | Phase I Clinical Trial | 1 |
| Proven | PPARA | Launched | 5+ |
| Novel | PPARD | Phase I Clinical Trial | 2 |
| Proven | PPARG | Launched | 5+ |
| Proven | PPIA | Launched | 5+ |
| Novel | PPIB | Phase II Clinical Trial | 1 |
| Novel | PPID | Preclinical | 1 |
| Novel | PPP2CA | Phase I Clinical Trial | 2 |
| Novel | PPYR1 | Preclinical | 2 |
| Novel | PRAME | Phase II Clinical Trial | 1 |
| Novel | PRCP | Preclinical | 1 |
| Novel | PREP | Phase II Clinical Trial | 1 |
| Novel | PRKCA | Preclinical | 4 |
| Novel | PRKCB | Phase III Clinical Trial | 1 |
| Proven | PRKCD | Launched | 1 |
| Novel | PRKCQ | Preclinical | 1 |
| Novel | PRKDC | Phase I Clinical Trial | 1 |
| Novel | PRLR | Phase I Clinical Trial | 2 |
| Novel | PRMT5 | Preclinical | 1 |
| Novel | PRNP | Preclinical | 2 |
| Proven | PROC | Launched | 4 |
| Novel | PROM1 | Preclinical | 2 |
| Novel | PRSS12 | Preclinical | 1 |
| Novel | PRTN3 | Phase III Clinical Trial | 1 |
| Novel | PSCA | Preclinical | 2 |
| Proven | PTAFR | Launched | 5+ |
| Novel | PTCH1 | Preclinical | 1 |
| Novel | PTGDR | Phase III Clinical Trial | 2 |
| Novel | PTGDR2 | Phase II Clinical Trial | 5+ |
| Novel | PTGDS | Phase II Clinical Trial | 2 |
| Proven | PTGER1 | Launched | 5+ |
| Proven | PTGER2 | Launched | 5+ |
| Novel | PTGER4 | Phase II Clinical Trial | 5+ |
| Proven | PTGES | Launched | 5+ |
| Proven | PTGFR | Launched | 5+ |
| Proven | PTGIR | Launched | 5+ |
| Proven | PTGS1 | Launched | 5+ |
| Proven | PTGS2 | Launched | 5+ |

FIG. 10O

| | | | |
|---|---|---|---|
| Proven | PTH | Launched | 4 |
| Proven | PTH1R | Launched | 5+ |
| Novel | PTK2 | Phase II Clinical Trial | 5+ |
| Proven | PTMA | Launched | 2 |
| Novel | PTPRC | Phase II Clinical Trial | 2 |
| Novel | PVRL4 | Phase I Clinical Trial | 1 |
| Novel | PYGL | Preclinical | 4 |
| Novel | QPCT | Phase I Clinical Trial | 2 |
| Proven | RARB | Launched | 2 |
| Novel | RARRES3 | Preclinical | 2 |
| Novel | RASSF1 | Preclinical | 1 |
| Novel | RB1 | Phase I Clinical Trial | 1 |
| Novel | REG3A | Phase II Clinical Trial | 2 |
| Proven | REN | Launched | 5+ |
| Proven | RHD | Launched | 2 |
| Novel | RIPK2 | Preclinical | 1 |
| Novel | RLN1 | Phase I Clinical Trial | 1 |
| Novel | ROBO1 | Preclinical | 1 |
| Novel | ROCK1 | Phase III Clinical Trial | 2 |
| Novel | ROCK2 | Phase I Clinical Trial | 1 |
| Novel | RORA | Preclinical | 2 |
| Novel | RORC | Preclinical | 4 |
| Novel | RPE65 | Phase II Clinical Trial | 1 |
| Novel | RPS6KB1 | Preclinical | 2 |
| Novel | RTN4 | Phase II Clinical Trial | 3 |
| Novel | RUNX3 | Preclinical | 1 |
| Novel | RXFP1 | Phase III Clinical Trial | 5+ |
| Novel | RYR1 | Preclinical | 3 |
| Novel | RYR2 | Phase II Clinical Trial | 1 |
| Novel | S100A4 | Preclinical | 1 |
| Novel | S100A9 | Phase III Clinical Trial | 2 |
| Novel | SCD | Preclinical | 2 |
| Novel | SCGB1A1 | Phase II Clinical Trial | 1 |
| Novel | SCN10A | Phase I Clinical Trial | 3 |
| Proven | SCN5A | Launched | 5+ |
| Proven | SCN9A | Launched | 5+ |
| Proven | SCNN1A | Launched | 3 |
| Proven | SCTR | Launched | 4 |
| Novel | SDC1 | Phase II Clinical Trial | 1 |
| Novel | SELE | Preclinical | 1 |
| Novel | SELP | Phase II Clinical Trial | 2 |
| Novel | SELPLG | Phase I Clinical Trial | 2 |
| Novel | SEMA3A | Preclinical | 1 |
| Novel | SEMA4D | Phase I Clinical Trial | 1 |
| Proven | SERPINA1 | Launched | 5+ |
| Proven | SERPINC1 | Launched | 5+ |
| Novel | SERPINE1 | Preclinical | 1 |
| Novel | SERPINF1 | Preclinical | 1 |
| Proven | SERPING1 | Launched | 5+ |
| Novel | SGPL1 | Phase II Clinical Trial | 1 |

FIG. 10P

| | | | |
|---|---|---|---|
| Novel | SGSH | Phase II Clinical Trial | 2 |
| Proven | SI | Launched | 1 |
| Novel | SIGLEC15 | Preclinical | 1 |
| Novel | SIK2 | Preclinical | 1 |
| Novel | SIRPA | Preclinical | 1 |
| Novel | SIRT1 | Phase II Clinical Trial | 4 |
| Novel | SLAMF7 | Phase III Clinical Trial | 1 |
| Novel | SLC10A2 | Phase II Clinical Trial | 3 |
| Proven | SLC12A3 | Launched | 5+ |
| Novel | SLC16A1 | Preclinical | 1 |
| Proven | SLC18A2 | Launched | 5+ |
| Proven | SLC22A12 | Launched | 4 |
| Novel | SLC2A8 | Preclinical | 1 |
| Novel | SLC34A3 | Preclinical | 2 |
| Novel | SLC40A1 | Phase I Clinical Trial | 1 |
| Novel | SLC44A4 | Phase I Clinical Trial | 1 |
| Novel | SLC5A1 | Phase I Clinical Trial | 2 |
| Proven | SLC5A2 | Launched | 5+ |
| Novel | SLC5A5 | Preclinical | 1 |
| Proven | SLC6A1 | Launched | 1 |
| Proven | SLC6A2 | Launched | 5+ |
| Proven | SLC6A3 | Launched | 5+ |
| Proven | SLC6A4 | Launched | 5+ |
| Novel | SLC6A9 | Phase III Clinical Trial | 2 |
| Novel | SLC9A3 | Phase II Clinical Trial | 2 |
| Novel | SMN2 | Phase II Clinical Trial | 3 |
| Proven | SMO | Launched | 5+ |
| Novel | SMPD1 | Phase II Clinical Trial | 2 |
| Novel | SNCA | Phase I Clinical Trial | 5+ |
| Novel | SNRNP70 | Phase III Clinical Trial | 1 |
| Proven | SOAT1 | Launched | 1 |
| Novel | SOD1 | Phase III Clinical Trial | 5+ |
| Novel | SOST | Phase III Clinical Trial | 5+ |
| Novel | SPHK1 | Preclinical | 1 |
| Novel | SPHK2 | Phase I Clinical Trial | 2 |
| Proven | SRD5A2 | Launched | 1 |
| Novel | SREBF2 | Preclinical | 2 |
| Novel | ST13 | Preclinical | 1 |
| Novel | STAB1 | Preclinical | 2 |
| Novel | STAT3 | Phase II Clinical Trial | 5+ |
| Novel | STEAP1 | Phase I Clinical Trial | 1 |
| Novel | STMN1 | Phase I Clinical Trial | 1 |
| Novel | STS | Phase II Clinical Trial | 2 |
| Proven | SV2A | Launched | 2 |
| Novel | SYK | Phase II Clinical Trial | 5+ |
| Novel | SYVN1 | Preclinical | 1 |
| Novel | TAAR1 | Preclinical | 1 |
| Proven | TACR1 | Launched | 5+ |
| Novel | TACR2 | Phase II Clinical Trial | 3 |
| Novel | TACR3 | Preclinical | 1 |

FIG. 10Q

| | | | |
|---|---|---|---|
| Novel | TACSTD2 | Preclinical | 3 |
| Novel | TAP1 | Phase I Clinical Trial | 2 |
| Novel | TARDBP | Preclinical | 2 |
| Proven | TBXA2R | Launched | 3 |
| Proven | TBXAS1 | Launched | 4 |
| Novel | TERC | Phase II Clinical Trial | 1 |
| Novel | TERT | Phase III Clinical Trial | 5+ |
| Novel | TFF1 | Preclinical | 1 |
| Novel | TFF3 | Preclinical | 1 |
| Proven | TFPI | Launched | 4 |
| Novel | TFRC | Preclinical | 1 |
| Proven | TGFB1 | Launched | 5+ |
| Novel | TGFB2 | Phase III Clinical Trial | 2 |
| Novel | TGFBR1 | Phase II Clinical Trial | 5+ |
| Novel | TGFBR2 | Phase I Clinical Trial | 1 |
| Novel | TGM2 | Preclinical | 3 |
| Proven | THBD | Launched | 2 |
| Novel | THRB | Phase I Clinical Trial | 2 |
| Novel | TIE1 | Preclinical | 1 |
| Novel | TLR2 | Phase II Clinical Trial | 1 |
| Novel | TLR3 | Phase III Clinical Trial | 5+ |
| Proven | TLR4 | Launched | 5+ |
| Novel | TLR5 | Phase I Clinical Trial | 1 |
| Novel | TLR7 | Phase II Clinical Trial | 5+ |
| Novel | TLR8 | Phase II Clinical Trial | 2 |
| Novel | TLR9 | Phase III Clinical Trial | 5+ |
| Novel | TMEFF2 | Preclinical | 1 |
| Novel | TMPRSS15 | Preclinical | 1 |
| Novel | TMPRSS6 | Preclinical | 1 |
| Novel | TMSB4X | Preclinical | 1 |
| Novel | TNC | Phase II Clinical Trial | 1 |
| Proven | TNF | Launched | 5+ |
| Novel | TNFRSF10A | Phase II Clinical Trial | 1 |
| Novel | TNFRSF10B | Phase II Clinical Trial | 2 |
| Novel | TNFRSF11B | Preclinical | 1 |
| Novel | TNFRSF12A | Phase II Clinical Trial | 5+ |
| Novel | TNFRSF13C | Phase I Clinical Trial | 1 |
| Novel | TNFRSF18 | Phase I Clinical Trial | 1 |
| Novel | TNFRSF4 | Phase II Clinical Trial | 2 |
| Proven | TNFRSF8 | Launched | 2 |
| Novel | TNFRSF9 | Phase II Clinical Trial | 2 |
| Novel | TNFSF10 | Preclinical | 5+ |
| Proven | TNFSF11 | Launched | 3 |
| Novel | TNFSF13 | Preclinical | 1 |
| Proven | TNFSF13B | Launched | 3 |
| Novel | TNFSF14 | Phase I Clinical Trial | 1 |
| Novel | TNFSF4 | Phase II Clinical Trial | 2 |
| Novel | TNFSF8 | Preclinical | 1 |
| Proven | TNNC1 | Launched | 1 |
| Proven | TOP1 | Launched | 5+ |

FIG. 10R

| | | | |
|---|---|---|---|
| Proven | TOP2A | Launched | 5+ |
| Novel | TOR1A | Preclinical | 1 |
| Proven | TP53 | Launched | 5+ |
| Novel | TPBG | Phase III Clinical Trial | 5+ |
| Novel | TPH1 | Phase III Clinical Trial | 2 |
| Proven | TPO | Launched | 1 |
| Novel | TPP1 | Preclinical | 1 |
| Novel | TPSAB1 | Preclinical | 1 |
| Novel | TRAF6 | Preclinical | 1 |
| Novel | TRBV6-2 | Phase II Clinical Trial | 1 |
| Novel | TREM1 | Preclinical | 1 |
| Proven | TRHR | Launched | 5+ |
| Novel | TRIM63 | Preclinical | 1 |
| Novel | TRPA1 | Phase II Clinical Trial | 4 |
| Novel | TRPC5 | Preclinical | 1 |
| Novel | TRPM7 | Preclinical | 1 |
| Novel | TRPM8 | Phase I Clinical Trial | 5+ |
| Proven | TRPV1 | Launched | 5+ |
| Novel | TRPV3 | Phase II Clinical Trial | 2 |
| Novel | TRPV4 | Preclinical | 3 |
| Novel | TRPV6 | Phase I Clinical Trial | 3 |
| Proven | TSHR | Launched | 1 |
| Novel | TSLP | Phase I Clinical Trial | 1 |
| Novel | TSPO | Phase I Clinical Trial | 2 |
| Novel | TTK | Preclinical | 1 |
| Proven | TTR | Launched | 4 |
| Proven | TUBB | Launched | 5+ |
| Novel | TUBB3 | Preclinical | 1 |
| Novel | TUSC2 | Phase I Clinical Trial | 1 |
| Novel | TXN | Phase II Clinical Trial | 2 |
| Novel | TYK2 | Preclinical | 2 |
| Novel | TYMP | Phase III Clinical Trial | 2 |
| Proven | TYMS | Launched | 5+ |
| Proven | TYR | Launched | 1 |
| Novel | UBA3 | Phase I Clinical Trial | 2 |
| Novel | UBE3A | Preclinical | 1 |
| Novel | UGCG | Phase III Clinical Trial | 3 |
| Novel | USP14 | Preclinical | 2 |
| Novel | USP19 | Preclinical | 1 |
| Novel | USP34 | Preclinical | 1 |
| Novel | USP7 | Preclinical | 2 |
| Novel | UTRN | Phase I Clinical Trial | 2 |
| Novel | UTS2R | Phase I Clinical Trial | 1 |
| Proven | VDR | Launched | 5+ |
| Proven | VEGFA | Launched | 5+ |
| Novel | VEGFB | Preclinical | 1 |
| Novel | VEGFC | Phase I Clinical Trial | 2 |
| Novel | VIM | Phase II Clinical Trial | 1 |
| Proven | VIPR1 | Launched | 4 |
| Novel | VKORC1 | Preclinical | 1 |

FIG. 10S

| Novel | VTCN1 | Preclinical | 1 |
| Proven | VWF | Launched | 5+ |
| Novel | WAS | Phase II Clinical Trial | 1 |
| Novel | WEE1 | Phase II Clinical Trial | 2 |
| Novel | WT1 | Phase II Clinical Trial | 5+ |
| Proven | XDH | Launched | 3 |
| Novel | XIAP | Phase II Clinical Trial | 2 |
| Novel | XPO1 | Phase II Clinical Trial | 5+ |
| Novel | YWHAH | Preclinical | 1 |
| Novel | ZP3 | Preclinical | 1 |
| Novel | ZYX | Preclinical | 1 |

FIG. 10T

METHODS AND COMPOSITIONS FOR DIAGNOSING, PROGNOSING, AND TREATING ENDOMETRIOSIS

CROSS-REFERENCE TO RELATED APPLICATIONS

This application claims the benefit of the filing date of U.S. application Ser. No. 61/903,286, filed on Nov. 12, 2013, the disclosure of which is incorporated by reference herein.

The instant application includes a file identified as follows: "3886001US1sequencelisting.txt", which is 22,601,728 bytes in size. This file contains tabulated sequence information in non-delineated format. The aforementioned file was created on Dec. 12, 2014 and is hereby incorporated by reference in its entirety.

BACKGROUND

Endometriosis is an estrogen-dependent gynecologic disorder, defined as the presence of endometrial-like tissue outside the uterine cavity, which affects 6% to 10% women of reproductive age from all ethnic and social groups. The degree of endometriosis is staged according to the classification system of the American Society of Reproductive Medicine (*Fertil. Steril.*, 67:81721 (1997)) into minimal, mild, moderate, and severe disease. At present, the gold standard for diagnosis of endometriosis is laparoscopic inspection with histologic confirmation after retrieval of lesions.

As endometriosis can be progressive in up to 50% of women, early noninvasive diagnosis has the potential to offer early treatment and prevent progression. A noninvasive test for endometriosis would be also useful for women with pelvic pain and/or subfertility with normal ultrasound results. The goal of a non-invasive test is that no women with endometriosis or other significant pelvic pathology are missed who might benefit from medical therapy or surgery. There are reports of biomarkers that maybe useful for early or noninvasive detection. For example, Fossbinder et al. (*Fertil. Steril.*, 99:1135-1145 (2013)) point out that cancer antigen 125 (CA-125) is the most used peripheral biomarker of endometriosis, and that out of 28 biomarkers, multivariate analysis of plasma samples, showed that annexin V, vascular endothelial growth factor (VEGF), CA-125, and soluble intercellular adhesion molecule-1 (sICAM-1)/or glycodelinin enabled the diagnosis of endometriosis in women who had disease undetected by ultrasound. Surprisingly, inflammatory molecules did not emerge as biomarkers in a panel with the best diagnostic performers.

May et al. (*Hum. Reprod. Update*, 17:637-53 (2011)) conducted a systematic review of published results that assessed over 200 potential biomarkers for endometriosis, including hormones and their receptors, cytokines, and factors identified using proteomics, and analyzed histological results from endometrial tissue. Some of those putative biomarkers related to nerve fiber growth or cell cycle control, while others were cytokines including IL-1β, IL-IR type II, IL-6, IL-8, IL-13, IL-15, tumor necrosis factor (TNF)-α, (MCP-1); macrophage-stimulating protein (RANTES); steroids and hormones, e.g., aromatase and hydroxysteroid dehydrogenase enzymes; growth factors; e.g., TGFβ family, insulin-like growth (IGF) factors, hepatocyte growth factor (HGF) and its receptor, annexin-1; cell adhesion and extracellular matrix molecules, e.g., the r33 integrin subunit $\alpha_3\beta_1$ integrin, $\alpha_v\beta_5$ and $\alpha_v\beta_5$ integrins, E-cadherin; extracellular matrix molecules (ECM), e.g., ICAM-1, focal adhesion kinase (FAK); tissue remodeling molecules, e.g., matrix metalloproteinase (MMP) family, tissue inhibitors of metalloproteinases (TIMPs), urokinase; angiogenesis, e.g., vascular endothelial growth factor (VEGF), angiopoeitin-1 and -2 molecules; associated with apoptosis and cell cycle control, e.g., calpain 5, MCL-1, Bak, Ki67, telomerase activity, proliferating cell nuclear antigen, Pak-1, phosphorylated ERK I 12, c-myc, survivin; reactive oxygen and nitrogen species, e.g., endothelial xanthine oxidase, WT-1, CCL16, CCL21, HOXA10 and COX-2.

SUMMARY OF THE INVENTION

The invention provides a method of screening one or more female subjects for those having endometriosis (EN), those with altered susceptibility to developing EN or those at risk of developing EN. The method comprises assaying at least one genetic sample of one or more subjects, nucleic acid sequence information from the one or more subjects, or providing that information, for at least one genetic variation in one or more loci associated with EN, e.g., gene variations associated with one or more genes in FIG. 3. The presence in the genetic sample of the at least one genetic variation is used to determine whether the one or more subjects have EN, have an altered susceptibility to EN or are at risk of EN. In some embodiments, determining whether the one or more subjects have EN, are at risk of EN or have an altered susceptibility to EN includes a gynecological examination and/or medical history analysis of the one or more subjects, e.g., in addition to the nucleic acid sequence information. In some embodiments, at least one genetic sample is collected from blood, e.g., peripheral blood mononuclear cells (PBMC) or peripheral blood lymphocytes (PBL), saliva, urine, serum, tears, skin, tissue, or hair from at least one subject. In some embodiments, assaying the at least one genetic sample of one or more subjects includes purifying the at least one genetic sample. In some embodiments, assaying the at least one genetic sample of the one or more subjects includes amplifying at least one nucleotide or a specific region of one or more chromosomes in the at least one genetic sample. In some embodiments, assaying the at least one genetic sample of the one or more subjects includes assaying an unamplified sample for at least one nucleotide or a specific region of one or more chromosomes in the at least one genetic sample. In some embodiments, assaying the at least one genetic sample for at least one genetic variation includes a microarray analysis of the at least one sample. In some embodiments, the microarray analysis comprises a comparative genomic hybridization (CGH) array analysis.

In one embodiment, the invention provides a method of diagnosing a susceptibility to endometriosis in a female subject. The method includes providing nucleic acid sequence information from the female subject on the presence or absence of at least genetic variation in one or more genes or regions in FIG. 1 or FIG. 2. A susceptibility to endometriosis in the subject is diagnosed if the subject has at least one genetic variation in the one or more genes or regions in FIG. 1, wherein the at least genetic variation occurs in the gene or region more frequently in a population of female subjects that have endometriosis than in a population of female subjects that does not have endometriosis. In one embodiment, the nucleic acid sequence information is for one or more genes or regions that include but are not limited to one or more of TGFBR3, FUT9, PDE1C, IMPK, GIGYF2, HMGB3, ZFP14, ACCS, or DPP6. In one embodiment, the nucleic acid sequence information is for one or more genes or regions that include but are not limited to one or more of MYO1B, MIR3675, NBPF1, or GPR111. In one embodiment, the nucleic acid sequence information is for one or more genes or regions that include but are not limited to one or more of TGFB1I1, PTK2, PGRMC2, LEPROT, LEPR, MUC4, MAGEA11, BOK, BOK-AS1, TSHR, MSN, MYADML, CYP17A1, RXFP1, CRHR2, PLA2G4C, NCOA1, BNC2, or MKRN1. In one embodiment, the nucleic acid sequence information is for one or more genes or regions that include but are not limited to one or more of ARMC5, C16orf58, SLC5A2, ZNF843, LARP1B, DNAJC6, AS3MT, C10orf32, AS3MT-C10orf32, CNNM2, or RAB19.

In one embodiment, the invention provides a method of diagnosing a susceptibility to endometriosis in a female subject. The method includes detecting in a sample of the subject nucleic acid sequence information on the presence or absence of at least one genetic variation in one or more regions in FIG. 2. A susceptibility to endometriosis is diagnosed in the subject if the subject has at least one genetic variation in the one or more genes or regions in FIG. 1 or FIG. 2, wherein the at least genetic variation occurs in the gene or region more frequently in a population of female subjects that have endometriosis than in a population of female subjects that does not have endometriosis. In one embodiment, the nucleic acid sequence information is for one or more genes or regions that include but are not limited to one or more of TGFBR3, FUT9, PDE1C, IMPK, GIGYF2, HMGB3, ZFP14, ACCS, or DPP6. In one embodiment, the nucleic acid sequence information is for one or more genes or regions that include but are not limited to one or more of MYO1B, MIR3675, NBPF1, or GPR111. In one embodiment, the nucleic acid sequence information is for one or more genes or regions that include but are not limited to one or more of TGFB1I1, PTK2, PGRMC2, LEPROT, LEPR, MUC4, MAGEA11, BOK, BOK-AS1, TSHR, MSN, MYADML, CYP17A1, RXFP1, CRHR2, PLA2G4C, NCOA1, BNC2, or MKRN1. In one embodiment, the nucleic acid sequence information is for one or more genes or regions that include but are not limited to one or more of ARMC5, C16orf58, SLC5A2, ZNF843, LARP1B, DNAJC6, AS3MT, C10orf32, AS3MT-C10orf32, CNNM2, or RAB19.

In one embodiment, the invention provides a method that includes providing nucleic acid sequence information from a female subject on the presence or absence of at least genetic variation in one or more genes or regions in FIG. 2. A susceptibility to endometriosis in the subject is diagnosed if the subject has at least one genetic variation in the one or more genes or regions in FIG. 2, wherein the at least genetic variation occurs in the gene or region more frequently in a population of female subjects that have endometriosis than in a population of female subjects that does not have endometriosis. In one embodiment, the nucleic acid sequence information is for one or more genes or regions that include but are not limited to one or more of TGFBR3, FUT9, PDE1C, IMPK, GIGYF2, HMGB3, ZFP14, ACCS, or DPP6. In one embodiment, the nucleic acid sequence information is for one or more genes or regions that include but are not limited to one or more of MYO1B, MIR3675, NBPF1, or GPR111. In one embodiment, the nucleic acid sequence information is for one or more genes or regions that include but are not limited to one or more of TGFB1I1, PTK2, PGRMC2, LEPROT, LEPR, MUC4, MAGEA11, BOK, BOK-AS1, TSHR, MSN, MYADML, CYP17A1, RXFP1, CRHR2, PLA2G4C, NCOA1, BNC2, or MKRN1. In one embodiment, the nucleic acid sequence information is for one or more genes or regions that include but are not limited to one or more of ARMC5, C16orf58, SLC5A2, ZNF843, LARP1B, DNAJC6, AS3MT, C10orf32, AS3MT-C10orf32, CNNM2, or RAB19.

In some embodiments, the method further comprises designing or preparing an array, e.g., a CGH array, to measure or detect one or more genetic variations in the regions shown in FIG. 1 or FIG. 2. In some embodiments, the method further comprises providing such a CGH array for the measuring or detecting of one or more genetic variations. In some embodiments, assaying at least one genetic sample comprises obtaining nucleic acid sequence information. In some embodiments, obtaining the nucleic acid sequence information is accomplished by one or more methods including but not limited to PCR, sequencing, Northern blots, multiplex ligation-dependent probe amplification (MLPA), molecular beacon, array Comparative Genomic Hybridization, Invader assay, ligase chain reaction (LCR), fluorescence in situ hybridization, or any combination thereof. In some embodiments, sequencing comprises one or more high-throughput sequencing methods.

In some embodiments, determining whether one or more test subjects have EN, are at risk of EN or have an altered susceptibility to EN includes comparing the nucleic acid sequence information of the one or more test subjects, the at least one genetic variation identified in the one or more test subjects, or a combination thereof, to those of one or more control subjects, e.g., subjects that do not have EN, are not at risk of EN or do not have an enhanced susceptibility to EN. In some embodiments, the one more control subjects include one or more subjects not suspected of having EN and the one or more test subjects include one or more subjects suspected of having EN. In some embodiments, the one or more test subjects include one or more subjects with EN, and the one or more control subjects include one or more subjects without EN. In some embodiments, the one or more test subjects include one or more subjects who are symptomatic for EN, and the one or more control subjects include one or more subjects who are asymptomatic for EN. In some embodiments, the one or more test subjects include one or more subjects that do not present with pain as a major symptom. In some embodiments, the one or more test subjects have infertility issues (e.g., up to about 40% of women with EN have infertility issues but have no or little pain related to their EN lesions). In some embodiments, the one or more control subjects include one or more subjects that have increased or decreased susceptibility to EN. In some embodiments, the one or more control subjects include one or more subjects associated or unassociated with a treatment, therapeutic regimen, or any combination thereof.

In some embodiments, determining whether the one or more test subjects have EN, are at risk of EN or have an altered susceptibility to EN includes comparing a gynecological examination, a medical history analysis, or a combination thereof, of the one or more test subjects to the nucleic acid sequence information of the one or more test subjects, at least one genetic variation identified in the one or more test subjects, the nucleic acid sequence information of one or more control subjects, at least one genetic variation identified in the one or more control subjects, or a combination thereof.

In some embodiments, the at least one genetic variation comprises one or more point mutations, single nucleotide polymorphisms (SNPs), single nucleotide variants (SNVs), polymorphisms, translocations, insertions, deletions, amplifications, inversions, microsatellites, interstitial deletions, copy number variations (CNVs), loss of heterozygosity, or any combination thereof. For example, in some embodiments, the at least one genetic variation includes one or more genetic variations, e.g., CNVs in the genes listed in FIG. 1, e.g., genes having any one of SEQ ID NOs:1-47 or one or more genetic variations in CNV subregions listed in FIG. 2. In some embodiments, the genetic variation includes one or more genetic variations, e.g., CNVs, that disrupt or modulate one or more genes listed in FIG. 3. In some embodiments, the at least one genetic variation includes variations such as one or more CNVs that disrupt or modulate the expression or function of one or more RNA transcripts in FIG. 4, e.g., those having any one of SEQ ID NOs:48-149

In one aspect, the invention provides a method for screening for a therapeutic agent useful for preventing, inhibiting or treating EN. The method includes identifying an agent that modulates the function or expression of one or more genes listed in FIG. 3 or expression products therefrom, or one or more RNA transcripts mentioned in FIG. 4 or expression products thereof. In some embodiments, the expression products include one or more proteins expressed from a gene listed in FIG. 3 or encoded by one or more transcripts mentioned in FIG. 4. In some embodiments, modulating the function or activity of one or more RNA transcripts or proteins results in an increase in expression. In some embodiments, modulating the function or activity of one or more RNA transcripts or proteins results in a decrease in expression.

In one aspect, a method of preventing, inhibiting or treating EN in a subject is provided. The method includes administering one or more agents effective to modulate the function of one or more genes listed in FIG. 3, or expression products therefrom, or one or more RNA transcripts mentioned in FIG. 4, or expression products thereof, thereby preventing, inhibiting or treating the EN. In some embodiments, the expression products are one or more proteins expressed from a gene listed in FIG. 3, or encoded by one or more RNA transcripts mentioned in FIG. 4 or genes in the same pathway (see, e.g., FIG. 9). In some embodiments, the one or more agents include but are not limited to a protein, e.g., an antibody, a drug, a combination of drugs, a compound, a combination of compounds, radiation, a genetic sequence, a combination of genetic sequences, heat or cryogenics, or a combination of two or more of any combination thereof.

In one aspect, a method for screening for a therapeutic agent useful for treating EN is provided. The method includes identifying an agent that modulates the function or expression of one or more genes listed in FIG. 3 or expression products therefrom. In some embodiments, the expression products include one or more RNA transcripts in FIG. 4. In some embodiments, the expression products include one or more proteins expressed from a gene listed in FIG. 3 or encoded by one or more RNA transcripts in FIG. 4. In some embodiments, modulating the function or activity of one or more RNA transcripts or proteins includes an increase in expression. In some embodiments, modulating the function or activity of one or more RNA transcripts or proteins includes a decrease in expression. In some embodiments, screening the one or more subjects also includes selecting one or more therapies based on the presence or absence of the one or more genetic variations, e.g., the presence of a genetic variation in at least one gene listed in FIG. 3.

In one aspect, a method of treating a subject for EN is provided. The method includes administering one or more agents effective to modulate the function of one or more genes listed in FIG. 3, or expression products therefrom, thereby treating EN. In some embodiments, the expression products include one or more RNA transcripts in FIG. 4. In some embodiments, the expression products include one or more proteins expressed from a gene in FIG. 3, or encoded by one or more RNA transcripts in FIG. 4. In some embodiments, the agent may be an antibody, a compound, a combination of compounds, radiation, a genetic sequence, a combination of genetic sequences, heat, cryogenics, and a combination of two or more of any combination thereof.

As described in Examples 3 and 4, CNV analysis using methods described in Example 1 revealed the presence of a 4-probe spanning heterozygous TGFBR3 deletion in 3 individuals with endometriosis. Primer pairs specific for that region successfully generated a product of the expected size in the deletion carriers but not in either normal DNA or DNA from an endometriosis patient without the deletion. Thus, TGFBR3 genetic variations, e.g., the TGFBR3 CNV or others described herein, may be used in an assay that would facilitate rapid and low cost screening of endometriosis cohorts for the presence of the genetic variation, e.g., deletion, in order to obtain better estimates for the frequency of the variation in such cohorts and diagnose the cause of endometriosis in those who carry the variation.

The method comprises assaying at least one genetic sample of one or more subjects, nucleic acid sequence information from the one or more subjects, or providing that information, for at least one genetic variation impacting or encompassing TGFBR3. The presence in the genetic sample of the at least one genetic variation is used to determine whether the one or more subjects have EN, have an altered susceptibility to EN or are at risk of EN. In some embodiments, determining whether the one or more subjects have EN, are at risk of EN or have an altered susceptibility to EN includes a gynecological examination and/or medical history analysis of the one or more subjects, e.g., in addition to the nucleic acid sequence information. In some embodiments, at least one genetic sample is collected from blood, e.g., peripheral blood mononuclear cells (PBMC) or peripheral blood lymphocytes (PBL), saliva, urine, serum, tears, skin, tissue, or hair from at least one subject. In some embodiments, assaying the at least one genetic sample of one or more subjects includes purifying the at least one genetic sample. In some embodiments, assaying the at least one genetic sample of the one or more subjects includes amplifying at least one nucleotide or a specific region of one or more chromosomes in the at least one genetic sample. In some embodiments, assaying the at least one genetic sample of the one or more subjects includes assaying an unamplified sample for at least one nucleotide or a specific region of one or more chromosomes in the at least one genetic sample. In some embodiments, assaying the at least one genetic sample for at least one genetic variation includes a microarray analysis of the at least one sample. In some embodiments, the microarray analysis comprises a comparative genomic hybridization (CGH) array analysis. In one embodiment, the method includes detecting a deletion in TGFBR3, e.g., using a multiplex ligation-dependent probe amplification (MLPA), molecular beacon, aCGH, Invader assay, ligase chain reaction (LCR), or fluorescence in situ hybridization.

In one aspect, the invention provides a kit for screening for EN in a subject. The kit includes at least one component for assaying a genetic sample from the subject for the presence of at least one genetic variation in the genes listed in FIG. 1 or in FIG. 2 associated with EN. In one embodiment, a kit to screen for the TGFBR3 deletion, as described in Example 4, contains PCR primers such as Example 4 OUTER_FWD and OUTER_REV primers or similar primer pairs (see below) that yield a specific amplification product in genetic samples that contain the TGFBR3 deletion but do not yield an amplification product in genetic samples without the TGFBR3 deletion. In another embodiment, a kit to screen for the TGFBR3 deletion, as described in Example 4, contains an Invader oligonucleotide and primary probe that target the specific junction fragment of DNA sequence resulting from the deletion and produce a signal in genetic samples that contain the TGFBR3 deletion but do not produce a signal in genetic samples without the TGFBR3 deletion. In some embodiments, the at least one genetic variation is associated with a disruption or aberration of one or more RNA transcripts mentioned in FIG. 4. In some embodiments, the at least one genetic variation is associated with a disruption or aberration of one or more proteins expressed from one or more genes listed in FIG. 3, or encoded by one or more RNA transcripts mentioned in FIG. 4. One embodiment provides a kit for screening for endometriosis in one or more female subjects, the kit comprising reagents for assaying a genetic sample from the one or more subjects for the presence or absence of at least one genetic variation in one or more genes or regions in FIG. 1 or 3, or a combination thereof.

In some embodiments, screening the one or more subjects further comprises selecting one or more therapies based on the presence or absence of the one or more genetic variations. In some embodiments, the nucleic acid sequencing information is obtained for the whole genome or whole exome from the one or more subjects. In some embodiments, the nucleic acid sequencing information has already been obtained for the whole genome or whole exome from the one or more individuals and the nucleic acid information is obtained from in silico analysis. In other embodiments, the nucleic acid sequencing information is obtained for a selected portion of the whole genome or whole exome.

BRIEF DESCRIPTION OF THE DRAWINGS

FIG. 1A, FIG. 1B, FIG. 1C, FIG. 1D, and FIG. 1E show exemplary regions with genetic variations that are associated with EN. For each variation in each EN subject, the following are provided: chromosome for the variation, start and stop locations for original CNV; original CNV size; CNV type; subject case identifier (ID); gene symbol; and SEQ ID number corresponding to that region.

FIG. 2A, FIG. 2B, FIG. 2C, FIG. 2D, and FIG. 2E, FIG. 2F, FIG. 2G, FIG. 2H, and FIG. 2I show exemplary CNV subregions with genetic variations that are associated with EN. For each variation in each EN case, the following are provided: chromosome for the variation; start and stop location of CNV subregion; CNV subregion size; CNV type; subject case ID(s); gene symbol; whether the CNV subregion overlaps an exon; the number of control (NVE) subjects with a CNV in that subregion, the number of EN cases with a CNV in that subregion; Fisher 2-tailed Exact Test (FET); odds ratio (OR); and whether the CNV subregion is of interest due to FET or OR, or a biological association with EN.

FIG. 3A, FIG. 3B, FIG. 3C, FIG. 3D, FIG. 3E, FIG. 3F, FIG. 3G, FIG. 3H, FIG. 3I, FIG. 3J, FIG. 3K, FIG. 3L, FIG. 3M, FIG. 3N, FIG. 3O, FIG. 3P, FIG. 3Q, FIG. 3R, FIG. 3S, FIG. 3T, FIG. 3U, FIG. 3V, FIG. 3W, FIG. 3X, and FIG. 3Y summarize the characteristics of genes in the regions associated with EN.

FIG. 4A, FIG. 4B, FIG. 4C, FIG. 4D, FIG. 4E, FIG. 4F, FIG. 4G, FIG. 4H, FIG. 4I, and FIG. 4J summarize transcripts in the regions associated with EN and corresponding SEQ ID Nos.

FIG. 10A, FIG. 10B, FIG. 10C, FIG. 10D, FIG. 10E, FIG. 10F, FIG. 10G, FIG. 10H, FIG. 10I, FIG. 10J, FIG. 10K, FIG. 10L, FIG. 10M, FIG. 10N, FIG. 10O, FIG. 10P, FIG. 10Q, FIG. 10R, FIG. 10S, and FIG. 10T provide a list of genes that are known drug targets as reported in Agarwal et al., *Nat. Rev. Drug Discov.* 12(8):575-6 (2013). Category defines the target as 'proven' if at least one drug selective for its protein product is approved and 'novel' if no drug has been approved yet. Gene lists the gene symbol for the drug target, latest phase lists the latest stage of drug development for the target, and competition lists the number of pharmaceutical companies that have a drug in development or launched for a given drug target.

DETAILED DESCRIPTION

Figure 5:
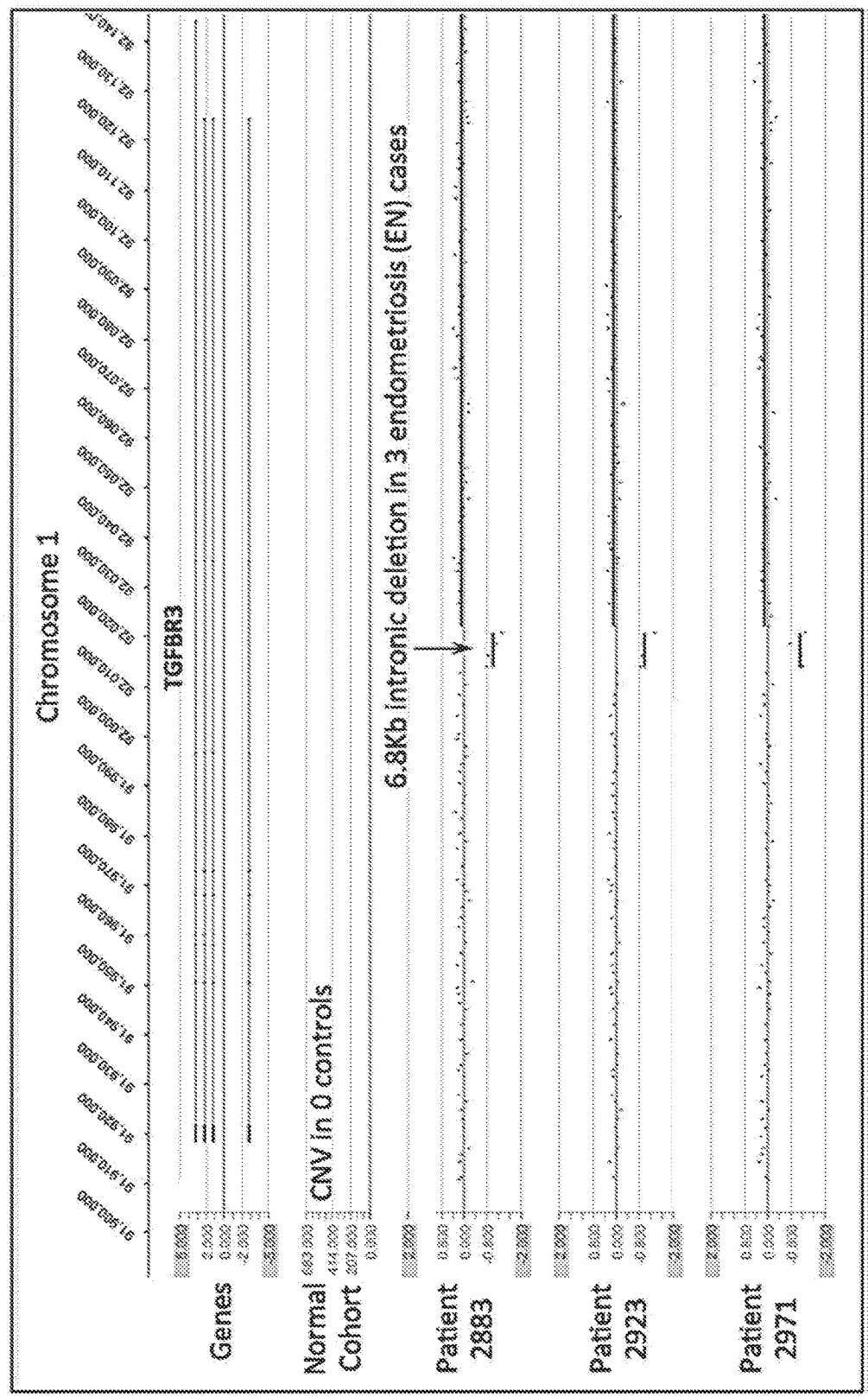
FIG. 5 shows schematic of deletion in chromosome 1 within TGFBR3 that is found in 3 EN cases and 0 controls.
Figure 6:
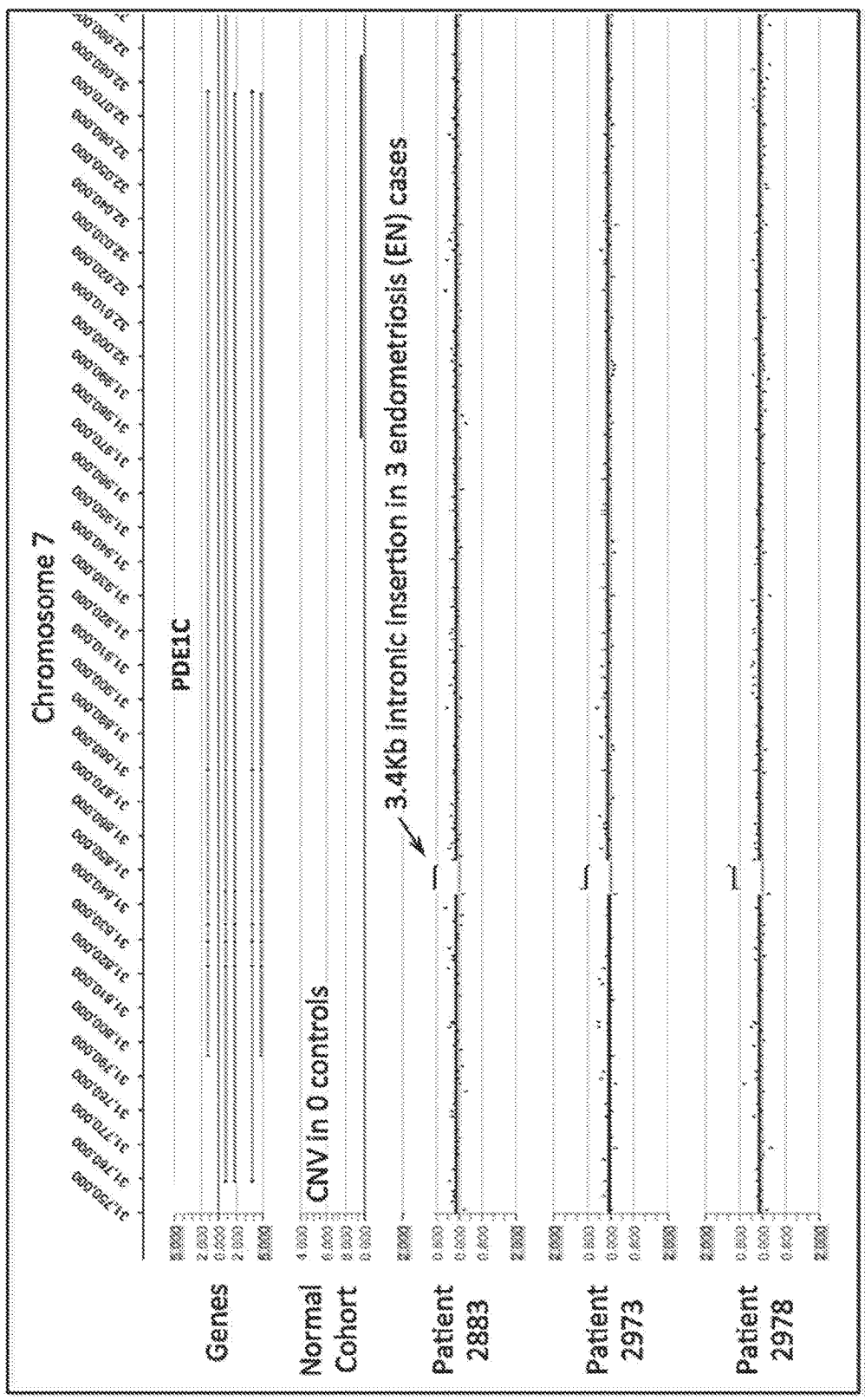
FIG. 6 shows schematic of insertion in chromosome 7 within PDE1C that is found in 3 EN cases and 0 controls.

Genetic risk can be conferred by subtle differences in individual genomes within a population. Genes can differ between individuals due to genomic variability, and the most frequent differences are due to single nucleotide polymorphisms (SNPs). SNPs can be located, on average, every 500-1000 base pairs in the human genome. Additional genetic polymorphisms in a human genome can be caused by duplication, insertion, deletion, translocation and/or inversion, of short and/or long stretches of DNA. Thus, in general, genetic variability among individuals occurs on many scales, ranging from single nucleotide changes, to gross changes in chromosome structure and function. Many copy number variations (CNVs) of DNA segments, including deletions, insertions, duplications and complex multi-site variants, ranging in length from kilobases to megabases in size, have been discovered (Redon et al., *Nature,* 444: 444-54 (2006) and Estivill & Armengol, *PLoS Genetics,* 3:1787 (2007)). Known CNVs account for over 15% of the assembled human genome (Estivill & Armengol, supra).

However, a majority of these variants are extremely rare and cover a small percentage of a human genome of any particular individual.

Described herein are methods of identifying variations in nucleic acids and genes associated with EN and their use in diagnosis, prognosis and theranosis. Also described herein are methods of screening for determining a subject's risk of or susceptibility to developing EN, or methods of diagnosing EN, based on identification and detection, or detection, of genetic nucleic acid variations. Also described herein are methods and compositions for treating, inhibiting and/or preventing EN using a therapeutic modality. The present disclosure further encompasses methods of assessing an individual for probability of response to a therapeutic agent for EN, methods for predicting the effectiveness of a therapeutic agent for EN, nucleic acids, polypeptides and antibodies useful in methods or kits, and computer-implemented functions. Kits for screening a sample from a subject to detect or determine a risk of or susceptibility to EN are also encompassed by the disclosure.

Genetic Variations Associated with Endometriosis

Genomic sequences within populations exhibit variability between individuals at many locations in the genome. For example, the human genome exhibits sequence variations, which occur on average every 500 base pairs. Such genetic variations in nucleic acid sequences are commonly referred to as polymorphisms or polymorphic sites. In some embodiments, these genetic variations can be found to be associated with EN using the methods disclosed herein. In some embodiments, these genetic variations comprise point mutations, e.g., single nucleotide polymorphisms (SNPs) or single nucleotide variants (SNVs), polymorphisms, translocations, insertions, deletions, amplifications, inversions, interstitial deletions, copy number variations (CNVs), loss of heterozygosity, or any combination thereof. In some embodiments, polymorphisms (e.g., polymorphic markers, genetic variations, or genetic variants) can comprise any nucleotide position at which two or more sequences are possible in a subject population. In some embodiments, each version of a nucleotide sequence with respect to the polymorphism can represent a specific allele of the polymorphism. In some embodiments, genomic DNA from a subject can contain two alleles for any given polymorphic marker, representative of each copy of the marker on each chromosome. In some embodiments, an allele can be a nucleotide sequence of a given location on a chromosome. Polymorphisms can comprise any number of specific alleles. In some embodiments of the disclosure, a polymorphism can be characterized by the presence of two or more alleles in a population. In some embodiments, the polymorphism can be characterized by the presence of three or more alleles. In some embodiments, the polymorphism can be characterized by four or more alleles, five or more alleles, six or more alleles, seven or more alleles, nine or more alleles, or ten or more alleles. In some embodiments an allele can be associated with one or more diseases or disorders. In some embodiments, genetic variations and alleles can be used to associate an inherited phenotype, for example, susceptibility EN, with a responsible genotype. In some embodiments, an allele, e.g., a risk allele, can be a variant allele that is statistically associated with EN, a risk of developing EN, or an increase susceptibility to EN. In some embodiments, genetic variations can be of any measurable frequency in the population, for example, a frequency higher than 10%, a frequency between 5-10%, a frequency between 1-5%, or frequency below 1%. As used herein, variant alleles can be alleles that differ from a reference allele. As used herein, a variant can be a segment of DNA that differs from the reference DNA, such as a genetic variation. In some embodiments, genetic variations can be used to track the inheritance of a gene that has not yet been identified, but whose approximate location is known.

As used herein, a haplotype can be information regarding the presence or absence of one or more genetic markers in a given chromosomal region in a subject. In some embodiments, a haplotype can be a segment of DNA characterized by one or more alleles arranged along the segment, for example, a haplotype can comprise one member of the pair of alleles for each genetic variation or locus. In some embodiments, the haplotype can comprise two or more alleles, three or more alleles, four or more alleles, five or more alleles, or any combination thereof, wherein, each allele can comprise one or more genetic variations along the segment.

In some embodiments, a genetic variation can be a functional aberration that can alter gene function, gene expression, protein expression, protein function, or any combination thereof. In some embodiments, a genetic variation can be a loss-of-function mutation, gain-of-function mutation, dominant negative mutation, or reversion. In some embodiments, a genetic variation can be part of a gene's coding region or regulatory regions. Regulatory regions can control gene expression and thus protein expression. In some embodiments, a regulatory region can be a segment of DNA wherein regulatory proteins, for example, transcription factors, can bind. In some embodiments a regulatory region can be positioned near the gene being regulated, for example, positions upstream of the gene being regulated. In some embodiments, a regulatory region (e.g., enhancer element) can be several thousands of base pairs upstream or downstream of a gene.

In some embodiments, variants can include changes that affect a polypeptide or protein, such as a change in expression level, sequence, function, localization, binding partners, or any combination thereof. In some embodiments, a genetic variation can be a frameshift mutation, nonsense mutation, missense mutation, neutral mutation, or silent mutation. For example, sequence differences, when compared to a reference nucleotide sequence, can include the insertion or deletion of a single nucleotide, or of more than one nucleotide, resulting in a frame shift; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of a reading frame; duplication of all or a part of a sequence; transposition; or a rearrangement of a nucleotide sequence. Such sequence changes can alter the polypeptide encoded by the nucleic acid, for example, if the change in the nucleic acid sequence causes a frame shift, the frame shift can result in a change in the encoded amino acids, and/or can result in the generation of a premature stop codon, causing generation of a truncated polypeptide. In some embodiments, a genetic variation associated with EN can be a synonymous change in one or more nucleotides, for example, a change that does not result in a change in the amino acid sequence. Such a polymorphism can, for example, alter splice sites, affect the stability or transport of mRNA, or otherwise affect the transcription or translation of an encoded polypeptide. In some embodiments, a synonymous mutation can result in the protein product having an altered structure due to rare codon usage that impacts protein folding during translation, which in some cases may alter its function and/or drug binding properties if it is a drug target. In some embodiments, the changes that can alter DNA increase the possibility that structural changes, such as amplifications or deletions, occur at the somatic level. A polypeptide encoded by the reference nucleotide sequence can be a reference polypeptide with a particular reference amino acid sequence, and polypeptides encoded by variant nucleotide sequences can be variant polypeptides with variant amino acid sequences.

In some embodiments, one or more variant polypeptides or proteins can be associated with EN. In some embodiments, variant polypeptides and changes in expression, localization, and interaction partners thereof, can be used to associate an inherited phenotype, EN, with a responsible genotype. In some embodiments, an EN associated variant polypeptide can be statistically associated with a diagnosis, prognosis, or theranosis of EN.

The most common sequence variants comprise base variations at a single base position in the genome, and such sequence variants, or polymorphisms, are commonly called single nucleotide polymorphisms (SNPs) or single nucleotide variants (SNVs). In some embodiments, a SNP represents a genetic variant present at greater than or equal to 1% occurrence in a population and in some embodiments a SNP can represent a genetic variant present at any frequency level in a population. A SNP can be a nucleotide sequence variation occurring when a single nucleotide at a location in the genome differs between members of a species or between paired chromosomes in a subject. SNPs can include variants of a single nucleotide, for example, at a given nucleotide position, some subjects can have a 'G', while others can have a 'C'. SNPs can occur in a single mutational event, and therefore there can be two possible alleles possible at each SNP site; the original allele and the mutated allele. SNPs that are found to have two different bases in a single nucleotide position are referred to as biallelic SNPs, those with three are referred to as triallelic, and those with all four bases represented in the population are quadallelic. In some embodiments, SNPs can be considered neutral. In some embodiments SNPs can affect susceptibility to EN. SNP polymorphisms can have two alleles, for example, a subject can be homozygous for one allele of the polymorphism wherein both chromosomal copies of the individual have the same nucleotide at the SNP location, or a subject can be heterozygous wherein the two sister chromosomes of the subject contain different nucleotides. The SNP nomenclature as reported herein is be the official Reference SNP (rs) ID identification tag as assigned to each unique SNP by the National Center for Biotechnological Information (NCBI).

Another genetic variation of the disclosure can be copy number variations/variants (CNVs). CNVs can be alterations of the DNA of a genome that results in an abnormal number of copies of one or more sections of DNA. CNVs can be inherited or caused by de novo mutation and can be responsible for a substantial amount of human phenotypic variability, behavioral traits, and disease susceptibility. In one embodiment, CNVs of the current disclosure can be associated with risk of or susceptibility to EN. In some embodiments, CNVs can impact a single gene or include a contiguous set of genes. In some embodiments, CNVs can be caused by structural rearrangements of the genome, for example, translocations, insertions, deletions, amplifications, inversions, and interstitial deletions. In some embodiments, these structural rearrangements occur on one or more chromosomes. Low copy repeats (LCRs), which are region-specific repeat sequences, can be susceptible to these structural rearrangements, resulting in CNVs. Factors such as size, orientation, percentage similarity and the distance between the copies can influence the susceptibility of LCRs to mediate genomic rearrangement.

CNVs can account for genetic variation affecting a substantial proportion of the human genome, for example, known CNVs can cover over 15% of the human genome sequence (Estivill and Armengol, supra). CNVs can affect gene expression, phenotypic variation and adaptation by disrupting a gene or altering gene dosage, and can cause disease, for example, microdeletion and microduplication disorders, and can confer susceptibility to diseases and disorders. Updated information about the location, type, and size of known CNVs can be found in one or more databases, for example, the Database of Genomic Variants (projects.tcag.ca/variation/), which currently contains data for over 100,000 CNVs.

Other types of sequence variants can be found in the human genome and can be associated with a disease or disorder, including but not limited to, microsatellites. Microsatellite markers are stable, polymorphic, easily analyzed, and can occur regularly throughout the genome, making them especially suitable for genetic analysis. A polymorphic microsatellite can comprise multiple small repeats of bases, for example, CA repeats, at a particular site wherein the number of repeat lengths varies in a population. In some embodiments, microsatellites, for example, variable number of tandem repeats (VNTRs), can be short segments of DNA that have one or more repeated sequences, for example, about 2 to 5 nucleotides long, that can occur in non-coding DNA. In some embodiments, changes in microsatellites can occur during genetic recombination of sexual reproduction, increasing or decreasing the number of repeats found at an allele, or changing allele length.

Subjects

A subject, as used herein, can be an individual of any age from whom a sample containing nucleotides is obtained for analysis, e.g., by one or more methods described herein, so as to obtain genetic data, for example, a female adult, child, newborn, or fetus. In some embodiments, a subject can be any target of therapeutic administration. In some embodiments, a subject can be a test subject or a reference subject. In some embodiments, a subject can be associated with EN, asymptomatic or symptomatic, have increased or decreased susceptibility to EN, be associated or unassociated with a treatment or treatment regimen, or any combination thereof. As used in the present disclosure a cohort can represent an ethnic group, a patient group, a particular age group, a group not associated with EN, a group associated with EN, a group of asymptomatic female subjects, a group of symptomatic female subjects, or a group or subgroup of female subjects associated with a particular response to a treatment regimen or clinical trial. In some embodiments, a patient can be a subject afflicted with EN. In some embodiments, a patient can be a subject not afflicted with EN. In some embodiments, a female subject can be a test female subject, a female patient or a female candidate for a therapeutic, wherein genomic DNA from the female subject, female patient, or female candidate is obtained for analysis by one or more methods of the present disclosure herein, so as to obtain genetic variation information of the subject, patient or candidate.

In some embodiments, the sample can be obtained prenatally from a female fetus or embryo or from the mother, for example, from fetal or embryonic cells in the maternal circulation. In some embodiments, the sample can be obtained with the assistance of a health care provider, for example, to draw blood. In some embodiments, the sample can be obtained without the assistance of a health care provider, for example, where the sample is obtained non-invasively, such as a saliva sample, or a sample comprising buccal cells that is obtained using a buccal swab or brush, or a mouthwash sample.

The present disclosure also provides methods for assessing genetic variations in female subjects who are members of a target population. Such a target population is in some embodiments a population or group of subjects at risk of developing EN, based on, for example, other genetic factors, biomarkers, biophysical parameters, family history of EN, previous screening or medical history, or any combination thereof.

In some embodiments, female subjects can be from specific age subgroups, such as those over the age of 1, over the age of 2, over the age of 3, over the age of 4, over the age of 5, over the age of 6, over the age of 7, over the age of 8, over the age of 9, over the age of 10, over the age of 15, over the age of 20, over the age of 25, over the age of 30, over the age of 35, over the age of 40, over the age of 45, over the age of 50, over the age of 55, over the age of 60, over the age of 65, over the age of 70, over the age of 75, over the age of 80, or over the age of 85. Other embodiments of the disclosure pertain to other age groups, such as subjects aged less than 85, such as less than age 80, less than age 75, less than age 70, less than age 65, less than age 60, less than age 55, less than age 50, less than age 45, less than age 40, less than age 35, less than age 30, less than age 25, less than age 20, less than age 15, less than age 10, less than age 9, less than age 8, less than age 6, less than age 5, less than age 4, less than age 3, less than age 2, or less than age 1. Other embodiments relate to female subjects with age at onset of the disease in any of particular age or age ranges defined by the numerical values described in the above or other numerical values bridging these numbers. It is also contemplated that a range of ages can be relevant in certain embodiments, such as age at onset at more than age 15 but less than age 20. Other age ranges are however also contemplated, including all age ranges bracketed by the age values listed in the above.

The genetic variations of the present disclosure found to be associated with EN can show similar association in other female populations. Particular embodiments comprising subject female populations are thus also contemplated and within the scope of the disclosure. Such embodiments relate to female subjects that are from one or more human populations including, but not limited to, Caucasian, European, American, Ashkenazi Jewish, Sephardi Jewish, Eurasian, Asian, Central/South Asian, East Asian, Middle Eastern, African, Hispanic, and Oceanic populations. European populations include, but are not limited to, Swedish, Norwegian, Finnish, Russian, Danish, Icelandic, Irish, Kelt, English, Scottish, Dutch, Belgian, French, German, Spanish, Portuguese, Italian, Polish, Bulgarian, Slavic, Serbian, Bosnian, Czech, Greek and Turkish populations. The racial contribution in female subjects can also be determined by genetic analysis, for example, genetic analysis of ancestry can be carried out using unlinked microsatellite markers such as those set out in Smith et al. (*Am. J. Hum. Genet.*, 74:1001 (2004)).

It is also well known to the person skilled in the art that certain genetic variations have different population frequencies in different populations, or are polymorphic in one population but not in another. A person skilled in the art can however apply the methods available and as thought herein to practice the present disclosure in any given human population. This can include assessment of genetic variations of the present disclosure, so as to identify those markers that give strongest association within the specific population. Thus, the at-risk variants of the present disclosure can reside on different haplotype background and in different frequencies in various human populations.

Samples

Samples that are suitable for use in the methods described herein can be from a subject and can contain genetic or proteinaceous material, for example, genomic DNA (gDNA). Genetic material can be extracted from one or more biological samples including but not limited to, blood, saliva, urine, mucosal scrapings of the lining of the mouth, expectorant, serum, tears, skin, tissue, or hair.

In some embodiments, the sample can comprise cells or tissue, for example, cell lines. Exemplary cell types from which genetic material can be obtained using the methods described herein and include but are not limited to, a blood cell; such as a B lymphocyte, T lymphocyte, leukocyte, erythrocyte, macrophage, or neutrophil; a muscle cell such as a skeletal cell, smooth muscle cell or cardiac muscle cell; a germ cell, such as a sperm or egg; an epithelial cell; a connective tissue cell, such as an adipocyte, chondrocyte; fibroblast or osteoblast; a neuron; an astrocyte; a stromal cell; an organ specific cell, such as a kidney cell, pancreatic cell, liver cell, or a keratinocyte; a stem cell; or any cell that develops there from. A cell from which gDNA is obtained can be at a particular developmental level including, for example, a hematopoietic stem cell or a cell that arises from a hematopoietic stem cell such as a red blood cell, B lymphocyte, T lymphocyte, natural killer cell, neutrophil, basophil, eosinophil, monocyte, macrophage, or platelet. Generally any type of stem cell can be used including, without limitation, an embryonic stem cell, adult stem cell, an induced pluripotent stem cell created from an adult cell type such as fibroblasts derived from skin or pluripotent stem cell.

In some embodiments, a sample can be processed for DNA isolation, for example, DNA in a cell or tissue sample can be separated from other components of the sample. Cells can be harvested from a biological sample using standard techniques known in the art, for example, by centrifuging a cell sample and resuspending the pelleted cells, for example, in a buffered solution, for example, phosphate-buffered saline (PBS). In some embodiments, after centrifuging the cell suspension to obtain a cell pellet, the cells can be lysed to extract DNA. In some embodiments, the sample can be concentrated and/or purified to isolate DNA. All samples obtained from a female subject, including those subjected to any sort of further processing, are considered to be obtained from the subject. In some embodiments, standard techniques and kits known in the art can be used to extract genomic DNA from a biological sample, including, for example, phenol extraction, a QIAamp® Tissue Kit (Qiagen, Chatsworth, Calif.), a Wizard® Genomic DNA purification kit (Promega), or a Qiagen Autopure method using Puregene chemistry, which can enable purification of highly stable DNA well-suited for archiving.

In some embodiments, determining the identity of an allele or determining copy number can, but need not, include obtaining a sample comprising DNA from a subject, and/or assessing the identity, copy number, presence or absence of one or more genetic variations and their chromosomal locations in the sample. The individual or organization that performs the determination need not actually carry out the physical analysis of a sample from a subject. In some embodiments, the methods can include using information obtained by analysis of the sample by a third party. In some embodiments, the methods can include steps that occur at more than one site. For example, a sample can be obtained from a subject at a first site, such as at a health care provider or at the subject's home in the case of a self-testing kit. The sample can be analyzed at the same or a second site, for example, at a laboratory or other testing facility.

Methods of Screening

As used herein, screening a subject may include diagnosing or determining, theranosing, or determining the risk of or susceptibility to developing (prognosing) EN. In particular embodiments, the disclosure is a method of determining the presence of, a risk of developing or a susceptibility to, EN, by detecting at least one genetic variation in a sample from a subject as described herein. In some embodiments, detection of particular alleles, markers, variations, or haplotypes is indicative of the presence of or susceptibility to EN.

Within any given population, there can be an absolute susceptibility of developing a disease or trait, defined as the chance of a person developing the specific disease or trait over a specified time-period. Susceptibility (e.g., being at-risk) is typically measured by looking at very large numbers of people, rather than at a particular individual. As described herein, certain copy number variations (genetic variations) are found to be useful for susceptibility assessment of EN. Susceptibility assessment can involve detecting particular genetic variations in the genome of individuals undergoing assessment. Particular genetic variations are found more frequently in individuals with EN, than in individuals without EN. Therefore, these genetic variations have predictive value for detecting EN, risk of developing EN, or a susceptibility to EN, in an individual. Without intending to be limited by theory, it is believed that the genetic variations described herein to be associated with susceptibility of EN represent functional variants predisposing to the disease. In some embodiments, a genetic variation can confer a susceptibility of the condition, for example, carriers of the genetic variation are at a different risk of the condition than non-carriers. In one embodiment, the presence of a genetic variation is indicative of increased susceptibility to or the presence of EN.

Screening can be performed using any method. In some embodiments, screening can be performed using Polymerase Chain Reaction (PCR). In one embodiment, screening can be performed using Array Comparative Genomic Hybridization (aCGH). In some embodiments, the genetic variation information as it relates to the current disclosure can be used in conjunction with any symptomatic screening tests.

In some embodiments, information from any of the above screening methods (e.g., specific symptoms or genetic variation data) can be used to define a subject as a test subject or reference subject. In some embodiments, information from any of the above screening methods can be used to associate a subject with a test or reference population, for example, a subject in a population.

In one embodiment, an association with EN can be determined by the statistical likelihood of the presence of a genetic variation in a subject with EN, for example, an unrelated individual or a first or second-degree relation of the subject. In some embodiments, an association with EN can be determined by determining the statistical likelihood of the absence of a genetic variation in an unaffected reference subject, for example, an unrelated individual or a first or second-degree relation of the subject. The methods described herein can include obtaining and analyzing a sample from one or more suitable reference subjects.

As used herein, susceptibility can be proneness of a subject towards the development of EN, or towards resisting development of EN, than one or more control subjects. In some embodiments, susceptibility can encompass increased susceptibility. For example, particular nucleic acid variations of the disclosure as described herein can be characteristic of increased susceptibility to development of EN. In some embodiments, susceptibility can encompass decreased susceptibility, for example, particular nucleic variations of the disclosure as described herein can be characteristic of decreased susceptibility to development of EN. As used herein, a subject at risk of developing EN has a greater chance of developing EN relative to the general population or to one or more subjects without a specific genetic variation.

As described herein, a genetic variation predictive of susceptibility to or presence of EN can be one where the particular genetic variation is more frequently present in a subject with the condition (affected), compared to the frequency of its presence in a reference group (control), such that the presence of the genetic variation is indicative of susceptibility to or presence of EN. In some embodiments, the reference group can be a population sample, for example, a random sample from the general population or a mixture of two or more samples from a population. In some embodiments, disease-free controls can be characterized by the absence of one or more specific EN-associated symptoms, for example, individuals who have not experienced symptoms associated with EN. In some embodiments, the disease-free control group is characterized by the absence of one or more EN-specific risk factors, for example, at least one genetic and/or environmental risk factor. In some embodiments, a reference sequence can be referred to for a particular site of genetic variation. In some embodiments, a reference allele can be a wild-type allele and can be chosen as either the first sequenced allele or as the allele from a control individual. In some embodiments, one or more reference subjects can be characteristically matched with one or more affected subjects, for example, with matched aged, gender or ethnicity.

A person skilled in the art can appreciate that for genetic variations with two or more alleles present in the population being studied, and wherein one allele can found in increased frequency in a group of individuals with EN in the population, compared with controls, the other allele(s) of the marker can be found in decreased frequency in the group of individuals with the trait or disease, compared with controls. In such a case, one allele of the marker, for example, the allele found in increased frequency in individuals with EN, can be the at-risk allele, while the other allele(s) can be neutral or even protective.

A genetic variant associated with EN can be used to predict the susceptibility of EN for a given genotype. For any genetic variation, there can be one or more possible genotypes, for example, homozygote for the at-risk variant (e.g., in autosomal recessive disorders), heterozygote, and non-carrier of the at-risk variant. In some embodiments, susceptibility associated with variants at multiple loci can be used to estimate overall susceptibility. For multiple genetic variants, there can be k ($k=3^n*2^p$) possible genotypes; wherein n can be the number of autosomal loci and p can be the number of gonosomal (sex chromosomal) loci. Overall susceptibility assessment calculations can assume that the relative susceptibilities of different genetic variants multiply, for example, the overall susceptibility associated with a particular genotype combination can be the product of the susceptibility values for the genotype at each locus. If the susceptibility presented is the relative susceptibility for a person, or a specific genotype for a person, compared to a reference population, then the combined susceptibility can be the product of the locus specific susceptibility values and can correspond to an overall susceptibility estimate compared with a population. If the susceptibility for a person is based on a comparison to non-carriers of the at-risk allele, then the combined susceptibility can correspond to an estimate that compares the person with a given combination of genotypes at all loci to a group of individuals who do not carry at-risk variants at any of those loci. The group of non-carriers of any at-risk variant can have the lowest estimated susceptibility and can have a combined susceptibility, compared with itself, for example, non-carriers, of 1.0, but can have an overall susceptibility, compared with the population, of less than 1.0.

Overall risk for multiple risk variants can be performed using standard methodology. Genetic variations described herein can form the basis of risk analysis that combines other genetic variations known to increase risk of EN, or other genetic risk variants for EN. In certain embodiments of the disclosure, a plurality of variants (genetic variations, variant alleles, and/or haplotypes) can be used for overall risk assessment. These variants are in some embodiments selected from the genetic variations as disclosed herein. Other embodiments include the use of the variants of the present disclosure in combination with other variants known to be useful for screening for EN or a susceptibility to EN. In such embodiments, the genotype status of a plurality of genetic variations, markers and/or haplotypes is determined in an individual, and the status of the individual compared with the population frequency of the associated variants, or the frequency of the variants in clinically healthy subjects, such as age-matched and sex-matched subjects.

Methods known in the art, such as the use of available algorithms and software can be used to identify, or call, significant genetic variations, including but not limited to, algorithms of DNA Analytics or DNAcopy, iPattern and/or QuantiSNP. In some embodiments, a threshold log ratio value can be used to determine losses and gains. For example, using DNA Analytics, a log 2ratio cutoff of 0.25 and −0.25 to classify CNV gains and losses respectively may be used. As a further example, using DNAcopy, a log 2ratio cutoff of 0.35 and −0.35 to classify CNV gains and losses respectively may be used. In some embodiments, the information and calls from two or more of the methods described herein can be compared to each other to identify significant genetic variations more or less stringently. For example, CNV calls generated by both DNA Analytics and DNAcopy algorithms may be defined as stringent CNVs. In some embodiments, significant or stringent genetic variations can be tagged as identified or called if it can be found to have a minimal reciprocal overlap to a genetic variation detected by one or more platforms and/or methods described herein. For example, a minimum of 50% reciprocal overlap can be used to tag the CNVs as identified or called.

In some embodiments, multivariate analyses or joint risk analyses, including the use of multiplicative model for overall risk assessment, and can subsequently be used to determine the overall risk conferred based on the genotype status at the multiple loci. Use of a multiplicative model, for example, assuming that the risk of individual risk variants multiply to establish the overall effect, allows for a straightforward calculation of the overall risk for multiple markers. The multiplicative model is a parsimonious model that usually fits the data of complex traits reasonably well. Deviations from multiplicity have been rarely described in the context of common variants for common diseases, and if reported are usually only suggestive since very large sample sizes can be required to be able to demonstrate statistical interactions between loci. Assessment of risk based on such analysis can subsequently be used in the methods, uses and kits of the disclosure, as described herein.

In some embodiments, the significance of increased or decreased susceptibility can be measured by a percentage. In some embodiments, a significant increased susceptibility can be measured as a relative susceptibility of at least 1.2, including but not limited to: at least 1.2, at least 1.3, at least 1.4, at least 1.5, at least 1.6, at least 1.7, 1.8, at least 1.9, at least 2.0, at least 2.5, at least 3.0, at least 4.0, at least 5.0, at least 6.0, at least 7.0, at least 8.0, at least 9.0, at least 10.0, and at least 15.0. In some embodiments, a relative susceptibility of at least 2.0, at least 3.0, at least 4.0, at least, 5.0, at least 6.0, or at least 10.0 is significant. Other values for significant susceptibility are also contemplated, for example, at least 2.5, 3.5, 4.5, 5.5, or any suitable other numerical values, wherein the values are also within scope of the present disclosure. In some embodiments, a significant increase in susceptibility is at least about 20%, including but not limited to about 25%, 30%, 35%, 40%, 45%, 50%, 55%, 60%, 65%, 70%, 75%, 80%, 85%, 90%, 95%, 100%, 150%, 200%, 300%, 400%, 500%, 600%, 700%, 800%, 900%, 1000%, and 1500%. In one particular embodiment, a significant increase in susceptibility is at least 100%. In other embodiments, a significant increase in susceptibility is at least 200%, at least 300%, at least 400%, at least 500%, at least 700%, at least 800%, at least 900% and at least 1000%. Other cutoffs or ranges as deemed suitable by the person skilled in the art to characterize the disclosure are also contemplated, and those are also within scope of the present disclosure. In certain embodiments, a significant increase in susceptibility is characterized by a p-value, such as a p-value of less than 0.5, less than 0.4, less than 0.3, less than 0.2, less than 0.1, less than 0.05, less than 0.01, less than 0.001, less than 0.0001, less than 0.00001, less than 0.000001, less than 0.0000001, less than 0.00000001, or less than 0.000000001.

In some embodiments, an individual who is at a decreased susceptibility for or the lack of presence of EN can be an individual in whom at least one genetic variation, conferring decreased susceptibility for or the lack of presence of EN is identified. In some embodiments, the genetic variations conferring decreased susceptibility are also protective. In one aspect, the genetic variations can confer a significant decreased susceptibility of or lack of presence of EN.

In some embodiments, significant decreased susceptibility can be measured as a relative susceptibility of less than 0.9, including but not limited to less than 0.9, less than 0.8, less than 0.7, less than 0.6, less than 0.5, less than 0.4, less than 0.3, less than 0.2 and less than 0.1. In some embodiments, the decrease in susceptibility is at least 20%, including but not limited to at least 25%, at least 30%, at least 35%, at least 40%, at least 45%, at least 50%, at least 55%, at least 60%, at least 65%, at least 70%, at least 75%, at least 80%, at least 85%, at least 90%, at least 95% and at least 98%. Other cutoffs or ranges as deemed suitable by the person skilled in the art to characterize the disclosure are however also contemplated, and those are also within scope of the present disclosure. In certain embodiments, a significant decrease in susceptibility is characterized by a p-value, such as a p-value of less than 0.05, less than 0.01, less than 0.001, less than 0.0001, less than 0.00001, less than 0.000001, less than 0.0000001, less than 0.00000001, or less than 0.000000001. Other tests for significance can be used, for example, a Fisher's exact test. Other statistical tests of significance known to the skilled person are also contemplated and are also within scope of the disclosure.

In some embodiments, the significance of increased or decreased susceptibility can be determined according to the ratio of measurements from a test subject to a reference subject. In one embodiment, losses or gains of one or more CNVs can be determined according to a threshold $\log_2$ ratio determined by these measurements. In some embodiments, a $\log_2$ ratio value greater than 0.35 is indicative of a gain of one or more CNVs. In some embodiments, a $\log_2$ ratio value less than −0.35 is indicative of a loss of one or more CNVs.

In some embodiments, the combined or overall susceptibility associated with a plurality of variants associated with EN can also be assessed, for example, the genetic variations described herein to be associated with susceptibility to EN can be combined with other common genetic risk factors. Combined risk for such genetic variants can be estimated in an analogous fashion to the methods described herein.

Calculating risk conferred by a particular genotype for the individual can be based on comparing the genotype of the individual to previously determined risk expressed, for example, as a relative risk (RR) or an odds ratio (OR), for the genotype, for example, for a heterozygous carrier of an at-risk variant for EN. An odds ratio can be a statistical measure used as a metric of causality. For example, in genetic disease research it can be used to convey the significance of a variant in a disease cohort relative to an unaffected/normal cohort. The calculated risk for the individual can be the relative risk for a subject, or for a specific genotype of a subject, compared to the average population. The average population risk can be expressed as a weighted average of the risks of different genotypes, using results from a reference population, and the appropriate calculations to calculate the risk of a genotype group relative to the population can then be performed. Alternatively, the risk for an individual can be based on a comparison of particular genotypes, for example, heterozygous carriers of an at-risk allele of a marker compared with non-carriers of the at-risk allele. Using the population average can, in certain embodiments, be more convenient, since it provides a measure which can be easy to interpret for the user, for example, a measure that gives the risk for the individual, based on his/her genotype, compared with the average in the population.

In certain embodiments of the disclosure, a genetic variation is correlated to EN by referencing genetic variation data to a look-up table that comprises correlations between the genetic variation and EN. The genetic variation in certain embodiments comprises at least one indication of the genetic variation. In some embodiments, the table comprises a correlation for one genetic variation. In other embodiments, the table comprises a correlation for a plurality of genetic variations. In both scenarios, by referencing to a look-up table that gives an indication of a correlation between a genetic variation and EN, a risk for EN, or a susceptibility to EN, can be identified in the individual from whom the sample is derived.

The screening applications of EN-associated genetic variations, as described herein, can, for example, be performed by an individual, a health professional, or a third party, for example, a service provider who interprets genotype information from the subject.

A medical professional can initiate or modify treatment after receiving information regarding a subject's screening for EN, for example. In some embodiments, a medical professional can recommend a change in therapy. In some embodiments, a medical professional can enroll a subject in a clinical trial for, by way of example, detecting correlations between a haplotype as described herein and any measurable or quantifiable parameter relating to the outcome of the treatment as described above.

Also provided herein are databases that include a list of genetic variations as described herein, and wherein the list can be largely or entirely limited to genetic variations identified as useful for screening EN as described herein. The list can be stored, for example, on a flat file or computer-readable medium. The databases can further include information regarding one or more subjects, for example, whether a subject is affected or unaffected, clinical information such as endophenotype, age of onset of symptoms, any treatments administered and outcomes, for example, data relevant to pharmacogenomics, diagnostics, prognostics or theranostics, and other details, for example, data about the disorder in the subject, or environmental or other genetic factors. The databases can be used to detect correlations between a particular haplotype and the information regarding the subject.

The methods described herein can also include the generation of reports for use, for example, by a subject, care giver, or researcher, that include information regarding a subject's genetic variations, and optionally further information such as treatments administered, treatment history, medical history, predicted response, and actual response. The reports can be recorded in a tangible medium, e.g., a computer-readable disk, a solid state memory device, or an optical storage device.

Methods of Screening Using Variations in Polypeptides and/or RNA

In some embodiments of the disclosure, screening of EN can be made by examining or comparing changes in expression, localization, binding partners, and composition of a polypeptide encoded by a nucleic acid associated with EN, for example, in those instances where the genetic variations of the present disclosure results in a change in the composition or expression of the polypeptide and/or RNA, for example, mRNAs, miRNAs, and other noncoding RNAs (ncRNAs). Thus, screening of EN can be made by examining expression and/or composition of one of these polypeptides and/or RNA, or another polypeptide and/or RNA encoded by a nucleic acid associated with EN, in those instances where the genetic variation of the present disclosure results in a change in the expression, localization, binding partners, and/or composition of the polypeptide and/or RNA. In some embodiments, screening can comprise diagnosing a subject. In some embodiments, screening can comprise determining a prognosis of a subject, for example, determining the susceptibility of developing EN. In some embodiments, screening can comprise theranosing a subject.

The genetic variations described herein that show association to EN can play a role through their effect on one or more of these nearby genes. For example, while not intending to be limited by theory, it is generally expected that a deletion of a chromosomal segment comprising a particular gene, or a fragment of a gene, can either result in an altered composition or expression, or both, of the encoded protein and/or mRNA. Likewise, duplications, or high number copy number variations, are in general expected to result in increased expression of encoded polypeptide and/or RNA if the duplication encompasses the whole gene. It is also known to those skilled in the art that segments of DNA can be duplicated, triplicated, quadruplicated, or amplified many times and result in increasingly higher levels of expression of the gene if it is encompassed by these multiplicated segments of DNA. Those skilled in the art also know that one or both breakpoints of a duplication or other level of amplification can disrupt a gene and thus result in loss of function, such as the expressed protein encoded by the transcript is truncated. Further, those skilled in the art anticipate that an amplified segment of DNA can occur in tandem (e.g., multiple gene copies adjacent to each other on the chromosome) or can insert into a site far away from the original chromosomal location or even on another chromosome. Thus, in some cases a gene not contained within the amplified segment of DNA is impacted by the chromosomal rearrangement. Such complex rearrangements can be mapped, for example, by fluorescence in situ hybridization (FISH) methods. Other possible mechanisms affecting genes within or near a genetic variation region include, for example, effects on transcription, effects on RNA splicing, alterations in relative amounts of alternative splice forms of mRNA, effects on RNA stability, effects on transport from the nucleus to cytoplasm, and effects on the efficiency and accuracy of translation. Thus, DNA variations can be detected directly, using the subjects unamplified or amplified genomic DNA, or indirectly, using RNA or DNA obtained from the subject's tissue(s) that are present in an aberrant form or expression level as a result of the genetic variations of the disclosure showing association to EN.

In some embodiments, the genetic variations of the disclosure showing association to EN can affect the expression of a gene within the genetic variation region. Certain genetic variation regions can have flanking duplicated segments, and genes within such segments can have altered expression and/or composition as a result of such genomic alterations. It is also well known that regulatory elements affecting gene expression can be located far away, even as far as tens or hundreds of kilobases away, from the promoter region of a gene. Thus, regulatory elements for genes that are located outside the genetic variation region can be located within the genetic variation, and thus affect the expression of genes located outside the genetic variation. It is thus contemplated that the detection of the genetic variations described herein, can be used for assessing expression for one or more of associated genes.

In some embodiments, genetic variations of the disclosure showing association to EN can affect protein expression at the translational level. It can be appreciated by those skilled in the art that this can occur by increased or decreased expression of one or more microRNAs (miRNAs) that regulates expression of a protein known to be important, or implicated, in the cause, onset, or progression of EN. Increased or decreased expression of the one or more miRNAs can result from gain or loss of the whole miRNA gene, disruption of a portion of the gene (e.g., by an indel or CNV), or even a single base change (SNP or SNV) that produces an altered, non-functional or aberrant functioning miRNA sequence. It can also be appreciated by those skilled in the art that the expression of protein, for example, one known to cause EN by increased or decreased expression, can result due to a genetic variation that results in alteration of an existing miRNA binding site within the protein's mRNA transcript, or even creates a new miRNA binding site that leads to aberrant protein expression.

A variety of methods can be used for detecting protein composition and/or expression levels, including but not limited to enzyme linked immunosorbent assays (ELISA), Western blots, spectroscopy, mass spectrometry, peptide arrays, colorimetry, electrophoresis, isoelectric focusing, immunoprecipitations, immunoassays, and immunofluorescence and other methods well-known in the art. A test sample from a subject can be assessed for the presence of an alteration in the expression and/or an alteration in composition of the polypeptide encoded by a nucleic acid associated with EN. An "alteration" in the polypeptide expression or composition, as used herein, refers to an alteration in expression or composition in a test sample, as compared to the expression or composition of the polypeptide in a control sample. Such alteration can, for example, be an alteration in the quantitative polypeptide expression or can be an alteration in the qualitative polypeptide expression, for example, expression of a mutant polypeptide or of a different splicing variant, or a combination thereof. In some embodiments, screening for EN can be made by detecting a particular splicing variant encoded by a nucleic acid associated with EN, or a particular pattern of splicing variants.

Antibodies can be polyclonal or monoclonal and can be labeled or unlabeled. An intact antibody or a fragment thereof can be used. The term "labeled", with regard to the probe or antibody, is intended to encompass direct labeling of the probe or antibody by coupling a detectable substance to the probe or antibody, as well as indirect labeling of the probe or antibody by reactivity with another reagent that is directly labeled as previously described herein. Other non-limiting examples of indirect labeling include detection of a primary antibody using a labeled secondary antibody, for example, a fluorescently-labeled secondary antibody and end-labeling of a DNA probe with biotin such that it can be detected with fluorescently-labeled streptavidin.

Detecting Genetic Variations Associated with Endometriosis

Described herein, are methods that can be used to detect genetic variations. Detecting specific genetic variations, for example, polymorphic markers and/or haplotypes, copy number, absence or presence of an allele, or genotype associated with EN as described herein, can be accomplished by methods known in the art for analyzing nucleic acids and/or detecting sequences at polymorphic or genetically variable sites, for example, amplification techniques, hybridization techniques, sequencing, arrays, or any combination thereof. Thus, by use of these methods disclosed herein or other methods available to the person skilled in the art, one or more alleles at polymorphic markers, including microsatellites, SNPs, CNVs, or other types of genetic variations, can be identified in a sample obtained from a subject.

Nucleic Acids

The nucleic acids and polypeptides described herein can be used in methods and kits of the present disclosure. In some embodiments, aptamers that specifically bind the nucleic acids and polypeptides described herein can be used in methods and kits of the present disclosure. As used herein, a nucleic acid can comprise a deoxyribonucleotide (DNA) or ribonucleotide (RNA), whether singular or in polymers, naturally occurring or non-naturally occurring, double-stranded or single-stranded, coding, for example, a translated gene, or non-coding, for example, a regulatory region, or any fragments, derivatives, mimetics or complements thereof. In some embodiments, nucleic acids can comprise oligonucleotides, nucleotides, polynucleotides, nucleic acid sequences, genomic sequences, antisense nucleic acids, DNA regions, probes, primers, genes, regulatory regions, introns, exons, open-reading frames, binding sites, target nucleic acids and allele-specific nucleic acids.

"Isolated" nucleic acids, as used herein, are separated from nucleic acids that normally flank the gene or nucleotide sequence (as in genomic sequences) and/or has been completely or partially purified from other transcribed sequences (e.g., as in an RNA library). For example, isolated nucleic acids of the disclosure can be substantially isolated with respect to the complex cellular milieu in which it naturally occurs, or culture medium when produced by recombinant techniques, or chemical precursors or other chemicals when chemically synthesized. In some instances, the isolated material can form part of a composition, for example, a crude extract containing other substances, buffer system or reagent mix. In some embodiments, the material can be purified to essential homogeneity using methods known in the art, for example, by polyacrylamide gel electrophoresis (PAGE) or column chromatography (e.g., HPLC). With regard to genomic DNA (gDNA), the term "isolated" also can refer to nucleic acids that are separated from the chromosome with which the genomic DNA is naturally associated. For example, the isolated nucleic acid molecule can contain less than about 250 kb, 200 kb, 150 kb, 100 kb, 75 kb, 50 kb, 25 kb, 10 kb, 5 kb, 4 kb, 3 kb, 2 kb, 1 kb, 0.5 kb or 0.1 kb of the nucleotides that flank the nucleic acid molecule in the gDNA of the cell from which the nucleic acid molecule is derived.

Nucleic acids can be fused to other coding or regulatory sequences can be considered isolated. For example, recombinant DNA contained in a vector is included in the definition of "isolated" as used herein. In some embodiments, isolated nucleic acids can include recombinant DNA molecules in heterologous host cells or heterologous organisms, as well as partially or substantially purified DNA molecules in solution. Isolated nucleic acids also encompass in vivo and in vitro RNA transcripts of the DNA molecules of the present disclosure. An isolated nucleic acid molecule or nucleotide sequence can be synthesized chemically or by recombinant means. Such isolated nucleotide sequences can be useful, for example, in the manufacture of the encoded polypeptide, as probes for isolating homologous sequences (e.g., from other mammalian species), for gene mapping (e.g., by in situ hybridization with chromosomes), or for detecting expression of the gene, in tissue (e.g., human tissue), such as by Northern blot analysis or other hybridization techniques disclosed herein. The disclosure also pertains to nucleic acid sequences that hybridize under high stringency hybridization conditions, such as for selective hybridization, to a nucleotide sequence described herein Such nucleic acid sequences can be detected and/or isolated by allele- or sequence-specific hybridization (e.g., under high stringency conditions). Stringency conditions and methods for nucleic acid hybridizations are well known to the skilled person (see, e.g., Current Protocols in Molecular Biology, Ausubel, F. et al., John Wiley & Sons, (1998), and Kraus, M. and Aaronson, S., Methods Enzymol, 200:546-556 (1991), the entire teachings of which are incorporated by reference herein.

Calculations of "identity" or "percent identity" between two or more nucleotide or amino acid sequences can be determined by aligning the sequences for optimal comparison purposes (e.g., gaps can be introduced in the sequence of a first sequence). The nucleotides at corresponding positions are then compared, and the percent identity between the two sequences is a function of the number of identical positions shared by the sequences (i.e., % identity=# of identical positions/total # of positions×100). For example, a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences.

In some embodiments, the length of a sequence aligned for comparison purposes is at least 30%, at least 40%, at least 50%, at least 60%, at least 70%, at least 80%, at least 90%, or at least 95%, of the length of the reference sequence. The actual comparison of the two sequences can be accomplished by well-known methods, for example, using a mathematical algorithm. A non-limiting example of such a mathematical algorithm is described in Karlin, and Altschul, *Proc. Natl. Acad. Sci. USA,* 90:5873 (1993). Such an algorithm is incorporated into the NBLAST and XBLAST programs (version 2.0), as described in Altschul et al., *Nucleic Acids Res.,* 25:3389 (1997). When utilizing BLAST and Gapped BLAST programs, any relevant parameters of the respective programs (e.g., NBLAST) can be used. For example, parameters for sequence comparison can be set at score=100, word length=12, or can be varied (e.g., W=5 or W=20). Other examples include the algorithm of Myers and Miller, CABIOS (1989), ADVANCE, ADAM, BLAT, and FASTA. In some embodiments, the percent identity between two amino acid sequences can be accomplished using, for example, the GAP program in the GCG software package (Accelrys, Cambridge, UK).

"Probes" or "primers" can be oligonucleotides that hybridize in a base-specific manner to a complementary strand of a nucleic acid molecule. Probes can include primers, which can be a single-stranded oligonucleotide probe that can act as a point of initiation of template-directed DNA synthesis using methods including but not limited to, polymerase chain reaction (PCR) and ligase chain reaction (LCR) for amplification of a target sequence. It can be appreciated by those skilled in the art that probes for detection of amplified or unamplified nucleic acid molecules can also include an Invader oligonucleotide and probe pair. Oligonucleotides, as described herein, can include segments or fragments of nucleic acid sequences, or their complements. In some embodiments, DNA segments can be between 5 and 10,000 contiguous bases, and can range from 5, 10, 12, 15, 20, or 25 nucleotides to 10, 15, 20, 25, 30, 40, 50, 100, 200, 500, 1000 or 10,000 nucleotides. In addition to DNA and RNA, probes and primers can include polypeptide nucleic acids (PNA), as described in Nielsen, P. et al., Science 254: 1497-1500 (1991). A probe or primer can comprise a region of nucleotide sequence that hybridizes to at least about 15, typically about 20-25, and in certain embodiments about 40, 50 or 75, consecutive nucleotides of a nucleic acid molecule.

The present disclosure also provides isolated nucleic acids, for example, probes or primers, that contain a fragment or portion that can selectively hybridize to a nucleic acid that comprises, or consists of, a nucleotide sequence, wherein the nucleotide sequence can comprise at least one polymorphism or polymorphic allele contained in the genetic variations described herein or the wild-type nucleotide that is located at the same position, or the compliments thereof. In some embodiments, the probe or primer can be at least 70% identical, at least 80% identical, at least 85% identical, at least 90% identical, or at least 95% identical, to the contiguous nucleotide sequence or to the complement of the contiguous nucleotide sequence.

In one embodiment, a nucleic acid probe can be an oligonucleotide capable of hybridizing with a complementary region of a gene associated with EN containing a genetic variation described herein. The nucleic acid fragments of the disclosure can be used as probes or primers in assays such as those described herein.

The nucleic acids of the disclosure, such as those described above, can be identified and isolated using standard molecular biology techniques well known to the skilled person. In some embodiments, DNA can be amplified and/or can be labeled (e.g., radiolabeled, fluorescently labeled) and used as a probe for screening, for example, a cDNA library derived from an organism. cDNA can be derived from mRNA and can be contained in a suitable vector. For example, corresponding clones can be isolated, DNA obtained following in vivo excision, and the cloned insert can be sequenced in either or both orientations by art-recognized methods to identify the correct reading frame encoding a polypeptide of the appropriate molecular weight. Using these or similar methods, the polypeptide and the DNA encoding the polypeptide can be isolated, sequenced and further characterized.

In some embodiments, nucleic acid can comprise one or more polymorphisms, variations, or mutations, for example, single nucleotide polymorphisms (SNPs), copy number variations (CNVs), for example, insertions, deletions, inversions, and translocations. In some embodiments, nucleic acids can comprise analogs, for example, phosphorothioates, phosphoramidates, methyl phosphonate, chiral methyl phosphonates, 2-0-methyl ribonucleotides, or modified nucleic acids, for example, modified backbone residues or linkages, or nucleic acids combined with carbohydrates, lipids, protein or other materials, or peptide nucleic acids (PNAs), for example, chromatin, ribosomes, and transcriptosomes. In some embodiments nucleic acids can comprise nucleic acids in various structures, for example, A DNA, B DNA, Z-form DNA, siRNA, tRNA, and ribozymes. In some embodiments, the nucleic acid may be naturally or non-naturally polymorphic, for example, having one or more sequence differences, for example, additions, deletions and/or substitutions, as compared to a reference sequence. In some embodiments, a reference sequence can be based on publicly available information, for example, the U.C. Santa Cruz Human Genome Browser Gateway (genome.ucsc.edu/cgi-bin/hg-Gateway) or the NCBI website (www.ncbi.nlm.nih.gov). In some embodiments, a reference sequence can be determined by a practitioner of the present disclosure using methods well known in the art, for example, by sequencing a reference nucleic acid.

In some embodiments, a probe can hybridize to an allele, SNP, or CNV as described herein. In some embodiments, the probe can bind to another marker sequence associated with EN as described herein.

One of skill in the art would know how to design a probe so that sequence specific hybridization can occur only if a particular allele is present in a genomic sequence from a test sample. The disclosure can also be reduced to practice using any convenient genotyping method, including commercially available technologies and methods for genotyping particular genetic variations Control probes can also be used, for example, a probe that binds a less variable sequence, for example, a repetitive DNA associated with a centromere of a chromosome, can be used as a control. In some embodiments, probes can be obtained from commercial sources. In some embodiments, probes can be synthesized, for example, chemically or in vitro, or made from chromosomal or genomic DNA through standard techniques. In some embodiments sources of DNA that can be used include genomic DNA, cloned DNA sequences, somatic cell hybrids that contain one, or a part of one, human chromosome along with the normal chromosome complement of the host, and chromosomes purified by flow cytometry or microdissection. The region of interest can be isolated through cloning, or by site-specific amplification using PCR.

One or more nucleic acids for example, a probe or primer, can also be labeled, for example, by direct labeling, to comprise a detectable label. A detectable label can comprise any label capable of detection by a physical, chemical, or a biological process for example, a radioactive label, such as $^{32}P$ or $^{3}H$, a fluorescent label, such as FITC, a chromophore label, an affinity-ligand label, an enzyme label, such as alkaline phosphatase, horseradish peroxidase, or 12 galactosidase, an enzyme cofactor label, a hapten conjugate label, such as digoxigenin or dinitrophenyl, a Raman signal generating label, a magnetic label, a spin label, an epitope label, such as the FLAG or HA epitope, a luminescent label, a heavy atom label, a nanoparticle label, an electrochemical label, a light scattering label, a spherical shell label, semiconductor nanocrystal label, such as quantum dots (described in U.S. Pat. No. 6,207,392), and probes labeled with any other signal generating label known to those of skill in the art, wherein a label can allow the probe to be visualized with or without a secondary detection molecule. A nucleotide can be directly incorporated into a probe with standard techniques, for example, nick translation, random priming, and PCR labeling.

Non-limiting examples of label moieties useful for detection include, without limitation, suitable enzymes such as horseradish peroxidase, alkaline phosphatase, beta-galactosidase, or acetylcholinesterase; members of a binding pair that are capable of forming complexes such as streptavidin/biotin, avidin/biotin or an antigen/antibody complex including, for example, rabbit IgG and anti-rabbit IgG; fluorophores such as umbelliferone, fluorescein, fluorescein isothiocyanate, rhodamine, tetramethyl rhodamine, eosin, green fluorescent protein, erythrosin, coumarin, methyl coumarin, pyrene, malachite green, stilbene, lucifer yellow, Cascade Blue, Texas Red, dichlorotriazinylamine fluorescein, dansyl chloride, phycoerythrin, fluorescent lanthanide complexes such as those including Europium and Terbium, cyanine dye family members, such as Cy3 and Cy5, molecular beacons and fluorescent derivatives thereof, as well as others known in the art as described, for example, in Principles of Fluorescence Spectroscopy, Joseph R. Lakowicz (Editor), Plenum Pub Corp, 2nd edition (July 1999) and the 6th Edition of the Molecular Probes Handbook by Richard P. Hoagland; a luminescent material such as luminol; light scattering or plasmon resonant materials such as gold or silver particles or quantum dots; or radioactive material include $^{14}C$, $^{123}I$, $^{124}I$, $^{125}I$, Tc99m, $^{32}P$, $^{33}P$, $^{35}S$ or $^{3}H$.

Other labels can also be used in the methods of the present disclosure, for example, backbone labels. Backbone labels comprise nucleic acid stains that bind nucleic acids in a sequence independent manner. Non-limiting examples include intercalating dyes such as phenanthridines and acridines (e.g., ethidium bromide, propidium iodide, hexidium iodide, dihydroethidium, ethidium homodimer-1 and -2, ethidium monoazide, and ACMA); some minor grove binders such as indoles and imidazoles (e.g., Hoechst 33258, Hoechst 33342, Hoechst 34580 and DAPI); and miscellaneous nucleic acid stains such as acridine orange (also capable of intercalating), 7-AAD, actinomycin D, LDS751, and hydroxystilbamidine. All of the aforementioned nucleic acid stains are commercially available from suppliers such as Molecular Probes, Inc. Still other examples of nucleic acid stains include the following dyes from Molecular Probes: cyanine dyes such as SYTOX Blue, SYTOX Green, SYTOX Orange, POPO-1, POPO-3, YOYO-1, YOYO-3, TOTO-1, TOTO-3, JOJO-1, LOLO-1, BOBO-1, BOBO-3, PO-PRO-1, PO-PRO-3, BO-PRO-1, BO-PRO-3, TO-PRO-1, TO-PRO-3, TO-PRO-5, JO-PRO-1, LO-PRO-1, YO-PRO-1, YO-PRO-3, PicoGreen, OliGreen, RiboGreen, SYBR Gold, SYBR Green I, SYBR Green II, SYBR DX, SYTO-40, -41, -42, -43, -44, -45 (blue), SYTO-13, -16, -24, -21, -23, -12, -11, -20, -22, -15, -14, -25 (green), SYTO-81, -80, -82, -83, -84, -85 (orange), SYTO-64, -17, -59, -61, -62, -60, -63 (red).

In some embodiments, fluorophores of different colors can be chosen, for example, 7-amino-4-methylcoumarin-3-acetic acid (AMCA), 5-(and -6)-carboxy-X-rhodamine, lissamine rhodamine B, 5-(and -6)-carboxyfluorescein, fluorescein-5-isothiocyanate (FITC), 7-diethylaminocoumarin-3-carboxylic acid, tetramethylrhodamine-5-(and -6)-isothiocyanate, 5-(and -6)-carboxytetramethylrhodamine, 7-hydroxycoumarin-3-carboxylic acid, 6-[fluorescein 5-(and -6)-carboxamido]hexanoic acid, N-(4,4-difluoro-5,7-dimethyl-4-bora-3a,4a diaza-3-indacenepropionic acid, eosin-5-isothiocyanate, erythrosin-5-isothiocyanate, TRITC, rhodamine, tetramethylrhodamine, R-phycoerythrin, Cy-3, Cy-5, Cy-7, Texas Red, Phar-Red, allophycocyanin (APC), and CASCADE blue acetylazide, such that each probe in or not in a set can be distinctly visualized. In some embodiments, fluorescently labeled probes can be viewed with a fluorescence microscope and an appropriate filter for each fluorophore, or by using dual or triple band-pass filter sets to observe multiple fluorophores. In some embodiments, techniques such as flow cytometry can be used to examine the hybridization pattern of the probes.

In other embodiments, the probes can be indirectly labeled, for example, with biotin or digoxygenin, or labeled with radioactive isotopes such as $^{32}$P and/or $^3$H. As a non-limiting example, a probe indirectly labeled with biotin can be detected by avidin conjugated to a detectable marker. For example, avidin can be conjugated to an enzymatic marker such as alkaline phosphatase or horseradish peroxidase. In some embodiments, enzymatic markers can be detected using colorimetric reactions using a substrate and/or a catalyst for the enzyme. In some embodiments, catalysts for alkaline phosphatase can be used, for example, 5-bromo-4-chloro-3-indolylphosphate and nitro blue tetrazolium. In some embodiments, a catalyst can be used for horseradish peroxidase, for example, diaminobenzoate.

Methods of Detecting Genetic Variations

In some embodiments, standard techniques for genotyping for the presence genetic variations, for example, amplification, can be used. Amplification of nucleic acids can be accomplished using methods known in the art. Generally, sequence information from the region of interest can be used to design oligonucleotide primers that can be identical or similar in sequence to opposite strands of a template to be amplified. In some embodiments, amplification methods can include but are not limited to, fluorescence-based techniques utilizing PCR, for example, ligase chain reaction (LCR), Nested PCR, transcription amplification, self-sustained sequence replication, nucleic acid based sequence amplification (NASBA), and multiplex ligation-dependent probe amplification (MLPA). Guidelines for selecting primers for PCR amplification are well known in the art. In some embodiments, a computer program can be used to design primers, for example, Oligo (National Biosciences, Inc., Plymouth Minn.), MacVector (Kodak/IBI), and GCG suite of sequence analysis programs.

In some embodiments, commercial methodologies available for genotyping, for example, SNP genotyping, can be used, but are not limited to, TaqMan genotyping assays (Applied Biosystems), SNPlex platforms (Applied Biosystems), gel electrophoresis, capillary electrophoresis, size exclusion chromatography, mass spectrometry, for example, MassARRAY system (Sequenom), minisequencing methods, real-time Polymerase Chain Reaction (PCR), Bio-Plex system (BioRad), CEQ and SNPstream systems (Beckman), array hybridization technology, for example, Affymetrix GeneChip (Perlegen), BeadArray Technologies, for example, Illumina GoldenGate and Infinium assays, array tag technology, Multiplex Ligation-dependent Probe Amplification (MLPA), and endonuclease-based fluorescence hybridization technology (Invader; Third Wave/Hologic). PCR can be a procedure in which target nucleic acid is amplified in a manner similar to that described in U.S. Pat. No. 4,683,195 and subsequent modifications of the procedure described therein. In some embodiments, real-time quantitative PCR can be used to determine genetic variations, wherein quantitative PCR can permit both detection and quantification of a DNA sequence in a sample, for example, as an absolute number of copies or as a relative amount when normalized to DNA input or other normalizing genes. In some embodiments, methods of quantification can include the use of fluorescent dyes that can intercalate with double-stranded DNA, and modified DNA oligonucleotide probes that can fluoresce when hybridized with a complementary DNA.

In some embodiments of the disclosure, a sample containing genomic DNA obtained from the subject can be collected and PCR can used to amplify a fragment of nucleic acid that comprises one or more genetic variations that can be indicative of a susceptibility to EN. In some embodiments, detection of genetic variations can be accomplished by expression analysis, for example, by using quantitative PCR. In some embodiments, this technique can assess the presence of an alteration in the expression or composition of one or more polypeptides or splicing variants encoded by a nucleic acid associated with EN.

In one embodiment, the DNA template of a sample from a subject containing a SNP can be amplified by PCR prior to detection with a probe. In such an embodiment, the amplified DNA serves as the template for a detection probe and, in some embodiments, an enhancer probe. Certain embodiments of the detection probe, the enhancer probe, and/or the primers used for amplification of the template by PCR can comprise the use of modified bases, for example, modified A, T, C, G, and U, wherein the use of modified bases can be useful for adjusting the melting temperature of the nucleotide probe and/or primer to the template DNA. In one embodiment, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In some embodiments, identification of genetic variations can be accomplished using hybridization methods. The presence of a specific marker allele or a particular genomic segment comprising a genetic variation, or representative of a genetic variation, can be indicated by sequence-specific hybridization of a nucleic acid probe specific for the particular allele or the genetic variation in a nucleic acid containing sample that has or has not been amplified but methods described herein. The presence of more than one specific marker allele or several genetic variations can be indicated by using two or more sequence-specific nucleic acid probes, wherein each is specific for a particular allele and/or genetic variation.

Hybridization can be performed by methods well known to the person skilled in the art, for example, hybridization techniques such as fluorescent in situ hybridization (FISH), Southern analysis, Northern analysis, or in situ hybridization. In some embodiments, hybridization refers to specific hybridization, wherein hybridization can be performed with no mismatches. Specific hybridization, if present, can be using standard methods. In some embodiments, if specific hybridization occurs between a nucleic acid probe and the nucleic acid in the sample, the sample can contain a sequence that can be complementary to a nucleotide present in the nucleic acid probe. In some embodiments, if a nucleic acid probe can contain a particular allele of a polymorphic marker, or particular alleles for a plurality of markers, specific hybridization is indicative of the nucleic acid being completely complementary to the nucleic acid probe, including the particular alleles at polymorphic markers within the probe. In some embodiments a probe can contain more than one marker allele of a particular haplotype, for example, a probe can contain alleles complementary to 2, 3, 4, 5 or all of the markers that make up a particular haplotype. In some embodiments detection of one or more particular markers of the haplotype in the sample is indicative that the source of the sample has the particular haplotype.

In some embodiments, PCR conditions and primers can be developed that amplify a product only when the variant allele is present or only when the wild type allele is present, for example, allele-specific PCR. In some embodiments of allele-specific PCR, a method utilizing a detection oligonucleotide probe comprising a fluorescent moiety or group at its 3' terminus and a quencher at its 5' terminus, and an enhancer oligonucleotide, can be employed, as described by Kutyavin et al. (*Nucleic Acid Res.*, 34:e128 (2006)).

An allele-specific primer/probe can be an oligonucleotide that is specific for particular a polymorphism can be prepared using standard methods. In some embodiments, allele-specific oligonucleotide probes can specifically hybridize to a nucleic acid region that contains a genetic variation. In some embodiments, hybridization conditions can be selected such that a nucleic acid probe can specifically bind to the sequence of interest, for example, the variant nucleic acid sequence.

In some embodiments, allele-specific restriction digest analysis can be used to detect the existence of a polymorphic variant of a polymorphism, if alternate polymorphic variants of the polymorphism can result in the creation or elimination of a restriction site. Allele-specific restriction digests can be performed, for example, with the particular restriction enzyme that can differentiate the alleles. In some embodiments, PCR can be used to amplify a region comprising the polymorphic site, and restriction fragment length polymorphism analysis can be conducted. In some embodiments, for sequence variants that do not alter a common restriction site, mutagenic primers can be designed that can introduce one or more restriction sites when the variant allele is present or when the wild type allele is present.

In some embodiments, fluorescence polarization template-directed dye-terminator incorporation (FP-TDI) can be used to determine which of multiple polymorphic variants of a polymorphism can be present in a subject. Unlike the use of allele-specific probes or primers, this method can employ primers that can terminate adjacent to a polymorphic site, so that extension of the primer by a single nucleotide can result in incorporation of a nucleotide complementary to the polymorphic variant at the polymorphic site.

In some embodiments, DNA containing an amplified portion can be dot-blotted, using standard methods and the blot contacted with the oligonucleotide probe. The presence of specific hybridization of the probe to the DNA can then be detected. The methods can include determining the genotype of a subject with respect to both copies of the polymorphic site present in the genome, wherein if multiple polymorphic variants exist at a site, this can be appropriately indicated by specifying which variants are present in a subject. Any of the detection means described herein can be used to determine the genotype of a subject with respect to one or both copies of the polymorphism present in the subject's genome.

In some embodiments, a peptide nucleic acid (PNA) probe can be used in addition to, or instead of, a nucleic acid probe in the methods described herein. A PNA can be a DNA mimic having a peptide-like, inorganic backbone, for example, N-(2-aminoethyl) glycine units with an organic base (A, G, C, T or U) attached to the glycine nitrogen via a methylene carbonyl linker.

Nucleic acid sequence analysis can also be used to detect genetic variations, for example, genetic variations can be detected by sequencing exons, introns, 5' untranslated sequences, or 3' untranslated sequences. One or more methods of nucleic acid analysis that are available to those skilled in the art can be used to detect genetic variations, including but not limited to, direct manual sequencing, automated fluorescent sequencing, single-stranded conformation polymorphism assays (SSCP); clamped denaturing gel electrophoresis (CDGE); denaturing gradient gel electrophoresis (DGGE), two-dimensional gel electrophoresis (2DGE or TDGE); conformational sensitive gel electrophoresis (CSGE); denaturing high performance liquid chromatography (DHPLC), infrared matrix-assisted laser desorption/ ionization (IR-MALDI) mass spectrometry, mobility shift analysis, quantitative real-time PCR, restriction enzyme analysis, heteroduplex analysis; chemical mismatch cleavage (CMC), RNase protection assays, use of polypeptides that recognize nucleotide mismatches, allele-specific PCR, real-time pyrophosphate DNA sequencing, PCR amplification in combination with denaturing high performance liquid chromatography (dHPLC), and combinations of such methods.

Sequencing can be accomplished through classic Sanger sequencing methods, which are known in the art. In one embodiment sequencing can be performed using high-throughput sequencing methods some of which allow detection of a sequenced nucleotide immediately after or upon its incorporation into a growing strand, for example, detection of sequence in substantially real time or real time. In some cases, high throughput sequencing generates at least 1,000, at least 5,000, at least 10,000, at least 20,000, at least 30,000, at least 40,000, at least 50,000, at least 100,000 or at least 500,000 sequence reads per hour; with each read being at least 50, at least 60, at least 70, at least 80, at least 90, at least 100, at least 120 or at least 150 bases per read (or 500-1,000 bases per read for 454).

High-throughput sequencing methods can include but are not limited to, Massively Parallel Signature Sequencing (MPSS, Lynx Therapeutics), Polony sequencing, 454 pyrosequencing, Illumina (Solexa) sequencing, SOLID sequencing, on semiconductor sequencing, DNA nanoball sequencing, Helloscope™ single molecule sequencing, Single Molecule SMRT™ sequencing, Single Molecule real time (RNAP) sequencing, Nanopore DNA sequencing, and/or sequencing by hybridization, for example, a non-enzymatic method that uses a DNA microarray, or microfluidic Sanger sequencing.

In some embodiments, high-throughput sequencing can involve the use of technology available by Helicos BioSciences Corporation (Cambridge, Mass.) such as the Single Molecule Sequencing by Synthesis (SMSS) method. SMSS is unique because it allows for sequencing the entire human genome in up to 24 hours. This fast sequencing method also allows for detection of a SNP/nucleotide in a sequence in substantially real time or real time. Finally, SMSS is powerful because, like the MIP technology, it does not use a pre-amplification step prior to hybridization. SMSS does not use any amplification. SMSS is described in US Publication Application Nos. 20060024711; 20060024678; 20060012793; 20060012784; and 20050100932. In some embodiments, high-throughput sequencing involves the use of technology available by 454 Life Sciences, Inc. (a Roche company, Branford, Conn.) such as the PicoTiterPlate device which includes a fiber optic plate that transmits chemiluminescent signal generated by the sequencing reaction to be recorded by a CCD camera in the instrument. This use of fiber optics allows for the detection of a minimum of 20 million base pairs in 4.5 hours.

In some embodiments, PCR-amplified single-strand nucleic acid can be hybridized to a primer and incubated with a polymerase, ATP sulfurylase, luciferase, apyrase, and the substrates luciferin and adenosine 5' phosphosulfate. Next, deoxynucleotide triphosphates corresponding to the bases A, C, G, and T (U) can be added sequentially. A base incorporation can be accompanied by release of pyrophosphate, which can be converted to ATP by sulfurylase, which can drive synthesis of oxyluciferin and the release of visible light. Since pyrophosphate release can be equimolar with the number of incorporated bases, the light given off can be proportional to the number of nucleotides adding in any one step. The process can repeat until the entire sequence can be determined. In some embodiments, pyrosequencing can be utilized to analyze amplicons to determine whether breakpoints are present. In some embodiments, pyrosequencing can map surrounding sequences as an internal quality control.

Pyrosequencing analysis methods are known in the art. Sequence analysis can include a four-color sequencing by ligation scheme (degenerate ligation), which involves hybridizing an anchor primer to one of four positions. Then an enzymatic ligation reaction of the anchor primer to a population of degenerate nonamers that are labeled with fluorescent dyes can be performed. At any given cycle, the population of nonamers that is used can be structured such that the identity of one of its positions can be correlated with the identity of the fluorophore attached to that nonamer. To the extent that the ligase discriminates for complementarily at that queried position, the fluorescent signal can allow the inference of the identity of the base. After performing the ligation and four-color imaging, the anchor primer: nonamer complexes can be stripped and a new cycle begins. Methods to image sequence information after performing ligation are known in the art.

In some embodiments, analysis by restriction enzyme digestion can be used to detect a particular genetic variation if the genetic variation results in creation or elimination of one or more restriction sites relative to a reference sequence. In some embodiments, restriction fragment length polymorphism (RFLP) analysis can be conducted, wherein the digestion pattern of the relevant DNA fragment indicates the presence or absence of the particular genetic variation in the sample.

In some embodiments, arrays of oligonucleotide probes that can be complementary to target nucleic acid sequence segments from a subject can be used to identify genetic variations. In some embodiments, an array of oligonucleotide probes comprises an oligonucleotide array, for example, a microarray. In some embodiments, the present disclosure features arrays that include a substrate having a plurality of addressable areas, and methods of using them. At least one area of the plurality includes a nucleic acid probe that binds specifically to a sequence comprising a genetic variation, and can be used to detect the absence or presence of the genetic variation, for example, one or more SNPs, microsatellites, or CNVs, as described herein, to determine or identify an allele or genotype. For example, the array can include one or more nucleic acid probes that can be used to detect a genetic variation associated with a gene and/or product of a gene listed in FIG. 3. In some embodiments, the array can further comprise at least one area that includes a nucleic acid probe that can be used to specifically detect another marker associated with EN, as described herein.

Microarray hybridization can be performed by hybridizing a nucleic acid of interest, for example, a nucleic acid encompassing a genetic variation, with the array and detecting hybridization using nucleic acid probes. In some embodiments, the nucleic acid of interest is amplified prior to hybridization. Hybridization and detecting can be carried out according to standard methods described in Published PCT Applications: WO 92/10092 and WO 95/11995, and U.S. Pat. No. 5,424,186. For example, an array can be scanned to determine the position on the array to which the nucleic acid hybridizes. The hybridization data obtained from the scan can be, for example, in the form of fluorescence intensities as a function of location on the array.

Arrays can be formed on substrates fabricated with materials such as paper; glass; plastic, for example, polypropylene, nylon, or polystyrene; polyacrylamide; nitrocellulose; silicon; optical fiber; or any other suitable solid or semisolid support; and can be configured in a planar, for example, glass plates or silicon chips); or three dimensional, for example, pins, fibers, beads, particles, microtiter wells, and capillaries, configuration.

Methods for generating arrays are known in the art and can include for example; photolithographic methods (U.S. Pat. Nos. 5,143,854, 5,510,270 and 5,527,681); mechanical methods, for example, directed-flow methods (U.S. Pat. No. 5,384,261); pin-based methods (U.S. Pat. No. 5,288,514); bead-based techniques (PCT US/93/04145); solid phase oligonucleotide synthesis methods; or by other methods known to a person skilled in the art (see, e.g., Bier et al., *Adv. Biochem. Eng. Biotechnol.,* 109:433-53 (2008); Hoheisel, *Nat. Rev. Genet.,* 7: 200-10 (2006); Fan et al., *Methods Enzymol.,* 410:57-73 (2006); Raqoussis & Elvidge, *Expert Rev. Mol. Design,* 6: 145-52 (2006); Mockler et al., *Genomics,* 85:1-15 (2005), and references cited therein, the entire teachings of each of which are incorporated by reference herein). Many additional descriptions of the preparation and use of oligonucleotide arrays for detection of polymorphisms can be found, for example, in U.S. Pat. Nos. 6,858, 394; 6,429,027; 5,445,934; 5,700,637; 5,744,305; 5,945, 334; 6,054,270; 6,300,063; 6,733,977; 7,364,858, EP 619 321, and EP 373 203, the entire teachings of which are incorporated by reference herein. Methods for array production, hybridization, and analysis are also described in Snijders et al., *Nat. Genetics*, 29:263-264 (2001); Klein et al., *Proc. Natl. Acad. Sci. USA*, 96:4494-4499 (1999); Albertson et al., *Breast Cancer Research and Treatment*, 78:289-298 (2003); and Snijders et al., "BAC microarray based comparative genomic hybridization," in: Zhao et al. (eds), *Bacterial Artificial Chromosomes: Methods and Protocols, Methods in Molecular Biology*, Humana Press, 2002.

In some embodiments, oligonucleotide probes forming an array can be attached to a substrate by any number of techniques, including, but not limited to, in situ synthesis, for example, high-density oligonucleotide arrays, using photolithographic techniques; spotting/printing a medium to low density on glass, nylon, or nitrocellulose; by masking; and by dot-blotting on a nylon or nitrocellulose hybridization membrane. In some embodiments, oligonucleotides can be immobilized via a linker, including but not limited to, by covalent, ionic, or physical linkage. Linkers for immobilizing nucleic acids and polypeptides, including reversible or cleavable linkers, are known in the art (U.S. Pat. No. 5,451,683 and WO98/20019). In some embodiments, oligonucleotides can be non-covalently immobilized on a substrate by hybridization to anchors, by means of magnetic beads, or in a fluid phase, for example, in wells or capillaries.

An array can comprise oligonucleotide hybridization probes capable of specifically hybridizing to different genetic variations. In some embodiments, oligonucleotide arrays can comprise a plurality of different oligonucleotide probes coupled to a surface of a substrate in different known locations. In some embodiments, oligonucleotide probes can exhibit differential or selective binding to polymorphic sites, and can be readily be designed by one of ordinary skill in the art, for example, an oligonucleotide that is perfectly complementary to a sequence that encompasses a polymorphic site, for example, a sequence that includes the polymorphic site, within it, or at one end, can hybridize preferentially to a nucleic acid comprising that sequence, as opposed to a nucleic acid comprising an alternate polymorphic variant.

In some embodiments, arrays can include multiple detection blocks, for example, multiple groups of probes designed for detection of particular polymorphisms. In some embodiments, these arrays can be used to analyze multiple different polymorphisms. In some embodiments, detection blocks can be grouped within a single array or in multiple, separate arrays, wherein varying conditions, for example, conditions optimized for particular polymorphisms, can be used during hybridization. General descriptions of using oligonucleotide arrays for detection of polymorphisms can be found, for example, in U.S. Pat. Nos. 5,858,659 and 5,837,832. In addition to oligonucleotide arrays, cDNA arrays can be used similarly in certain embodiments.

The methods described herein can include but are not limited to providing an array as described herein; contacting the array with a sample, and detecting binding of a nucleic acid from the sample to the array. In some embodiments, the method can comprise amplifying nucleic acid from the sample, for example, a region associated with EN or a region that includes another region associated with EN. In some embodiments, the methods described herein can include using an array that can identify differential expression patterns or copy numbers of one or more genes in samples from control and affected individuals. For example, arrays of probes to a marker described herein can be used to identify genetic variations between DNA from an affected subject, and control DNA obtained from an individual that does not have EN. Since the nucleotides on the array can contain sequence tags, their positions on the array can be accurately known relative to the genomic sequence.

In some embodiments, it can be desirable to employ methods that can detect the presence of multiple genetic variations, for example, polymorphic variants at a plurality of polymorphic sites, in parallel or substantially simultaneously. In some embodiments, these methods can comprise oligonucleotide arrays and other methods, including methods in which reactions, for example, amplification and hybridization, can be performed in individual vessels, for example, within individual wells of a multi-well plate or other vessel.

Determining the identity of a genetic variation can also include or consist of reviewing a subject's medical history, where the medical history includes information regarding the identity, copy number, presence or absence of one or more alleles or SNPs in the subject, e.g., results of a genetic test.

Genetic variations can also be identified using any of a number of methods well known in the art. For example, genetic variations available in public databases, which can be searched using methods and custom algorithms or algorithms known in the art, can be used. In some embodiments, a reference sequence can be from, for example, the human draft genome sequence, publicly available in various databases, or a sequence deposited in a database such as GenBank.

Methods of Detecting CNVs

Detection of genetic variations, specifically CNVs, can be accomplished by one or more suitable techniques described herein. Generally, techniques that can selectively determine whether a particular chromosomal segment is present or absent in an individual can be used for genotyping CNVs. Identification of novel copy number variations can be done by methods for assessing genomic copy number changes.

In some embodiments, methods include but are not limited to, methods that can quantitatively estimate the number of copies of a particular genomic segment, but can also include methods that indicate whether a particular segment is present in a sample or not. In some embodiments, the technique to be used can quantify the amount of segment present, for example, determining whether a DNA segment is deleted, duplicated, or triplicated in subject, for example, Fluorescent In Situ Hybridization (FISH) techniques, and other methods described herein.

In some embodiments, other genotyping technologies can be used for detection of CNVs, including but not limited to, karyotype analysis, Molecular Inversion Probe array technology, for example, Affymetrix SNP Array 6.0, and BeadArray Technologies, for example, Illumina GoldenGate and Infinium assays, as can other platforms such as NimbleGen HD2.1 or HD4.2, High-Definition Comparative Genomic Hybridization (CGH) arrays (Agilent Technologies), tiling array technology (Affymetrix), multiplex ligation-dependent probe amplification (MLPA), Invader assay, qPCR, or fluorescence in situ hybridization. In one embodiment, Array Comparative Genomic Hybridization (aCGH) methods can be used. As described herein, karyotype analysis can be a method to determine the content and structure of chromosomes in a sample. In some embodiments, karyotyping can be used, in lieu of aCGH, to detect translocations, which can be copy number neutral (balanced translocations), and therefore, not detectable by aCGH. Information about amplitude of particular probes, which can be representative of particular alleles, can provide quantitative dosage information for the particular allele, and by consequence, dosage information about the CNV in question, since the marker can be selected as a marker representative of the CNV and can be located within the CNV. In some embodiments, if the CNV is a deletion, the absence of particular marker allele is representative of the deletion. In some embodiments, if the CNV is a duplication or a higher order copy number variation, the signal intensity representative of the allele correlating with the CNV can represent the copy number. A summary of methodologies commonly used is provided in Perkel (*J. Nature Methods,* 5:447-453 (2008)).

PCR assays can be utilized to detect CNVs and can provide an alternative to array analysis. In particular, PCR assays can enable detection of precise boundaries of gene/chromosome variants, at the molecular level, and which boundaries are identical in different individuals. PCR assays can be based on the amplification of a junction fragment present only in individuals that carry a deletion. This assay can convert the detection of a loss by array CGH to one of a gain by PCR.

Examples of PCR techniques that can be used in the present disclosure include, but are not limited to quantitative PCR, real-time quantitative PCR (qPCR), quantitative fluorescent PCR (QF-PCR), multiplex fluorescent PCR (MF-PCR), real time PCR (RT-PCR), single cell PCR, PCR-RFLP/RT-PCR-RFLP, hot start PCR and Nested PCR. Other suitable amplification methods include the ligase chain reaction (LCR), ligation mediated PCR (LM-PCR), degenerate oligonucleotide probe PCR (DOP-PCR), transcription amplification, self-sustained sequence replication, selective amplification of target polynucleotide sequences, consensus sequence primed polymerase chain reaction (CP-PCR), arbitrarily primed polymerase chain reaction (AP-PCR) and nucleic acid based sequence amplification (NABSA).

Alternative methods for the simultaneous interrogation of multiple regions include quantitative multiplex PCR of short fluorescent fragments (QMPSF), multiplex amplifiable probe hybridization (MAPH) and multiplex ligation-dependent probe amplification (MLPA), in which copy-number differences for up to 40 regions can be scored in one experiment. Another approach can be to specifically target regions that harbor known segmental duplications, which are often sites of copy-number variation. By targeting the variable nucleotides between two copies of a segmental duplication (called paralogous sequence variants) using a SNP-genotyping method that provides independent fluorescence intensities for the two alleles, it is possible to detect an increase in intensity of one allele compared with the other.

In some embodiments, the amplified piece of DNA can be bound to beads using the sequencing element of the nucleic acid tag under conditions that favor a single amplified piece of DNA molecule to bind a different bead and amplification occurs on each bead. In some embodiments, such amplification can occur by PCR. Each bead can be placed in a separate well, which can be a picoliter-sized well. In some embodiments, each bead is captured within a droplet of a PCR-reaction-mixture-in-oil-emulsion and PCR amplification occurs within each droplet. The amplification on the bead results in each bead carrying at least one million, at least 5 million, or at least 10 million copies of the single amplified piece of DNA molecule.

In some embodiments where PCR occurs in oil-emulsion mixtures, the emulsion droplets are broken, the DNA is denatured and the beads carrying single-stranded nucleic acids clones are deposited into a well, such as a picoliter-sized well, for further analysis according to the methods described herein. These amplification methods allow for the analysis of genomic DNA regions. Methods for using bead amplification followed by fiber optics detection are described in Margulies et al., *Nature,* 15:437(7057):376-80 (2005), and as well as in US Publication Application Nos. 20020012930; 20030068629; 20030100102; 20030148344; 20040248161; 20050079510; 20050124022; and 20060078909.

Another variation on the array-based approach can be to use the hybridization signal intensities that are obtained from the oligonucleotides employed on Affymetrix SNP arrays or in Illumina Bead Arrays. Here hybridization intensities are compared with average values that are derived from controls, such that deviations from these averages indicate a change in copy number. As well as providing information about copy number, SNP arrays have the added advantage of providing genotype information. For example, they can reveal loss of heterozygosity, which could provide supporting evidence for the presence of a deletion, or might indicate segmental uniparental disomy (which can recapitulate the effects of structural variation in some genomic regions—Prader-Willi and Angelman syndromes, for example).

Many of the basic procedures followed in microarray-based genome profiling are similar, if not identical, to those followed in expression profiling and SNP analysis, including the use of specialized microarray equipment and data-analysis tools. Since microarray-based expression profiling has been well established in the last decade, much can be learned from the technical advances made in this area. Examples of the use of microarrays in nucleic acid analysis that can be used are described in U.S. Pat. No. 6,300,063, U.S. Pat. No. 5,837,832, U.S. Pat. No. 6,969,589, U.S. Pat. No. 6,040,138, U.S. Pat. No. 6,858,412, U.S. application Ser. No. 08/529,115, U.S. application Ser. No. 10/272,384, U.S. application Ser. No. 10/045,575, U.S. application Ser. No. 10/264,571 and U.S. application Ser. No. 10/264,574. It should be noted that there are also distinct differences such as target and probe complexity, stability of DNA over RNA, the presence of repetitive DNA and the need to identify single copy number alterations in genome profiling.

In one embodiment, the genetic variations detected comprise CNVs and may be detected using array CGH. In some embodiments, array CGH can be been implemented using a wide variety of techniques. The initial approaches used arrays produced from large-insert genomic clones such as bacterial artificial chromosomes (BACs). Producing sufficient BAC DNA of adequate purity to make arrays is arduous, so several techniques to amplify small amounts of starting material have been employed. These techniques include ligation-mediated PCR (Snijders et al, *Nat. Genet.,* 29:263-64), degenerate primer PCR using one or several sets of primers, and rolling circle amplification. BAC arrays that provide complete genome tiling paths are also available. Arrays made from less complex nucleic acids such as cDNAs, selected PCR products, and oligonucleotides can also be used. Although most CGH procedures employ hybridization with total genomic DNA, it is possible to use reduced complexity representations of the genome produced by PCR techniques. Computational analysis of the genome sequence can be used to design array elements complementary to the sequences contained in the representation. Various SNP genotyping platforms, some of which use reduced complexity genomic representations, can be useful for their ability to determine both DNA copy number and allelic content across the genome. In some embodiments, small amounts of genomic DNA can be amplified with a variety of whole genome amplification methods prior to CGH analysis of the sample.

The different basic approaches to array CGH provide different levels of performance, so some are more suitable for particular applications than others. The factors that determine performance include the magnitudes of the copy number changes, their genomic extents, the state and composition of the specimen, how much material is available for analysis, and how the results of the analysis can be used. Many applications use reliable detection of copy number changes of much less than 50%, a higher stringency than for other microarray technologies. Note that technical details are extremely important and different implementations of methods using the same array CGH approach can yield different levels of performance. Various CGH methods are known in the art and are equally applicable to one or more methods of the present disclosure. For example, CGH methods are disclosed in U.S. Pat. Nos. 7,957,913, 7,910,353, 7,238,484, 7,702,468, 7,034,144; 7,030,231; 7,011,949; 7,014,997; 6,977,148; 6,951,761; and 6,916,621, the disclosure from each of which is incorporated by reference herein in its entirety.

The data provided by array CGH are quantitative measures of DNA sequence dosage. Array CGH provides high-resolution estimates of copy number aberrations, and can be performed efficiently on many samples. The advent of array CGH technology makes it possible to monitor DNA copy number changes on a genomic scale and many projects have been launched for studying the genome in specific diseases.

In one embodiment, whole genome array-based comparative genome hybridization (array CGH) analysis, or array CGH on a subset of genomic regions, can be used to efficiently interrogate human genomes for genomic imbalances at multiple loci within a single assay. The development of comparative genomic hybridization (CGH) (Kallioniemi et al, 1992, Science 258: 818-21) provided the first efficient approach to scanning entire genomes for variations in DNA copy number. The importance of normal copy number variation involving large segments of DNA has been unappreciated. Array CGH is a breakthrough technique in human genetics, which is attracting interest from clinicians working in fields as diverse as cancer and IVF (In Vitro Fertilization). The use of CGH microarrays in the clinic holds great promise for identifying regions of genomic imbalance associated with disease. Advances from identifying chromosomal critical regions associated with specific phenotypes to identifying the specific dosage sensitive genes can lead to therapeutic opportunities of benefit to patients. Array CGH is a specific, sensitive and rapid technique that can enable the screening of the whole genome in a single test. It can facilitate and accelerate the screening process in human genetics and is expected to have a profound impact on the screening and counseling of patients with genetic disorders. It is now possible to identify the exact location on the chromosome where an aberration has occurred and it is possible to map these changes directly onto the genomic sequence.

An array CGH approach provides a robust method for carrying out a genome-wide scan to find novel copy number variants (CNVs). The array CGH methods can use labeled fragments from a genome of interest, which can be competitively hybridized with a second differentially labeled genome to arrays that are spotted with cloned DNA fragments, revealing copy-number differences between the two genomes. Genomic clones (for example, BACs), cDNAs, PCR products and oligonucleotides, can all be used as array targets. The use of array CGH with BACs was one of the earliest employed methods and is popular, owing to the extensive coverage of the genome it provides, the availability of reliable mapping data and ready access to clones. The last of these factors is important both for the array experiments themselves, and for confirmatory FISH experiments.

In a typical CGH measurement, total genomic DNA is isolated from test and reference subjects, differentially labeled, and hybridized to a representation of the genome that allows the binding of sequences at different genomic locations to be distinguished. More than two genomes can be compared simultaneously with suitable labels. Hybridization of highly repetitive sequences is typically suppressed by the inclusion of unlabeled Cot-1 DNA in the reaction. The relative hybridization intensity of the test and reference signals at a given location can be proportional to the relative copy number of those sequences in the test and reference genomes. If the reference genome is normal then increases and decreases in signal intensity ratios directly indicate DNA copy number variation within the test genome. Data are typically normalized so that the modal ratio for the genome is set to some standard value, typically 1.0 on a linear scale or 0.0 on a logarithmic scale. Additional measurements such as FISH or flow cytometry can be used to determine the actual copy number associated with a ratio level.

In some embodiments, an array CGH procedure can include the following steps. First, large-insert clones, for example, BACs can be obtained from a supplier of clone libraries. Then, small amounts of clone DNA can be amplified, for example, by degenerate oligonucleotide-primed (DOP) PCR or ligation-mediated PCR in order to obtain sufficient quantities needed for spotting. Next, PCR products can be spotted onto glass slides using, for example, microarray robots equipped with high-precision printing pins. Depending on the number of clones to be spotted and the space available on the microarray slide, clones can either be spotted once per array or in replicate. Repeated spotting of the same clone on an array can increase precision of the measurements if the spot intensities are averaged, and allows for a detailed statistical analysis of the quality of the experiments. Subject and control DNAs can be labeled, for example, with either Cy3 or Cy5-dUTP using random priming and can be subsequently hybridized onto the microarray in a solution containing an excess of Cot1-DNA to block repetitive sequences. Hybridizations can either be performed manually under a coverslip, in a gasket with gentle rocking or, automatically using commercially available hybridization stations. These automated hybridization stations can allow for an active hybridization process, thereby improving the reproducibility as well as reducing the actual hybridization time, which increases throughput. The hybridized DNAs can detected through the two different fluorochromes using standard microarray scanning equipment with either a scanning confocal laser or a charge coupled device (CCD) camera-based reader, followed by spot identification using commercially or freely available software packages.

The use of CGH with arrays that comprise long oligonucleotides (60-100 bp) can improve the detection resolution (in some embodiments, as small as about 3-5 kb sized CNVs on arrays designed for interrogation of human whole genomes) over that achieved using BACs (limited to 50-100 kb or larger sized CNVs due to the large size of BAC clones). In some embodiments, the resolution of oligonucleotide CGH arrays is achieved via in situ synthesis of 1-4 million unique features/probes per microarray, which can include microarrays available from Roche NimbleGen and Agilent Technologies. In addition to array CGH methods for copy number detection, other embodiments for partial or whole genome analysis of CNVs within a genome include, but are not limited to, use of SNP genotyping microarrays and sequencing methods.

Another method for copy number detection that uses oligonucleotides can be representational oligonucleotide microarray analysis (ROMA). It is similar to that applied in the use of BAC and CGH arrays, but to increase the signal-to-noise ratio, the 'complexity' of the input DNA is reduced by a method called representation or whole-genome sampling. Here the DNA that is to be hybridized to the array can be treated by restriction digestion and then ligated to adapters, which results in the PCR-based amplification of fragments in a specific size-range. As a result, the amplified DNA can make up a fraction of the entire genomic sequence—that is, it is a representation of the input DNA that has significantly reduced complexity, which can lead to a reduction in background noise. Other suitable methods available to the skilled person can also be used, and are within scope of the present disclosure.

A comparison of one or more genomes relative to one or more other genomes with array CGH, or a variety of other CNV detection methods, can reveal the set of CNVs between two genomes, between one genome in comparison to multiple genomes, or between one set of genomes in comparison to another set of genomes. In some embodiments, an array CGH experiment can be performed by hybridizing a single test genome against a pooled sample of two or more genomes, which can result in minimizing the detection of higher frequency variants in the experiment. In some embodiments, a test genome can be hybridized alone (e.g., one-color detection) to a microarray, for example, using array CGH or SNP genotyping methods, and the comparison step to one or more reference genomes can be performed in silico to reveal the set of CNVs in the test genome relative to the one or more reference genomes. In one embodiment, a single test genome is compared to a single reference genome in a 2-color experiment wherein both genomes are cohybridized to the microarray.

Array CGH can be used to identify genes that are causative or associated with a particular phenotype, condition, or disease by comparing the set of CNVs found in the affected cohort to the set of CNVs found in an unaffected cohort. An unaffected cohort may consist of any individual unaffected by the phenotype, condition, or disease of interest, but in one embodiment is comprised of individuals or subjects that are apparently healthy (normal). Methods employed for such analyses are described in U.S. Pat. Nos. 7,702,468, 7,957, 913 and 8,862,410. In some embodiments of CNV comparison methods, candidate genes that are causative or associated (i.e., potentially serving as a biomarker) with a phenotype, condition, or disease will be identified by CNVs that occur in the affected cohort but not in the unaffected cohort, or present at much lower frequency in the unaffected cohort as compared to the affected cohort. In another embodiment of CNV comparison methods, one or more CNVs may be present at much higher frequency in the unaffected cohort as compared to the affected cohort and thus may be indicative of protection for development of the disease or condition present in the affected cohort. In some embodiments of CNV comparison methods, candidate genes that are causative or associated (i.e., potentially serving as a biomarker) with a phenotype, condition, or disease will be identified by CNVs that occur at a statistically significant higher frequency in the affected cohort as compared their frequency in the unaffected cohort. Thus, CNVs detected in the affected cohort as compared to the unaffected cohort can serve as beacons of genes that are causative or associated with a particular phenotype, condition, or disease. In some embodiments, CNV detection and comparison methods can result in direct identification of the gene that is causative or associated with phenotype, condition, or disease if the CNVs are found to overlap with or encompass the gene(s). In some embodiments, CNV detection and comparison methods can result in identification of regulatory regions of the genome (e.g., promoters, enhancers, transcription factor binding sites) that regulate the expression of one or more genes that are causative or associated with the phenotype, condition, or disease of interest.

Due to the large amount of genetic variation between any two genomes, or two sets (cohorts) of genomes, being compared, one embodiment is to reduce the genetic variation search space by interrogating only CNVs, as opposed to the full set of genetic variants that can be identified in an individual's genome or exome. The set of CNVs that occur only, or at a statistically higher frequency, in the affected cohort as compared to the unaffected cohort can then be further investigated in targeted sequencing experiments to reveal the full set of genetic variants (of any size or type) that are causative or associated (e.g., potentially serving as a biomarker) with a phenotype, condition, or disease. It can be appreciated by those skilled in the art that the targeted sequencing experiments can be performed in both the affected and unaffected cohorts in order to identify the genetic variants (e.g., SNVs and indels) that occur only, or at a statistically significant higher frequency, in the affected individual or cohort as compared to the unaffected cohort. In another embodiment, the targeted sequencing experiments can be performed on the affected cohort and the variations found can be compared to public or private databases containing sequence variants present in unaffected subjects, or in some embodiments, the general population.

When investigating EN, it can be appreciated by those skilled in the art that the number of EN candidate genes (or regulatory sequences) identified via CNV (or other variant types) detection methods may increase or decrease when additional EN cohorts are analyzed. Similarly, the number of EN candidate genes (or regulatory sequences), for example, identified via CNV (or other variant types) detection methods may increase or decrease when additional unaffected cohorts are used to interpret the affected cohort CNVs (or other variant types). For very rare CNVs (e.g., <0.1% frequency in the general population), only a single case may be observed in a given EN cohort (e.g., 100 cases) but further statistical significance or evidence for the gene (or regulatory sequence/locus in the genome) can be established by: 1) CNV analysis of additional EN cohorts, 2) CNV analysis of additional Normal cohorts, 3) targeted gene sequencing of both EN and Normal cohorts, and/or 4) functional characterization of the EN candidate gene (e.g., in silico analysis of the predicted impact of the candidate mutation on the gene product, RNAi knockdown experiments, biochemical assays on EN patient tissue, gene expression analysis of disease-relevant tissues or of induced pluripotent stem cells (iPSCs) created from the EN patient(s) harboring the candidate EN-causing genetic variant). It can be appreciated by those skilled in the art that the ability to identify disease genes via rare CNVs in as few as 100-300 cases, the typical size of a Phase 2 clinical trial, has particular utility for the identification of genetic biomarkers of drug efficacy and/or safety and advantages over SNV-based discovery methods, which typically require thousands of cases. Genes identified by rare loss-of-function CNVs can then be sequenced in the Phase 2 clinical trial cohort (or, via targeted interpretation of previously obtained exome and/or whole genome sequences on the clinical trial cohort) to reveal genetic biomarkers. Knowledge of genetic biomarkers for safety and/or efficacy in Phase 2 can substantially reduce the attrition rate and costs of drug development.

It can be appreciated by those skilled in the art that a candidate gene may validate as causative of the phenotype, condition, or disease (e.g., EN), which may, for example, be confirmed via mechanism of action experiments, or it may serve as a biomarker of the phenotype, condition, or disease. Thus, in the example of EN, in some embodiments, the EN-specific gene (or regulatory sequence/locus) may be a biomarker of age-of-onset for EN and disease severity, and thus have diagnostic utility for monitoring patients known to be at risk for EN or as a general screening test in the population for early diagnosis of the disease. In some embodiments, the EN-specific gene/biomarker may be an indicator of drug response (e.g., a particular subtype of EN may respond best to a therapeutic targeting a particular phenotype, causative gene, or other gene in the same pathway as the causative gene) and thus have utility during drug development in clinical trials. For example, clinical trials for a therapeutic that targets a EN genetic subtype comprising only 10% of all patients exhibiting symptoms of EN, can be designed to comprise only those 10% of patients with a specific genotype(s) in order to reduce the time and cost of such clinical trials (e.g., smaller number of patients in the clinical trial). It can be appreciated by those skilled in the art that such patient stratification methods (i.e., specific genotypes correlated with the disease or drug response) can be employed not only for targeted therapeutics, but in general for any drug that is approved or in development (i.e., the mechanism of action may or may not be known). For example, drugs in development or approved to treat, for example, cancer, may have utility in being repurposed to treat EN. Such patient stratification methods can also be utilized to develop a companion diagnostic test (e.g., comprising the specific genes/genotypes found in patients that are indicative of drug response) for a particular drug, either concurrently during the clinical trials for the drug or after drug approval (e.g., as a new indication or for the physician to use in guiding medical decisions for the patient).

Figure 9:
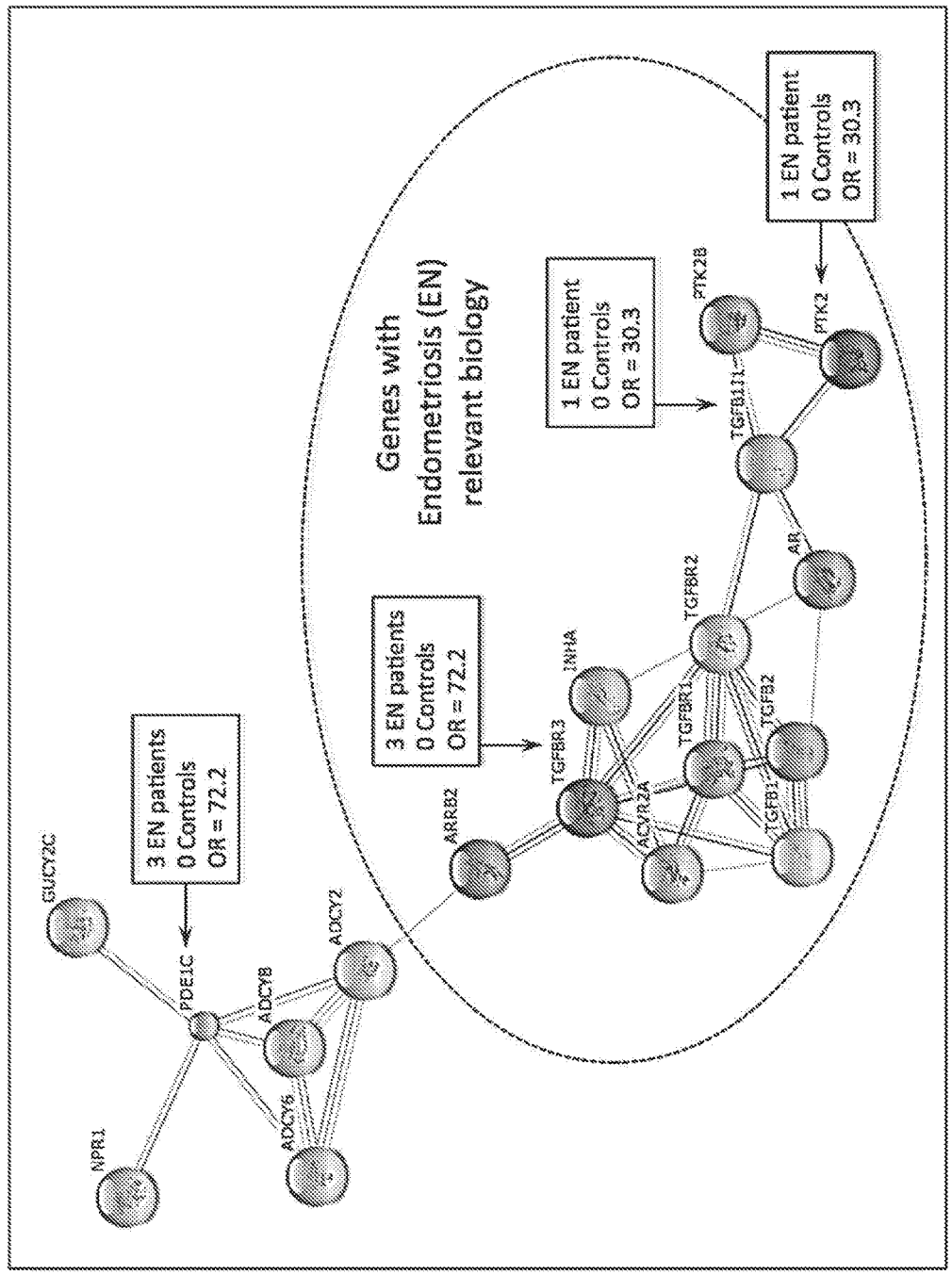
FIG. 9 shows molecular interactions on the basis of biochemical and in silico evidence generated with the String 9.05 algorithm (http://string-db.org/). Four genes (PDE1C, PTK2, TGFBR3, TBFB1I1) that were identified on the basis of CNVs present in 1-3 EN patients and 0 controls are indicated along with OR values. Genes with EN-relevant biology are encircled.

Further links to EN pathology may be established via pathway analysis of the genes, which may take into consideration binding interactions (e.g., via yeast 2-hybrid screen) and molecular events (e.g., kinase activity or other enzymatic processes) if such information is available for the gene(s) of interest (e.g., specified in the analysis). Both commercial (e.g., Ingenuity's IPA software and Thomson Reuter's GeneGo software) and open source software (e.g., String: string-db.org/) are available for such analyses. To assess connections to established EN biology, analyses can be performed for the set of candidate EN genes independently or against known causative EN genes singly or as a group. For example, see FIG. 9.

A method of screening a subject for a disease or disorder can comprise assaying a nucleic acid sample from the subject to detect sequence information for more than one genetic loci and comparing the sequence information to a panel of nucleic acid biomarkers and screening the subject for the presence or absence of EN if one or more of low frequency biomarkers in the panel are present in the sequence information. The panel may comprise at least one nucleic acid biomarker for each of the more than one genetic loci. For example, the panel can comprise 2, 3, 4, 5, 6, 7, 8, 9, 10, 15, 20, 25, 30, 35, 40, 45, 50, 75, 100, 150, 200 or more nucleic acid biomarkers for each of the more than one genetic loci. The panel may comprise at least 25 low frequency biomarkers. For example, the panel can comprise at least 30, 35, 40, 45, 50, 55, 60, 65, 70, 75, 80, 85, 90, 95, 100, 135, 150, 175, 200, 250, 500, or 1000 or more low frequency biomarkers. A low frequency biomarker can occur at a frequency of 0.1% or less in a population of subjects without a diagnosis of the disease or disorder. For example, a low frequency biomarker can occur at a frequency of 0.05%, 0.01%, 0.005%, 0.001%, 0.0005%, 0.0001%, 0.00005%, or 0.00001% or less in a population of subjects without a diagnosis of the disease or disorder.

In some embodiments, the presence or absence of EN in the subject can be determined with at least 50% confidence. For example, the presence or absence of the disease or disorder in the subject can be determined with at least 50%, 55%, 60%, 65%, 70%, 75%, 80%, 85%, 90%, 95%, 98%, 99%, or 100% confidence.

In one embodiment, EN candidate CNV subregions and genes associated with these regions may be determined or identified by comparing genetic data from a cohort of normal individuals (NVE) to that of a cohort of individuals known to have, or be susceptible to EN.

In some embodiments, genomic DNA samples from individuals within a NVE cohort and/or a EN cohort can be considered test subject DNA samples and hybridized against one or more, sex-matched reference DNA samples from individuals. For example, reference DNA samples can be labeled with a fluorophore such as Cy5, using methods described herein, and test subject DNA samples can be labeled with a different fluorophore, such as Cy3. After labeling, samples can be combined and can be co-hybridized to a microarray and analyzed using any of the methods described herein, such as aCGH. Arrays can then be scanned and the data can be analyzed with software. Genetic alterations, such as CNVs, can be called using any of the methods described herein. A list of the genetic alterations, such as CNVs, can be generated for each cohort. The list of CNVs can be used to generate a master list of non-redundant CNVs and/or CNV subregions for each cohort. The list can be based on the presence or absence of the CNV subregion in individuals within the cohort. In this manner, the master list can contain a number of distinct CNV subregions, some of which are uniquely present in a single individual and some of which are present in multiple individuals.

In some embodiments, CNV subregions of interest may be obtained by annotation of each CNV subregion with relevant information, such as overlap with known genes and/or exons. In some embodiments, CNV subregions of interest can be obtained by calculating the OR for a CNV subregion according to the following formula: OR=(EN/((# individuals in EN cohort)−EN))/(NVE/((# individuals in NVE cohort)−NVE)), where: EN=number of EN individuals with a CNV subregion of interest and NVE=number of NVE individuals with the CNV subregion of interest. If NVE=0, it can be set to 1 to avoid dealing with infinities in cases where no CNVs are seen in the NVE.

The number of individuals in any given cohort may be at least about 10, 50, 100, 200, 300, 400, 500, 600, 700, 800, 900, 1000, 2500, 5000, 7500, 10,000, 100,000, or more.

In some embodiments, a CNV subregion/gene can be of interest if the CNV subregion overlaps a known gene, and is associated with an OR of at least 6, e.g., at least 35. For example, a CNV subregion/gene can be of interest if the CNV subregion overlaps a known gene, and is associated with an OR of at least 7, 8, 9, 10, 12, 14, 16, 18, 20, 25, 30, 35, 40, 45, 50, or more. In some embodiments, a CNV subregion/gene can be of interest if the CNV subregion overlaps a known gene, and is associated with an OR from about 6-100, 6-50, 6-40, 6-30, 6-20, 6-10, 6-9, 6-8, 6-7, 8-100, 8-50, 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7. The CNV subregion/gene can be an exonic or intronic part of the gene, or both.

In some embodiments, a CNV subregion/gene can be of interest if the CNV subregion does not overlap a known gene (e.g., is non-genic or intergenic) and is associated with an OR of at least 4 or higher. For example, a CNV subregion/gene can be of interest if the CNV subregion does not overlap a known gene (e.g., is non-genic or intergenic) and is associated with an OR of at least 5, 6, 7, 9, 9, 10, 12, 14, 16, 18, 20, 25, 30, 35, 40, 45, 50, or more. In some embodiments, a CNV subregion/gene can be of interest if the CNV subregion does not overlap a known gene (e.g., is non-genic or intergenic) and is associated with an OR from about 5-100, 5-50, 5-40, 5-30, 5-20, 20-100, 20-50, 20-40, 20-30, 30-100, 30-50, 30-40, 40-100, 40-50, 50-100, or 9-11.

In some embodiments, a CNV subregion/gene can be of interest based on the OR associated with the sum of EN cases and the sum of NVE cases affecting the same gene (including distinct CNV subregions). For example, a CNV subregion/gene can be of interest if the OR associated with the sum of EN cases and the sum of NVE cases affecting the same gene (including distinct CNV subregions) is at least 4, 5, 6, 7, 8, 9, 10, 12, 14, 16, 18, 20, 25, 30, 35, 40, 45, 50, or more. In some embodiments, a CNV subregion/gene can be of interest if the OR associated with the sum of EN cases and the sum of NVE cases affecting the same gene (including distinct CNV subregions) is from about 4-100, 4-50, 4-40, 4-30, 4-20, 4-10, 4-9, 4-8, 4-7, 8-100, 8-50, 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7.

The data presented in FIGS. 1-4 were generated on the basis of a comparison of copy number variants (CNVs) identified in a NVE and a EN cohort. CNV genome locations are provided using the Human March 2006 (NCBI36/hg18) assembly. It can be appreciated by those skilled in the art that a CNV found in an affected individual may have one or more subregions that are found in the affected cohort as compared to the unaffected cohort and, similarly, other subregions within the CNV that are found at comparable frequencies, or not statistically significant different frequencies, in the affected and unaffected cohorts. In one embodiment, CNV detection and analysis methods are employed that enable comparison of CNV subregions to facilitate identification of genes (or regulatory loci) that are causative or associated with the phenotype, condition, or disease being investigated (or detected for diagnostic purposes).

FIG. 1 lists exemplary CNVs associated with EN, obtained as described in Example 1. For each entry, the chromosome (for the purpose of algorithms and databases used in the analyses, chromosome X is designated as chromosome 23) and original CNV start and stop positions are listed, along with original CNV size, CNV type (loss or gain), EN case ID, gene annotation (for the CNV subregion not the original CNV) and corresponding SEQ ID numbers (Nos.).

FIG. 2 shows the actual CNV subregions found to be unique or significantly different between the EN and NVE cohorts. For each entry, the chromosome (for the purpose of algorithms and databases used in the analyses, chromosome X is designated as chromosome 23) and CNV subregion start and stop positions are listed, along with CNV subregion size, CNV type (loss or gain), EN case ID, gene annotation, whether a genic CNV subregion of interest overlaps an exon or not, the number of NVE subjects and the number of EN subjects that harbor the relevant CNV subregion, the Fisher's 2 tailed Exact Test (FET), Odds ratio (OR), and the category under which the CNV subregion was identified.

FIG. 3 represents a non-redundant list for all genes listed in FIG. 2 (namely, those relevant to CNV subregions of interest), and includes RefSeq Gene Symbol, Exon overlap (intronic, exonic or both), NCBI Gene ID (DNA accession number), Gene Description (brief gene description), and RefSeq Summary (summary of gene function).

FIG. 4 represents a non-redundant list for all genes listed in FIG. 2 (namely, those relevant to CNV subregions of interest) and includes RefSeq Gene Symbol, Exon overlap (intronic, exonic or both), RefSeq Accession Number (may be multiple entries per gene), mRNA Description (brief description of mRNA), and corresponding SEQ ID Nos.

More than one RNA product (e.g., alternatively spliced mRNA transcripts and non-coding RNAs) can be produced from a single gene. FIG. 4 lists all presently known transcript variants (and their RNA accession numbers) but new variants may be found when further studies are completed and that generation of these additional transcript variants (and ultimately protein and/or regulatory RNA products) may also be impacted by one or more CNVs or CNV subregions listed in FIGS. 1 and 2, respectively. The transcripts listed in FIG. 4 can be expression products of the same gene biomarker. The gene biomarker can comprise genomic DNA encoding the gene, including exons, introns, and/or regulatory binding regions (such as enhancers, promoters, silencers, and/or response elements). Point mutations, polymorphisms, translocations, insertions, deletions, amplifications, inversions, micro satellites, interstitial deletions, CNVs, loss of heterozygosity, or any other aberrations which affect the structure or function of one or more gene biomarkers and/or expression products thereof, can be associated with EN as described herein.

Computer-Implemented Aspects

As understood by those of ordinary skill in the art, the methods and information described herein (genetic variation association with EN) can be implemented, in all or in part, as computer executable instructions on known computer readable media. For example, the methods described herein can be implemented in hardware. Alternatively, the method can be implemented in software stored in, for example, one or more memories or other computer readable medium and implemented on one or more processors. As is known, the processors can be associated with one or more controllers, calculation units and/or other units of a computer system, or implanted in firmware as desired. If implemented in software, the routines can be stored in any computer readable memory such as in RAM, ROM, flash memory, a magnetic disk, a laser disk, or other storage medium, as is also known. Likewise, this software can be delivered to a computing device via any known delivery method including, for example, over a communication channel such as a telephone line, the Internet, a wireless connection, etc., or via a transportable medium, such as a computer readable disk, flash drive, etc.

More generally, and as understood by those of ordinary skill in the art, the various steps described above can be implemented as various blocks, operations, tools, modules and techniques which, in turn, can be implemented in hardware, firmware, software, or any combination of hardware, firmware, and/or software. When implemented in hardware, some or all of the blocks, operations, techniques, etc. can be implemented in, for example, a custom integrated circuit (IC), an application specific integrated circuit (ASIC), a field programmable logic array (FPGA), a programmable logic array (PLA), etc.

Results from such genotyping can be stored in a data storage unit, such as a data carrier, including computer databases, data storage disks, or by other convenient data storage means. In certain embodiments, the computer database is an object database, a relational database or a post-relational database. Data can be retrieved from the data storage unit using any convenient data query method.

When implemented in software, the software can be stored in any known computer readable medium such as on a magnetic disk, an optical disk, or other storage medium, in a RAM or ROM or flash memory of a computer, processor, hard disk drive, optical disk drive, tape drive, etc. Likewise, the software can be delivered to a user or a computing system via any known delivery method including, for example, on a computer readable disk or other transportable computer storage mechanism.

The steps of the claimed methods can be operational with numerous other general purpose or special purpose computing system environments or configurations. Examples of well-known computing systems, environments, and/or configurations that can be suitable for use with the methods or system of the claims include, but are not limited to, personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, and the like.

The steps of the claimed method and system can be described in the general context of computer-executable instructions, such as program modules, being executed by a computer. Generally, program modules include routines, programs, objects, components, and/or data structures that perform particular tasks or implement particular abstract data types. The methods and apparatus can also be practiced in distributed computing environments where tasks are performed by remote processing devices that are linked through a communications network. In both integrated and distributed computing environments, program modules can be located in both local and remote computer storage media including memory storage devices. Numerous alternative embodiments could be implemented, using either current technology or technology developed after the filing date of this application, which would still fall within the scope of the claims defining the disclosure.

While the risk evaluation system and method, and other elements, have been described as being implemented in software, they can be implemented in hardware, firmware, etc., and can be implemented by any other processor. Thus, the elements described herein can be implemented in a standard multi-purpose CPU or on specifically designed hardware or firmware such as an application-specific integrated circuit (ASIC) or other hard-wired device as desired. When implemented in software, the software routine can be stored in any computer readable memory such as on a magnetic disk, a laser disk, or other storage medium, in a RAM or ROM of a computer or processor, in any database, etc. Likewise, this software can be delivered to a user or a screening system via any known or desired delivery method including, for example, on a computer readable disk or other transportable computer storage mechanism or over a communication channel, for example a telephone line, the internet, or wireless communication. Modifications and variations can be made in the techniques and structures described and illustrated herein without departing from the spirit and scope of the present disclosure.

EN Therapeutics

Medications and surgery can provide relief from the symptoms of EN. The main families of drugs useful for treating EN are NSAIDS, GnRH agonists and antagonists, oral contraceptives, progestin, danazol, and aromatase inhibitors. The stage of the disease may determine which therapy is most useful.

It can be appreciated by those skilled in the art that patient stratification methods (e.g., specific genotypes correlated with the disease or drug response) can be employed not only for targeted therapeutics, but in general for any drug that is approved or in development. For example, drugs in development or approved to treat, for example, cancer, may have utility in being repurposed to treat EN. Such patient stratification methods can also be utilized to develop a companion diagnostic test (e.g., for the specific genes/genotypes found in patients that are indicative of drug response) for a particular drug, either concurrently during the clinical trials for the drug or after drug approval (e.g., as a new indication or for the physician to use in guiding medical decisions for the patient).

Thus, those skilled in the art can appreciate that the gene product of one or more EN-associated genes listed in FIGS. 1-3 may be useful as a drug target for development of a therapeutic to treat a patient with an EN-associated genetic variant. For example, the protein product of a gene that is known to contain an EN-associated variant (such as an SNV or CNV) may have partial or full loss of function in an EN patient with the EN-associated genetic variant. In another embodiment, an EN-associated genetic variant may result in gain of function for the protein product expressed from the mutated gene, such as an activating mutation of the protein's function (e.g., kinase activity is aberrantly increased) or overexpression of the protein due to a CNV gain of the whole gene. Methods of drug screening for drug targets are well known to those skilled in the art. Drugs can be developed to specifically target a gene that is found to cause a particular disease (e.g., EN) due to the presence of a genetic variant or to another gene in a particular biochemical/cellular pathway (e.g., FIG. 9).

In one embodiment, drug development can be pursued on the basis that a gene is a target for drugs in development or already approved for use in one or more conditions, such as those genes listed in FIG. 10. For example, EN-associated genes in FIG. 3 that are known drug targets, according to FIG. 10, include CYP17A1, LEPR, PTK2, RXFP1, and TSHR. In another embodiment, a gene family member of a known drug target may have a higher probability of success in yielding an approved drug than a target with no prior efforts attempted for drug development. For example, EN-associated genes in FIG. 3 that are in the same gene family of known drug targets, according to FIG. 10, include DPP6 (FIG. 10, DPP4), GPR111 (FIG. 10, 4 GPR genes), HMGB3 (FIG. 10, HMGB1), MAGEA11 (FIG. 10, MAGEA3), MUC4 (FIG. 10, MUC1 and MUC16), MYO1B (FIG. 10, MYO7A), PDE1C (FIG. 10, 6 PDE genes), PGRMC2 (FIG. 10, PGR), PLA2G4C (FIG. 10, PLA2G4A), TGFBR3 (FIG. 10, TGFBR1 and TGFBR2), and TGFB1I1 (FIG. 10, TGFB signaling genes TGFB1, TGFB2, TGFBR1, TGFBR2).

For example, a drug approved or in development for one disease area may have therapeutic use in a related, or even unrelated, disease area. For example, the EN-associated gene RXFP1 is a known drug target (FIG. 10) and multiple pharmaceutical companies are developing drugs that target its gene product. The RXFP1 protein is a G-protein-coupled receptor and the endogenous hormone relaxin activates this receptor (Xiao et al., Probe Reports from the NIH Molecular Libraries Program [Internet] Bethesda (Md.): National Center for Biotechnology Information (US), 2010-2012 (2013, updated); Xiao et al., Nat Commun. 4:1953 (2013)). Recombinant relaxin hormone is in development for treatment of heart failure. Analogs of relaxin, such as H2:A(4-24)(F23A) (see Chan et al., J. Biol. Chem., 287:41152 (2012)), have also been found to have potency. However, due to the short half-life of relaxin, it requires intravenous administration. Small molecule agonists of the relaxin receptor are being developed that are orally bioavailable (Xiao et al., supra). Those molecules can be identified using a high-throughput screening assay developed for the RXFP1 gene product (Chen et al., J Biomol Screen. 18:670 (2013)). Since RXFP1 has been reported to have lower expression in ectopic endometriotic tissues (see Table 1) and a deletion in the RXFP1 gene is associated with EN (FIG. 2), recombinant relaxin, relaxin analogs or RXFP1 small molecule agonists may have therapeutic value in certain EN patients. For example, Xiao et al. (supra) reported that relaxin, via its RXFP1 receptor, regulates cellular processes such as extracellular matrix remodeling, cell invasiveness, and proliferation, which are also known to be involved in the pathology of endometriosis. Those skilled in the art also appreciate that therapeutics developed to target a specific gene (or its products) can be administered on the basis of a patient testing positive for a particular genetic variant that impacts the gene target or another gene in the same molecular pathway. In some embodiments, a genetic test is developed as a companion diagnostic test for a specific therapeutic.

RNA Therapeutics

The nucleic acids and/or variants of the disclosure, or nucleic acids comprising their complementary sequence, can be used as antisense constructs to control gene expression in cells, tissues or organs. The methodology associated with antisense techniques is well known to the skilled artisan, and is described and reviewed in Antisense Drug Technology: Principles, Strategies, and Applications, Crooke, Marcel Dekker Inc., New York (2001) In general, antisense nucleic acids are designed to be complementary to a region of mRNA expressed by a gene, so that the antisense molecule hybridizes to the mRNA, thus blocking translation of the mRNA into protein Several classes of antisense oligonucleotide are known to those skilled in the art, including cleavers and blockers. The former bind to target RNA sites, activate intracellular nucleases (e.g., Rnase H or Rnase L) that cleave the target RNA. Blockers bind to target RNA, inhibit protein translation by steric hindrance of the ribosomes. Examples of blockers include nucleic acids, morpholino compounds, locked nucleic acids and methylphosphonates (Thompson, Drug Discovery Today, 7:912-917 (2002)) Antisense oligonucleotides are useful directly as therapeutic agents, and are also useful for determining and validating gene function, for example by gene knock-out or gene knock-down experiments. Antisense technology is further described in Lavery et al., Curr. Opin. Drug Discov. Devel., 6:561-569 (2003), Stephens et al., Curr. Opin. Mol Ther., 5:118-122 (2003), Kurreck, Eur. J. Biochem., 270:1628-44 (2003), Dias et al, Mol. Cancer Ter., 1:347-55 (2002), Chen, Methods Mol. Med., 75:621-636 (2003), Wang et al., Curr. Cancer Drug Targets, 1:177-96 (2001), and Bennett, Antisense Nucleic Acid Drug. Dev., 12 215-24 (2002).

The variants described herein can be used for the selection and design of antisense reagents that are specific for particular variants (e.g., particular genetic variations or polymorphic markers in linkage disequilibrium with particular genetic variations). Using information about the variants described herein, antisense oligonucleotides or other antisense molecules that specifically target mRNA molecules that contain one or more variants of the disclosure can be designed. In this manner, expression of mRNA molecules that contain one or more variants of the present disclosure (markers and/or haplotypes) can be inhibited or blocked. In some embodiments, the antisense molecules are designed to specifically bind a particular allelic form (i.e., one or several variants (alleles and/or haplotypes)) of the target nucleic acid, thereby inhibiting translation of a product originating from this specific allele or haplotype, but which do not bind other or alternate variants at the specific polymorphic sites of the target nucleic acid molecule.

As antisense molecules can be used to inactivate mRNA so as to inhibit gene expression, and thus protein expression, the molecules can be used to treat EN. The methodology can involve cleavage by means of ribozymes containing nucleotide sequences complementary to one or more regions in the mRNA that attenuate the ability of the mRNA to be translated. Such mRNA regions include, for example, protein-coding regions, in particular protein-coding regions corresponding to catalytic activity, substrate and/or ligand binding sites, or other functional domains of a protein.

The phenomenon of RNA interference (RNAi) has been actively studied for the last decade, since its original discovery in C. elegans (Fire et al., Nature, 391:806-11 (1998)), and in recent years its potential use in treatment of human disease has been actively pursued (reviewed in Kim & Rossi, Nature Rev. Genet., 8:173-204 (2007)). RNA interference (RNAi), also called gene silencing, is based on using double-stranded RNA molecules (dsRNA) to turn off specific genes. In the cell, cytoplasmic double-stranded RNA molecules (dsRNA) are processed by cellular complexes into small interfering RNA (siRNA). The siRNA guide the targeting of a protein-RNA complex to specific sites on a target mRNA, leading to cleavage of the mRNA (Thompson, Drug Discovery Today, 7:912-917 (2002)). The siRNA molecules are typically about 20, 21, 22 or 23 nucleotides in length. Thus, one aspect of the disclosure relates to isolated nucleic acid sequences, and the use of those molecules for RNA interference, for example as small interfering RNA molecules (siRNA). In some embodiments, the isolated nucleic acid sequences can be 18-26 nucleotides in length, or 19-25 nucleotides in length, or 20-24 nucleotides in length, or 21, 22 or 23 nucleotides in length.

Another pathway for RNAi-mediated gene silencing originates in endogenously encoded primary microRNA (pn-miRNA) transcripts, which are processed in the cell to generate precursor miRNA (pre-miRNA). These miRNA molecules are exported from the nucleus to the cytoplasm, where they undergo processing to generate mature miRNA molecules (miRNA), which direct translational inhibition by recognizing target sites in the 3' untranslated regions of mRNAs, and subsequent mRNA degradation by processing P-bodies (reviewed in Kim & Rossi, Nature Rev. Genet., 8:173-204 (2007)).

Clinical applications of RNAi include the incorporation of synthetic siRNA duplexes, which are approximately 20-23 nucleotides in size, and may have 3' overlaps of 2 nucleotides. Knockdown of gene expression is established by sequence-specific design for the target mRNA. Several commercial sites for optimal design and synthesis of such molecules are known to those skilled in the art.

Other applications provide longer siRNA molecules (typically 25-30 nucleotides in length, such as about 27 nucleotides), as well as small hairpin RNAs (shRNAs; typically about 29 nucleotides in length). The latter are naturally expressed, as described in Amarzguioui et al. (*FEBS Lett.*, 579:5974-81 (2005)). Chemically synthetic siRNAs and shRNAs are substrates for in vivo processing, and in some cases provide more potent gene-silencing than shorter designs (Kim et al., *Nature Biotechnol.*, 23:222-226 (2005); Siola et al., *Nature Biotechnol.*, 23:227-231 (2005)). In general siRNAs provide for transient silencing of gene expression, because their intracellular concentration is diluted by subsequent cell divisions. By contrast, expressed shRNAs mediate long-term, stable knockdown of target transcripts, for as long as transcription of the shRNA takes place (Marques et al., *Nature Biotechnol.*, 23:559-565 (2006), Brummelkamp et al., *Science*, 296:550-553 (2002)).

Since RNAi molecules, including siRNA, miRNA and shRNA, act in a sequence-dependent manner, variants described herein can be used to design RNAi reagents that recognize specific nucleic acids comprising specific genetic variations, alleles and/or haplotypes, while not recognizing nucleic acid sequences not comprising the genetic variation, or comprising other alleles or haplotypes. These RNAi reagents can thus recognize and destroy the target nucleic acid sequences. As with antisense reagents, RNAi reagents can be useful as therapeutic agents (i.e., for turning off disease-associated genes or disease-associated gene variants), but can also be useful for characterizing and validating gene function (e.g., by gene knock-out or gene knock-down experiments).

Delivery of RNAi can be performed by a range of methodologies known to those skilled in the art. Methods utilizing non-viral delivery include cholesterol, stable nucleic acid-lipid particle (SNALP), heavy-chain antibody fragment (Fab), aptamers and nanoparticles Viral delivery methods include use of lentivirus, adenovirus and adeno-associated virus The siRNA molecules are in some embodiments chemically modified to increase their stability. This can include modifications at the 2' position of the ribose, including 2'-O-methylpunnes and 2'-fluoropyrimidmes, which provide resistance to RNase activity. Other chemical modifications are possible and known to those skilled in the art.

The following references provide a further summary of RNAi, and possibilities for targeting specific genes using RNAi: Kim & Rossi, *Nat. Rev. Genet.*, 8:173 (2007), Chen & Rajewsky, *Nat. Rev. Genet.*, 8:93 (2007), Reynolds, et al., *Nat. Biotechnol.*, 22:326 (2004), Chi et al., *Proc. Natl. Acad. Sa. USA*, 100:6343 (2003), Vickers et al., *J. Biol. Chem.*, 278:7108 (2003), Agami, *Curr. Opin. Chem. Biol.*, 6:829 (2002), Lavery, et al., *Curr. Opin. Drug Discov. Devel.*, 6:561 (2003), Shi, *Trends Genet.*, 19:9 (2003), Shuey et al., *Drug Discov. Today*, 7:1040 (2002), McManus et al., *Nat. Rev. Genet.*, 3:737 (2002), Xia et al., *Nat. Biotechnol.*, 20:1006 (2002), Plasterk et al., *Curr. Opin Genet. Dev.*, 10:562 (2000), Bosher et al., *Nat. Cell Biol.*, 2:E31 (2000), and Hunter, *Curr. Biol.*, 9:R440 (1999).

A genetic defect leading to increased predisposition or risk for development of EN or a defect causing the disease, can be corrected permanently by administering to a subject carrying the defect a nucleic acid fragment that incorporates a repair sequence that supplies the normal/wild-type nucleotide(s) at the site of the genetic defect. Such site-specific repair sequence can encompass an RNA/DNA oligonucleotide that operates to promote endogenous repair of a subject's genomic DNA. The administration of the repair sequence can be performed by an appropriate vehicle, such as a complex with polyethelamine, encapsulated in anionic liposomes, a viral vector such as an adenovirus vector, or other pharmaceutical compositions suitable for promoting intracellular uptake of the administered nucleic acid The genetic defect can then be overcome, since the chimeric oligonucleotides induce the incorporation of the normal sequence into the genome of the subject, leading to expression of the normal/wild-type gene product. The replacement is propagated, thus rendering a permanent repair and alleviation of the symptoms associated with the disease or condition.

Double stranded oligonucleotides are formed by the assembly of two distinct oligonucleotide sequences where the oligonucleotide sequence of one strand is complementary to the oligonucleotide sequence of the second strand; such double stranded oligonucleotides are generally assembled from two separate oligonucleotides (e.g., siRNA), or from a single molecule that folds on itself to form a double stranded structure (e.g., shRNA or short hairpin RNA). These double stranded oligonucleotides known in the art all have a common feature in that each strand of the duplex has a distinct nucleotide sequence, wherein only one nucleotide sequence region (guide sequence or the antisense sequence) has complementarity to a target nucleic acid sequence and the other strand (sense sequence) comprises nucleotide sequence that is homologous to the target nucleic acid sequence.

Double stranded RNA induced gene silencing can occur on at least three different levels: (i) transcription inactivation, which refers to RNA guided DNA or histone methylation; (ii) siRNA induced mRNA degradation; and (iii) mRNA induced transcriptional attenuation. It is generally considered that the major mechanism of RNA induced silencing (RNA interference, or RNAi) in mammalian cells is mRNA degradation. RNA interference (RNAi) is a mechanism that inhibits gene expression at the stage of translation or by hindering the transcription of specific genes. Specific RNAi pathway proteins are guided by the dsRNA to the targeted messenger RNA (mRNA), where they "cleave" the target, breaking it down into smaller portions that can no longer be translated into protein. Initial attempts to use RNAi in mammalian cells focused on the use of long strands of dsRNA. However, these attempts to induce RNAi met with limited success, due in part to the induction of the interferon response, which results in a general, as opposed to a target-specific, inhibition of protein synthesis. Thus, long dsRNA is not a viable option for RNAi in mammalian systems. Another outcome is epigenetic changes to a gene—histone modification and DNA methylation—affecting the degree the gene is transcribed.

More recently it has been shown that when short (18-30 bp) RNA duplexes are introduced into mammalian cells in culture, sequence-specific inhibition of target mRNA can be realized without inducing an interferon response. Certain of these short dsRNAs, referred to as small inhibitory RNAs ("siRNAs"), can act catalytically at sub-molar concentrations to cleave greater than 95% of the target mRNA in the cell. A description of the mechanisms for siRNA activity, as well as some of its applications are described in Provost et al., *EMBO J.*, 21:5864 (2002); Tabara et al., *Cell*, 109:861 (2002); Martinez et al., *Cell*, 110:563 (2002); Hutvagner & Zamore, *Science*, 297:2056 (2002).

From a mechanistic perspective, introduction of long double stranded RNA into plants and invertebrate cells is broken down into siRNA by a Type III endonuclease known as Dicer. Sharp, RNA interference-2001, *Genes Dev.*, 15:485 (2001). Dicer, a ribonuclease-III-like enzyme, processes the dsRNA into 19-23 base pair short interfering RNAs with characteristic two base 3' overhangs. Bernstein, Caudy, Hammond, & Hannon, *Nature,* 409:363 (2001). The siRNAs are then incorporated into an RNA-induced silencing complex (RISC) where one or more helicases unwind the siRNA duplex, enabling the complementary antisense strand to guide target recognition (Nykanen, Haley, & Zamore, *Cell,* 107:309 (2001)). Upon binding to the appropriate target mRNA, one or more endonucleases within the RISC cleaves the target to induce silencing. Elbashir, Lendeckel, & Tuschl, *Genes Dev.,* 15:188 (2001).

Generally, the antisense sequence is retained in the active RISC complex and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC complex (see for example, Schwarz et al., *Cell,* 115:199 (2003)). In this instance the sense sequence is believed to direct the RISC complex to a sequence (off-target sequence) that is distinct from the intended target sequence, resulting in the inhibition of the off-target sequence. In these double stranded nucleic acid sequences, each strand is complementary to a distinct target nucleic acid sequence. However, the off-targets that are affected by these dsRNAs are not entirely predictable and are non-specific.

The term "siRNA" refers to small inhibitory RNA duplexes that induce the RNA interference (RNAi) pathway. These molecules can vary in length (generally between 18-30 basepairs) and contain varying degrees of complementarity to their target mRNA in the antisense strand. Some, but not all, siRNA have unpaired overhanging bases on the 5' or 3' end of the sense strand and/or the antisense strand. The term "siRNA" includes duplexes of two separate strands, as well as single strands that can form hairpin structures comprising a duplex region. Small interfering RNA (siRNA), sometimes known as short interfering RNA or silencing RNA, are a class of 20-25 nucleotide-long double-stranded RNA molecules that play a variety of roles in biology.

While the two RNA strands do not need to be completely complementary, the strands should be sufficiently complementary to hybridize to form a duplex structure. In some instances, the complementary RNA strand can be less than 30 nucleotides, less than 25 nucleotides in length, about 19 to 24 nucleotides in length, or 20-23 nucleotides in length, including 22 nucleotides in length. The dsRNA of the present disclosure can further comprise at least one single-stranded nucleotide overhang. The dsRNA of the present disclosure can further comprise a substituted or chemically modified nucleotide. As discussed in detail below, the dsRNA can be synthesized by standard methods known in the art.

siRNA can be divided into five (5) groups including non-functional, semi-functional, functional, highly functional, and hyper-functional based on the level or degree of silencing that they induce in cultured cell lines. As used herein, these definitions are based on a set of conditions where the siRNA is transfected into the cell line at a concentration of 100 nM and the level of silencing is tested at a time of roughly 24 hours after transfection, and not exceeding 72 hours after transfection. In this context, "non-functional siRNA" are defined as those siRNA that induce less than 50% (<50%) target silencing. "Semi-functional siRNA" induce 50-79% target silencing. "Functional siRNA" are molecules that induce 80-95% gene silencing. "Highly-functional siRNA" are molecules that induce greater than 95% gene silencing. "Hyperfunctional siRNA" are a special class of molecules. For purposes of this document, hyperfunctional siRNA are defined as those molecules that: (1) induce greater than 95% silencing of a specific target when they are transfected at subnanomolar concentrations (i.e., less than one nanomolar); and/or (2) induce functional (or better) levels of silencing for greater than 96 hours. These relative functionalities (though not intended to be absolutes) can be used to compare siRNAs to a particular target for applications such as functional genomics, target identification and therapeutics.

microRNAs (miRNA) are single-stranded RNA molecules of about 21-23 nucleotides in length, which regulate gene expression. miRNAs are encoded by genes that are transcribed from DNA but not translated into protein (non-coding RNA); instead they are processed from primary transcripts known as pri-miRNA to short stem-loop structures called pre-miRNA and finally to functional miRNA. Mature miRNA molecules are partially complementary to one or more messenger RNA (mRNA) molecules, and their main function is to downregulate gene expression.

Antibody-Based Therapeutics

The present disclosure embodies agents that modulate a peptide sequence or RNA expressed from a gene associated with EN. The term biomarker, as used herein, can comprise a genetic variation of the present disclosure or a gene product, for example, RNA and polypeptides, of any one of the genes listed in FIGS. 1-4. Such modulating agents include, but are not limited to, proteins, peptides, peptidomimetics, peptoids, or any other forms of a molecule, which bind to, and alter the signaling or function associated with the EN associated biomarker, have an inhibitory or stimulatory effect on the EN associated biomarkers, or have a stimulatory or inhibitory effect on the expression or activity of the EN associated biomarkers' ligands, for example, polyclonal antibodies and/or monoclonal antibodies that specifically bind one form of the gene product but not to the other form of the gene product are also provided, or which bind a portion of either the variant or the reference gene product that contains the polymorphic site or sites.

In some embodiments, the present disclosure provides antibody-based agents targeting EN associated biomarkers. The antibody-based agents in any suitable form of an antibody, e.g., monoclonal, polyclonal, or synthetic, can be utilized in the therapeutic methods disclosed herein. The antibody-based agents include any target-binding fragment of an antibody and also peptibodies, which are engineered therapeutic molecules that can bind to human drug targets and contain peptides linked to the constant domains of antibodies. In some embodiments, the antibodies used for targeting EN associated biomarkers are humanized antibodies. Methods for humanizing antibodies are well known in the art. In some embodiments, the therapeutic antibodies comprise an antibody generated against EN associated biomarkers described in the present disclosure, wherein the antibodies are conjugated to another agent or agents, for example, a cytotoxic agent or agents.

The term "antibody" as used herein refers to immunoglobulin molecules and immunologically active portions of immunoglobulin molecules, i.e., molecules that contain antigen-binding sites that specifically bind an antigen. A molecule that specifically binds to a polypeptide of the disclosure is a molecule that binds to that polypeptide or a fragment thereof, but does not substantially bind other molecules in a sample, e.g., a biological sample, which naturally contains the polypeptide. Examples of immunologically active portions of immunoglobulin molecules include F(ab) and F(ab')2 fragments which can be generated by treating the antibody with an enzyme such as pepsin. The disclosure provides polyclonal and monoclonal antibodies that bind to a polypeptide of the disclosure. The term "monoclonal antibody" or "monoclonal antibody composition", as used herein, refers to a population of antibody molecules that contain only one species of an antigen binding site capable of immunoreacting with a particular epitope of a polypeptide of the disclosure. A monoclonal antibody composition thus typically displays a single binding affinity for a particular polypeptide of the disclosure with which it immunoreacts.

Polyclonal antibodies can be prepared as described above by immunizing a suitable subject with a desired immunogen, e.g., polypeptide of the disclosure or a fragment thereof. The antibody titer in the immunized subject can be monitored over time by standard techniques, such as with an enzyme linked immunosorbent assay (ELISA) using immobilized polypeptide. If desired, the antibody molecules directed against the polypeptide can be isolated from the mammal (e.g., from the blood) and further purified by well-known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybridoma technique originally described by Kohler and Milstein, *Nature,* 256:495 (1975), the human B cell hybridoma technique (Kozbor et al., *Immunol. Today,* 4:72 (1983)), the EBV-hybridoma technique (Cole et al., *Monoclonal Antibodies and Cancer Therapy*, Alan R. Liss (1985) Inc., pp. 77-96) or trioma techniques. The technology for producing hybridomas is well known (see generally *Current Protocols in Immunology* (1994) Coligan et al., (eds.) John Wiley & Sons, Inc., New York, N.Y.). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds a polypeptide of the disclosure.

Any of the many well-known protocols used for fusing lymphocytes and immortalized cell lines can be applied for the purpose of generating a monoclonal antibody to a polypeptide of the disclosure (see, e.g., *Current Protocols in Immunology*, supra; Galfre et al., *Nature,* 266:55052 (1977); R. H. Kenneth, in *Monoclonal Antibodies: A New Dimension In Biological Analyses*, Plenum Publishing Corp., New York, N.Y. (1980); and Lerner, *J. Biol. Med.,* 54:387 (1981)). Moreover, the ordinarily skilled worker can appreciate that there are many variations of such methods that also would be useful. Alternative to preparing monoclonal antibody-secreting hybridomas, a monoclonal antibody to a polypeptide of the disclosure can be identified and isolated by screening a recombinant combinatorial immunoglobulin library (e.g., an antibody phage display library) with the polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP$^a$ Phage Display Kit, Catalog No. 240612). Additionally, examples of methods and reagents particularly amenable for use in generating and screening antibody display library can be found in, for example, U.S. Pat. No. 5,223,409; PCT Publication Nos. WO 92/18619, WO 91/17271, WO 92/20791, WO 92/15679; WO 93/01288, WO 92/01047, WO 92/09690, and WO 90/02809; Fuchs et al., *Bio/Technology,* 9:1370 (1991); Hay et al., *Hum. Antibod. Hybndology,* 3:81 (1992); Huse et al., *Science,* 246:1275 (1989); and Griffiths et al., *EMBO J.,* 12:725 (1993).

Additionally, recombinant antibodies, such as chimeric and humanized monoclonal antibodies, comprising both human and non-human portions, which can be made using standard recombinant DNA techniques, are within the scope of the disclosure. Such chimeric and humanized monoclonal antibodies can be produced by recombinant DNA techniques known in the art.

In general, antibodies of the disclosure (e.g., a monoclonal antibody) can be used to isolate a polypeptide of the disclosure by standard techniques, such as affinity chromatography or immunoprecipitation. A polypeptide-specific antibody can facilitate the purification of natural polypeptide from cells and of recombinants produced polypeptide expressed in host cells Moreover, an antibody specific for a polypeptide of the disclosure can be used to detect the polypeptide (e.g., in a cellular lysate, cell supernatant, or tissue sample) in order to evaluate the abundance and pattern of expression of the polypeptide. Antibodies can be used diagnostically, prognostically, or theranostically to monitor protein levels in tissue as part of a clinical testing procedure, e.g., to, for example, determine the efficacy of a given treatment regimen. The antibody can be coupled to a detectable substance to facilitate its detection. Examples of detectable substances include various enzymes, prosthetic groups, fluorescent materials, luminescent materials, bioluminescent materials, and radioactive materials. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotnazinylamine fluorescein, dansyl chloride or phycoerythnn; an example of a luminescent material includes luminol; examples of bioluminescent materials include luciferase, luciferin, and aequorin, and examples of suitable radioactive material include $^{125}$I, $^{131}$I, $^{35}$S or $^{3}$H. Antibodies can also be useful in pharmacogenomic analysis. In such embodiments, antibodies against variant proteins encoded by nucleic acids according to the disclosure, such as variant proteins that are encoded by nucleic acids that contain at least one genetic variation of the disclosure, can be used to identify individuals that can benefit from modified treatment modalities.

Antibodies can furthermore be useful for assessing expression of variant proteins in disease states, such as in active stages of a disease, or in an individual with a predisposition to a disease related to the function of the protein, in particular EN. Antibodies specific for a variant protein of the present disclosure that is encoded by a nucleic acid that comprises at least one polymorphic marker or haplotype as described herein can be used to screen for the presence of the variant protein, for example to screen for a predisposition to EN as indicated by the presence of the variant protein.

Antibodies can be used in other methods. Thus, antibodies are useful as screening tools for evaluating proteins, such as variant proteins of the disclosure, in conjunction with analysis by electrophoretic mobility, isoelectric point, tryptic or other protease digest, or for use in other physical assays known to those skilled in the art. Antibodies can also be used in tissue typing. In one such embodiment, a specific variant protein has been correlated with expression in a specific tissue type, and antibodies specific for the variant protein can then be used to identify the specific tissue type.

Subcellular localization of proteins, including variant proteins, can also be determined using antibodies, and can be applied to assess aberrant subcellular localization of the protein in cells in various tissues. Such use can be applied in genetic testing, but also in monitoring a particular treatment modality. In the case where treatment is aimed at correcting the expression level or presence of the variant protein or aberrant tissue distribution or, for instance, endometrial or blood cell expression of the variant protein, antibodies specific for the variant protein or fragments thereof can be used to monitor therapeutic efficacy.

Antibodies are further useful for inhibiting variant protein function, for example by blocking the binding of a variant protein to a binding molecule or partner. Such uses can also be applied in a therapeutic context in which treatment involves inhibiting a variant protein's function. An antibody can be for example be used to block or competitively inhibit binding, thereby modulating (i.e., agonizing or antagonizing) the activity of the protein. Antibodies can be prepared against specific protein fragments containing sites for specific function or against an intact protein that is associated with a cell or cell membrane.

The present disclosure also embodies the use of any pharmacologic agent that can be conjugated to an antibody or an antibody binding fragment, and delivered in active form. Examples of such agents include cytotoxins, radioisotopes, hormones such as a steroid, anti-metabolites such as cytosines, and chemotherapeutic agents. Other embodiments can include agents such as a coagulant, a cytokine, growth factor, bacterial endotoxin or a moiety of bacterial endotoxin. The targeting antibody-based agent directs the toxin to, and thereby selectively modulates the cell expressing the targeted surface receptor. In some embodiments, therapeutic antibodies employ cross-linkers that provide high in vivo stability (Thorpe et al., *Cancer Res.*, 48:6396 (1988)). In any event, it is proposed that agents such as these can, if desired, be successfully conjugated to antibodies or antibody binding fragments, in a manner that can allow their targeting, internalization, release or presentation at the site of the targeted cells expressing the EN associated biomarkers using known conjugation technology. For administration in vivo, for example, an antibody can be linked with an additional therapeutic payload, such as radionuclide, an enzyme, an immunogenic epitope, or a cytotoxic agent, including bacterial toxins (diphtheria or plant toxins, such as ricin). The in vivo half-life of an antibody or a fragment thereof can be increased by pegylation through conjugation to polyethylene glycol.

Methods of Treatment

One embodiment of the present disclosure relates to methods of using pharmaceutical compositions and kits comprising agents that can reduce or increase the function and/or activity of polypeptides and/or nucleic acids that are associated with EN to inhibit or decrease EN progression. Another embodiment of the present disclosure provides methods, pharmaceutical compositions, and kits for the treatment of animal subjects. The term "animal subject" as used herein includes humans as well as other mammals. The term "treating" as used herein includes achieving a therapeutic benefit and/or a prophylactic benefit. By therapeutic benefit is meant eradication or amelioration of the underlying cause of EN. Also, a therapeutic benefit is achieved with the eradication or amelioration of one or more of the physiological symptoms associated EN such that an improvement is observed in the animal subject, notwithstanding the fact that the animal subject can still be afflicted with EN.

For embodiments where a prophylactic benefit is desired, a pharmaceutical composition of the disclosure can be administered to a subject at risk of developing EN, or to a subject reporting one or more of the physiological symptoms of EN, even though a screening of the condition cannot have been made. Administration can prevent EN from developing, or it can reduce, lessen, shorten and/or otherwise ameliorate the progression of EN, or symptoms that develop. The pharmaceutical composition can modulate a target EN associated biomarker. Wherein, the term modulate includes inhibition of EN associated biomarkers or alternatively activation of EN associated biomarkers.

Reducing the activity and/or function of polypeptides and/or nucleic acids found to be associated with EN, is also referred to as "inhibiting" the polypeptides and/or nucleic acids. The term "inhibits" and its grammatical conjugations, such as "inhibitory," do not require complete inhibition, but refer to a reduction in EN associated biomarkers' activities. In some embodiments, such reduction is by at least 5%, at least 10%, at least 20%, at least 30%, at least 40%, at least 50%, at least 75%, at least 90%, and can be by at least 95% of the activity of the enzyme in the absence of the inhibitory effect, e.g., in the absence of an inhibitor. Conversely, the phrase "does not inhibit" and its grammatical conjugations refer to situations where there is less than 20%, less than 10%, and can be less than 5%, of reduction in enzyme activity in the presence of the agent. Further the phrase "does not substantially inhibit" and its grammatical conjugations refer to situations where there is less than 30%, less than 20%, and in some embodiments less than 10% of reduction in enzyme activity in the presence of the agent.

Increasing the activity and/or function of polypeptides and/or nucleic acids found to be associated with EN, is also referred to as "activating" the polypeptides and/or nucleic acids. The term "activated" and its grammatical conjugations, such as "activating," do not require complete activation, but refer to an increase in EN associated biomarkers' activities. In some embodiments such increase is by at least 5%, at least 10%, at least 20%, at least 30%, at least 40%, at least 50%, at least 60%, at least 70%, at least 75%, at least 80%, at least 85%, at least 90%, and can be by at least 95% of the activity of the enzyme in the absence of the activation effect, e.g., in the absence of an activator. Conversely, the phrase "does not activate" and its grammatical conjugations refer to situations where there can be less than 20%, less than 10%, and less than 5%, of an increase in enzyme activity in the presence of the agent. Further the phrase "does not substantially activate" and its grammatical conjugations refer to situations where there is less than 30%, less than 20%, and in some embodiments less than 10% of an increase in enzyme activity in the presence of the agent.

The ability to reduce enzyme activity is a measure of the potency or the activity of an agent, or combination of agents, towards or against the enzyme. Potency can be measured by cell free, whole cell and/or in vivo assays in terms of IC50, Ki and/or ED50 values. An IC50 value represents the concentration of an agent to inhibit enzyme activity by half (50%) under a given set of conditions. A Ki value represents the equilibrium affinity constant for the binding of an inhibiting agent to the enzyme. An ED50 value represents the dose of an agent to affect a half-maximal response in a biological assay. Further details of these measures will be appreciated by those of ordinary skill in the art, and can be found in standard texts on biochemistry, enzymology, and the like.

The present disclosure also includes kits that can be used to treat EN. These kits comprise an agent or combination of agents that inhibits an EN associated biomarker and in some embodiments instructions teaching the use of the kit according to the various methods and approaches described herein. Such kits can also include information, such as scientific literature references, package insert materials, clinical trial results, and/or summaries of these and the like, which indicate or establish the activities and/or advantages of the agent. Such information can be based on the results of various studies, for example, studies using experimental animals involving in vivo models and studies based on human clinical trials. Kits described herein can be provided, marketed and/or promoted to health providers, including physicians, nurses, pharmacists, formulary officials, and the like.

Kits

Kits useful in the methods of the disclosure comprise components useful in any of the methods described herein, including for example, primers for nucleic acid amplification, hybridization probes for detecting genetic variation, or other marker detection, restriction enzymes, nucleic acid probes, optionally labeled with suitable labels, allele-specific oligonucleotides, antibodies that bind to an altered polypeptide encoded by a nucleic acid of the disclosure as described herein or to a wild type polypeptide encoded by a nucleic acid of the disclosure as described herein, means for amplification of genetic variations or fragments thereof, means for analyzing the nucleic acid sequence of nucleic acids comprising genetic variations as described herein, means for analyzing the amino acid sequence of a polypeptide encoded by a genetic variation, or a nucleic acid associated with a genetic variation, etc. The kits can for example include necessary buffers, nucleic acid primers for amplifying nucleic acids, and reagents for allele-specific detection of the fragments amplified using such primers and necessary enzymes (e.g., DNA polymerase). Additionally, kits can provide reagents for assays to be used in combination with the methods of the present disclosure, for example reagents for use with other screening assays for EN.

In some embodiments, the disclosure pertains to a kit for assaying a sample from a subject to detect the presence of a genetic variation, wherein the kit comprises reagents necessary for selectively detecting at least one particular genetic variation in the genome of the individual. In some embodiments, the disclosure pertains to a kit for assaying a sample from a subject to detect the presence of at least particular allele of at least one polymorphism associated with a genetic variation in the genome of the subject. In some embodiments, the reagents comprise at least one contiguous oligonucleotide that hybridizes to a fragment of the genome of the individual comprising at least genetic variation. In some embodiments, the reagents comprise at least one pair of oligonucleotides that hybridize to opposite strands of a genomic segment obtained from a subject, wherein each oligonucleotide primer pair is designed to selectively amplify a fragment of the genome of the individual that includes at least one genetic variation, or a fragment of a genetic variation. Such oligonucleotides or nucleic acids can be designed using the methods described herein. In some embodiments, the kit comprises one or more labeled nucleic acids capable of allele-specific detection of one or more specific polymorphic markers or haplotypes with a genetic variation, and reagents for detection of the label. In some embodiments, a kit for detecting SNP markers can comprise a detection oligonucleotide probe, that hybridizes to a segment of template DNA containing a SNP polymorphisms to be detected, an enhancer oligonucleotide probe, detection probe, primer and/or an endonuclease, for example as described by Kutyavin et al. (*Nucleic Acid Res.*, 34:e128 (2006)).

In some embodiments, the DNA template is amplified by any means of the present disclosure, prior to assessment for the presence of specific genetic variations as described herein. Standard methods well known to the skilled person for performing these methods can be utilized, and are within scope of the disclosure. In one such embodiment, reagents for performing these methods can be included in the reagent kit.

In a further aspect of the present disclosure, a pharmaceutical pack (kit) is provided, the pack comprising a therapeutic agent and a set of instructions for administration of the therapeutic agent to humans screened for one or more variants of the present disclosure, as disclosed herein. The therapeutic agent can be a small molecule drug, an antibody, a peptide, an antisense or RNAi molecule, or other therapeutic molecules as described herein. In some embodiments, an individual identified as a carrier of at least one variant of the present disclosure is instructed to take a prescribed dose of the therapeutic agent. In one such embodiment, an individual identified as a carrier of at least one variant of the present disclosure is instructed to take a prescribed dose of the therapeutic agent. In some embodiments, an individual identified as a non-carrier of at least one variant of the present disclosure is instructed to take a prescribed dose of the therapeutic agent.

Also provided herein are articles of manufacture, comprising a probe that hybridizes with a region of human chromosome as described herein and can be used to detect a polymorphism described herein. For example, any of the probes for detecting polymorphisms described herein can be combined with packaging material to generate articles of manufacture or kits. The kit can include one or more other elements including: instructions for use; and other reagents such as a label or an agent useful for attaching a label to the probe. Instructions for use can include instructions for screening applications of the probe for making a diagnosis, prognosis, or theranosis to EN in a method described herein. Other instructions can include instructions for attaching a label to the probe, instructions for performing in situ analysis with the probe, and/or instructions for obtaining a sample to be analyzed from a subject. In some cases, the kit can include a labeled probe that hybridizes to a region of human chromosome as described herein.

The kit can also include one or more additional reference or control probes that hybridize to the same chromosome or another chromosome or portion thereof that can have an abnormality associated with a particular endophenotype. A kit that includes additional probes can further include labels, e.g., one or more of the same or different labels for the probes. In other embodiments, the additional probe or probes provided with the kit can be a labeled probe or probes. When the kit further includes one or more additional probe or probes, the kit can further provide instructions for the use of the additional probe or probes. Kits for use in self-testing can also be provided. Such test kits can include devices and instructions that a subject can use to obtain a biological sample (e.g., buccal cells, blood) without the aid of a health care provider. For example, buccal cells can be obtained using a buccal swab or brush, or using mouthwash.

Kits as provided herein can also include a mailer (e.g., a postage paid envelope or mailing pack) that can be used to return the sample for analysis, e.g., to a laboratory. The kit can include one or more containers for the sample, or the sample can be in a standard blood collection vial. The kit can also include one or more of an informed consent form, a test requisition form, and instructions on how to use the kit in a method described herein. Methods for using such kits are also included herein. One or more of the forms (e.g., the test requisition form) and the container holding the sample can be coded, for example, with a bar code for identifying the subject who provided the sample.

In some embodiments, an in vitro screening test can comprise one or more devices, tools, and equipment configured to collect a genetic sample from an individual. In some embodiments of an in vitro screening test, tools to collect a genetic sample can include one or more of a swab, a scalpel, a syringe, a scraper, a container, and other devices and reagents designed to facilitate the collection, storage, and transport of a genetic sample. In some embodiments, an in vitro screening test can include reagents or solutions for collecting, stabilizing, storing, and processing a genetic sample.

Such reagents and solutions for nucleotide collecting, stabilizing, storing, and processing are well known by those of skill in the art and can be indicated by specific methods used by an in vitro screening test as described herein. In some embodiments, an in vitro screening test as disclosed herein, can comprise a microarray apparatus and reagents, a flow cell apparatus and reagents, a multiplex nucleotide sequencer and reagents, and additional hardware and software necessary to assay a genetic sample for certain genetic markers and to detect and visualize certain genetic markers.

The present disclosure further relates to kits for using antibodies in the methods described herein. This includes, but is not limited to, kits for detecting the presence of a variant protein in a test sample. One embodiment comprises antibodies such as a labeled or labelable antibody and a compound or agent for detecting variant proteins in a biological sample, means for determining the amount or the presence and/or absence of variant protein in the sample, and means for comparing the amount of variant protein in the sample with a standard, as well as instructions for use of the kit. In certain embodiments, the kit further comprises a set of instructions for using the reagents comprising the kit.

Unless otherwise explained, all technical and scientific terms used herein have the same meaning as commonly understood by one of ordinary skill in the art to which this disclosure belongs. The following references contain embodiments of the methods and compositions that can be used herein: *The Merck Manual of Diagnosis and Therapy*, 18th Edition, published by Merck Research Laboratories, 2006 (ISBN 0-911910-18-2); Benjamin Lewin, *Genes IX*, published by Jones & Bartlett Publishing, 2007 (ISBN-13: 9780763740634); Kendrew et al. (eds.), *The Encyclopedia of Molecular Biology*, published by Blackwell Science Ltd., 1994 (ISBN 0-632-02182-9); and Robert A. Meyers (ed.), *Molecular Biology and Biotechnology: a Comprehensive Desk Reference*, published by VCH Publishers, Inc., 1995 (ISBN 1-56081-569-8).

Standard procedures of the present disclosure are described, e.g., in Maniatis et al., *Molecular Cloning: A Laboratory Manual*, Cold Spring Harbor Laboratory Press, Cold Spring Harbor, N.Y., USA (1982); Sambrook et al., *Molecular Cloning: A Laboratory Manual* (2 ed.), Cold Spring Harbor Laboratory Press, Cold Spring Harbor, N.Y., USA (1989); Davis et al., *Basic Methods in Molecular Biology*, Elsevier Science Publishing, Inc., New York, USA (1986); or *Methods in Enzymology: Guide to Molecular Cloning Techniques*, Vol. 152, S. L. Berger and A. R. Kimmerl (eds.), Academic Press Inc., San Diego, USA (1987)). *Current Protocols in Molecular Biology* (CPMB) (Fred M. Ausubel, et al. ed., John Wiley and Sons, Inc.), *Current Protocols in Protein Science* (CPPS) (John E. Coligan, et. al., ed., John Wiley and Sons, Inc.), *Current Protocols in Immunology* (CPI) (John E. Coligan, et. al., ed. John Wiley and Sons, Inc.), *Current Protocols in Cell Biology* (CPCB) (Juan S. Bonifacino et. al. ed., John Wiley and Sons, Inc.), *Culture of Animal Cells: A Manual of Basic Technique* by R. Ian Freshney, Publisher: Wiley-Liss; 5th edition (2005), and *Animal Cell Culture Methods* (Methods in Cell Biology, Vol. 57, Jennie P. Mather and David Barnes editors, Academic Press, 1st edition, 1998), which are all incorporated by reference herein in their entireties.

It should be understood that the following examples should not be construed as being limiting to the particular methodology, protocols, and compositions, etc., described herein and, as such, can vary. The following terms used herein is for the purpose of describing particular embodiments only, and is not intended to limit the scope of the embodiments disclosed herein.

Disclosed herein are molecules, materials, compositions, and components that can be used for, can be used in conjunction with, can be used in preparation for, or are products of methods and compositions disclosed herein. It is understood that when combinations, subsets, interactions, groups, etc. of these materials are disclosed and while specific reference of each various individual and collective combinations and permutation of these molecules and compounds cannot be explicitly disclosed, each is specifically contemplated and described herein. For example, if a nucleotide or nucleic acid is disclosed and discussed and a number of modifications that can be made to a number of molecules including the nucleotide or nucleic acid are discussed, each and every combination and permutation of nucleotide or nucleic acid and the modifications that are possible are specifically contemplated unless specifically indicated to the contrary. This concept applies to all aspects of this application including, but not limited to, steps in methods of making and using the disclosed molecules and compositions. Thus, if there are a variety of additional steps that can be performed it is understood that each of these additional steps can be performed with any specific embodiment or combination of embodiments of the disclosed methods, and that each such combination is specifically contemplated and should be considered disclosed.

Those skilled in the art can recognize, or be able to ascertain using no more than routine experimentation, many equivalents to the specific embodiments of the method and compositions described herein. Such equivalents are intended to be encompassed by the following claims.

It is understood that the disclosed methods and compositions are not limited to the particular methodology, protocols, and reagents described as these can vary. It is also to be understood that the terminology used herein is for the purpose of describing particular embodiments only, and is not intended to limit the scope of the present disclosure which can be limited only by the appended claims.

Unless defined otherwise, all technical and scientific terms used herein have the meanings that would be commonly understood by one of skill in the art in the context of the present specification.

It should be noted that as used herein and in the appended claims, the singular forms "a," "an," and "the" include plural reference unless the context clearly dictates otherwise. Thus, for example, reference to "a nucleotide" includes a plurality of such nucleotides; reference to "the nucleotide" is a reference to one or more nucleotides and equivalents thereof known to those skilled in the art, and so forth.

The term "and/or" shall in the present context be understood to indicate that either or both of the items connected by it are involved. While preferred embodiments of the present disclosure have been shown and described herein, it can be obvious to those skilled in the art that such embodiments are provided by way of example only. Numerous variations, changes, and substitutions can now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

The invention will be further described by the following non-limiting examples.

Example 1

The present invention is not based on finding common variants that increase the risk for or cause disease, but rather rare variants. In this context 'rare' refers to variants that are present/observed in disease cohorts at a certain frequency but never or almost never in normal (non-disease or unaffected) subjects. 'Rare' refers to the frequency in normal cohorts, but not necessarily in disease cohorts. Thus, a variant may actually be 'common' in the disease cohort but if absent or present at low frequency in a normal cohort, it would be classed as a 'rare' variant. The present invention is based on a discovery method that differs from traditional 'common variant' studies which, by design, typically identify weak associations between variants and disease (e.g., with low odds ratios of <1.5), since the variants being studied are known, in advance, to be present at an appreciable frequency in normal/unaffected subjects. As an example, consider the TGFBR3 deletion found in 3/100 EN cases but in 0/1,005 normal subjects (see FIG. 5). This deletion is clearly 'very rare' in normal subjects (found in the study described herein at 0% frequency) but this is not so in the EN cohort (the deletion is found at a frequency of 3%). While there is no specific frequency cutoff that defines a variant as rare or common, it is generally accepted by those skilled in the art and the genetics field that rare variants occur at <1% frequency in the general population (i.e., the presence of the TGFBR3 deletion in the EN cohort at 3% frequency would be considered a 'common' variant by this general cutoff used for the population at large). The discovery methodology described herein is able to detect rare variants because it is not limited to the analysis of previously known variants, as is the case with the common variant SNP-based genome-wide association studies (GWAS) that have been employed by many skilled in the art for the discovery of genes that are causal or associated with the disease being studied. Thus, for a complex disease such EN, the present method identifies single highly causal genes and rare gene variations including intragenic regions or nongenic (intergenic) regions. Data was generated on the basis of a comparison of copy number variants (CNVs) identified in 2 cohorts: 1,005 Normal individuals (Normal Variation Engine—NVE); and 100 endometriosis (EN) cases.

Genomic DNA Sample Hybridization

Genomic DNA samples from individuals within the Normal cohort (NVE 'test' subjects) and from the Endo cohort (Endo 'test' subjects) were hybridized against a single, sex-matched reference individual as follows. Reference DNA samples were labeled with Cy5 and test subject DNA samples were labeled with Cy3. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 2 μm resolution, using Agilent's DNA microarray scanner, generating tiff images for later analysis.

All tiff images were analyzed using Agilent Feature Extraction (FE) software, with the following settings:
Human Genome Freeze: hg18:NCBI36:Mar2006
FE version: 10.7.3.1
Grid/design file: 021529_D_F_20091001
Protocol: CGH_107_Sep09

This procedure generates a variety of output files, containing about 1,000,000 rows of data, each corresponding to a specific feature on the array. This file was used to perform CNV calling using DNAcopy, an open source software package implemented in R via BioConductor (http://www-.bioconductor.org/packages/release/bioc/html/DNA-copy.html). Losses or gains were determined according to a threshold $\log_2$ ratio, which was set at −/+0.35. In other words, all losses with a $\log_2$ ratio value $<=-0.35$ were counted, as were all gains with a $\log_2$ ratio $>=+0.35$. All $\log_2$ ratio values were determined according to Cy3/Cy5 (Test/Reference). A minimum probe threshold for CNV-calling was set at 2 (2 consecutive probes were sufficient to call a CNV). A CNV list was thus generated for each individual in the 2 cohorts.

There were a total of 162,316 CNVs in the NVE cohort of 1,005 individuals (an average of 162 CNVs per individual). These CNVs (many of which appeared in multiple individuals) were 'merged' into a master list (NVE-master) of non-redundant CNV subregions, according to the presence or absence of the CNV subregion in individuals within the cohort. Using this approach, the NVE-master list has 14,693 distinct CNV subregions, some of which are uniquely present in a single individual and some of which are present in multiple individuals. For example, consider 3 individuals within the NVE cohort with the following hypothetical CNVs:
A. Chr1:1-100,000;
B. Chr1:10,001-100,000;
C. Chr1:1-89,999;

In the master list, these would be merged into 3 distinct CNV subregions, as follows:

| CNV subregion 1 | Chr1: 1-10,000 | Patients A, C |
| CNV subregion 2 | Chr1: 10,001-89,999 | Patients A, B, C |
| CNV subregion 3 | Chr1: 90,000-100,000 | Patients A, B |

There were a total of 16,577 CNVs in the EN cohort of 100 individuals (an average of 166 CNVs per individual). These CNVs (many of which appeared in multiple individuals) were 'merged' into a master list (EN-master) of non-redundant CNV subregions, according to the presence or absence of the CNV subregion in individuals within the cohort. Using this approach, the EN-master list has 3,408 distinct CNV subregions, some of which are uniquely present in a single individual and some of which are present in multiple individuals.

CNV subregions of interest were obtained after:
1. Annotation in order to attach to each CNV region relevant information regarding overlap with known genes and exons;
2. A calculation of the odds ratio (OR) for each CNV subregion, according to the following formula:

$$*OR=(EN/(100-EN))/(NVE/(1005-NVE))$$

where:
EN=number of EN individuals with CNV subregion of interest
NVE=number of NVE individuals with CNV subregion of interest.

As an illustrative example, consider the CNV subregion chr1:92013987-92020793, which is found in 0 individuals in the NVE cohort and 3 individuals in the EN cohort.
The OR is:

$$(3.5/(97.5))/(0.5/(1005.5))=72.19$$

Note that, by one convention, if either of NVE or EN=0, a value of 0.5 is added to all 4 entries in the main formula above, in order to avoid dealing with infinities. This has the effect of artificially lowering OR values in cases where no individuals within the NVE have the CNV. This method is also used when calculating the Fisher's 2-tailed Exact Test (FET) in the event that any one of the variables is zero.

CNV subregions/genes that fulfill one of the following criteria were identified (see FIG. 1):
1. Strong biology linking the CNV subregion and/or the gene it overlaps, with known pathways/mechanisms or biology in EN (in some cases, statistical evidence is lacking but does not exclude the CNV subregion as a candidate);
2. Statistical analysis without obvious biological connection (FDR adjusted p-value <=0.05);
3. A combination of statistical significance and biology.

It can be appreciated by those skilled in the art that the number of EN candidate CNV subregions, irrespective of category, may increase or decrease as additional EN cohorts are analyzed.

FIG. 1 lists exemplary CNVs of interest. FIG. 2 shows the CNV coordinates for the actual CNV subregions found to be unique or significantly different between the disease and normal cohorts, as opposed to FIG. 1, which lists the original CNV coordinates. FIG. 2 also details whether genic CNV subregions of interest overlap an exon or not and the number of normal subjects and the number of disease subjects that harbor the relevant CNV subregion, reports Fisher's 2-tailed Exact Test (FET) and odds ratio (OR), and provides the category under which the CNV subregion falls with respect to statistical and/or biological significance as discussed above. FIG. 3 represents a non-redundant list for all genes listed in FIG. 2. For all genes listed in FIG. 2, FIG. 4 represents a non-redundant list of relevant RNA transcripts. Table I summarizes biology and uterus expression data for genes impacted by CNVs/CNV subregions of interest (NA=data or information 'not available').

The sequence file 3886.001PRV_ST25.txt contains genomic sequence information for (in the following order): All distinct CNVs listed in FIG. 1 (SEQ ID NOs: 1-47) and the full genomic extent of the transcripts listed in FIG. 4 (SEQ ID NOs: 48-149).

Examples of Sequences:

```
Sequence entry starts:
SEQ_ID 1 = 6,806bp CNV (loss) involving an intron of the gene TGFBR3:
1
<211> 6807
<212> DNA
<213> Homo sapiens
<400> 1
actgaaacat tcattttcca agattcctttt ccaaattcaa ctccatggtc tttcttttgt         60
ctgttttgct aaagggcaaa atactaacct gtttccaagc tattcagcaa tattttggca        120
caggtaatcc agtaagagaa ttgtttgtat agaacagagc tgatgttaat aacagggtgc        180
......................................................(sequence
truncated for brevity)

aaagcactgc ttgcacatcg actgacctga ggttgagagg aggagcagag gaatgtggaa       6720
aggattgttt ttaccttcat taagtgttaa atttacctaa gactcccaga gagtcaatgc       6780
tcttcaggaa ctattctgag gcagaaa                                          6807
Sequence entry ends.

Sequence entry starts:
SEQ_ID 149 = GPR111, transcript NM_153839, which is 41,208bp in length:
<210> 149
<211> 41208
<212> DNA
<213> Homo sapiens
<400> 149
gcaaggtatg acagaagaga gccagtaatg cccatatctc cagctgccag ggagtggggc         60
aaatttgccg gtgagtttgt ctttggccag ccacagtgag tagtcccagg tcctccttct        120
ccttccagtg acttcctttg gagaggaatt tcagagatga gcagccactc atgattttgt        180
......................................................(sequence truncated for brevity)

cctttggtc ttttgtgtg catatgtata tgttttgggg aatggggtat tcacttttgt       41100
```

```
tactcactgt gttactcact tttgtatgcc catagtgcag agcatggtgc cttgtacata    41160
gagtatgttc ggtaaatatg tgcaataaaa agtcctttga ttacacaa                 41208
Sequence entry ends.
```

TABLE I

Biological notes for genes impacted by CNVs/CNV Subregions of Interest

| CHR | START | STOP | Gene_symbol | Expression_data_uterus | Biology_notes | PubMed_PMID_No |
|---|---|---|---|---|---|---|
| 1 | 92,013,987 | 92,020,793 | TGFBR3 | yes | One of several TGF beta superfamily members involved in endometrial function, links to CNV-identified endometriosis candidates TGFB1I1 (Hic-5) and PTK2 (FAK) | 11912285, 15745937, 16613890, 16621788, 16885531, 21261473, 22562249, 23242524 |
| 23 | 149,901,706 | 149,902,701 | HMGB3 | yes | Family member HMGB1 expressed in endometrium and regulated by estradiol, progesterone, and nitric oxide | 18483013, 22014880 |
| 23 | 149,902,702 | 149,904,265 | HMGB3 | yes | Family member HMGB1 expressed in endometrium and regulated by estradiol, progesterone, and nitic oxide | 18483013, 22014880 |
| 6 | 96,610,680 | 96,625,609 | FUT9 | yes | Link between FUT9 (fucosyltransferase) and SELE (e-selectin) and endometrial, 16 PubMed citations for "fucosyltransferase AND endometrial", 15 PubMed citations for "e-selectin AND endometrial", 7 PubMed citations "e-selectin AND endometriosis" | 7627975, 23192350 |
| 7 | 31,844,434 | 31,851,158 | PDE1C | no | Regulates collagen homeostasis and is a key regulator of pathological vascular remodeling and CNV-identified endometriosis candidate TGFB1I1 (Hic-5) is linked to vascular remodeling and endometriosis, PDE1C maps to linkage peak 7p13-15 for endometriosis | 9366577, 18335582, 21112686, 21148428, 21576276, 21962439, 22472216 |
| 10 | 59,620,764 | 59,630,493 | IPMK | no | IPMK linked to p53 and 95 PubMed citations for "p53 AND endometriosis", IPMK linked to mTor and 8 PubMed citations for "mtor AND endometriosis" plus 111 PubMed citations for "mtor AND endometrial" | 21284988, 23550211, 23708509 |
| 2 | 233,285,559 | 233,298,235 | GIGYF2 | no | IGF-1 expression linked to endometriosis and GYGYF1 and GYGYF2 are transiently linked to IGF-I receptors by the Grb10 adapter protein (GRB10) following IGF-I stimulation, GYGYF2 has also been incorrectly identified as a Parkinson's disease gene (PARK11) | 12771153, 20844834, 23776368 |
| 6 | 138,516,944 | 138,520,155 | intergenic | no | Intergenic and located near KIAA1244 (BIG3), which is linked to estrogen/ER signaling in breast cancer | 19496786 |
| 11 | 44,056,561 | 44,058,123 | ACCS | yes | NA | 11470512, 22543105 |
| 7 | 153,645,525 | 153,647,352 | DPP6 | no | NA | NA |
| 6 | 120,674,750 | 120,680,729 | intergenic | NA | NA | NA |
| 16 | 31,356,038 | 31,434,641 | TGFB1I1 | yes | TGFB1I1 (Hic-5) is a coactivator of the progesterone receptor and may be involved in progesterone resistance observed in some endometriosis patients, linked to vascular remodeling, interacts with CNV-identified endometriosis candidate PTK2 and acts as a scaffold for focal adhesions, TP53 and CDKN1A (p21, WAF1, CIP1) genotypes correlate with endometriosis and TGFB1I1 transactivates CDKN1A, and potential pharmacolgoical link to | 19389829, 21715447, 22472216, 22529104 |

TABLE I-continued

Biological notes for genes impacted by CNVs/CNV Subregions of Interest

| CHR | START | STOP | Gene_symbol | Expression_data_uterus | Biology_notes | PubMed_PMID_No |
|---|---|---|---|---|---|---|
| 8 | 142,060,703 | 142,065,735 | PTK2 | no | HDAC inhibitors, links to CNV-identified endometriosis candidates TGFBR3 (betaglycan) PDE1C, and PTK2 (FAK) PTK2 (FAK) is implicated in endometriosis and endometrial cancer, links to CNV-identified endometriosis candidates TGFB1I1 (Hic-5) and TGFBR3 (betaglycan) | 17543958, 17550607, 18294638, 19471549, 20869705, 21058027, 21900245, 23242524 |
| 4 | 129,189,476 | 129,451,283 | PGRMC2 | yes | Gain of several genes, PGRMC2 has links to endometriosis and progesterone, and expression levels correlate with diminished ovarian reserve (see also CNV-identified endometriosis candidate MYADML) | 22307145, 22355044, 23276631, 23522067 |
| 19 | 41,532,062 | 41,533,404 | ZFP14 | no | NA | NA |
| 1 | 65,627,570 | 65,696,043 | LEPROT, LEPR | yes | CNV may result in gain-of-function for LEPROT and gain-of-function/loss-of-function for LEPR (several transcript variants), disruption of leptin signaling linked to endometriosis, LEPROT is a negative regulator of leptin signaling, LEPR mutations cause reduced fertility, LEPROT (and LEPROTL1) involved in growth hormone signaling, which is implicated in endometrial cancer and endometriosis | 16564564, 17962343, 18450952, 19854659, 20624279, 22265003, 22647716, 23184927, 23634146, 24239717, 24401660, 24845415 |
| 3 | 197,001,562 | 197,065,388 | MUC4 | yes | Complex CNV with 4-step change in copy number and part overlaps with a frequent CNV found in several endometriosis patients and controls, mucin proteins have been detected in normal and pathological endometrial tissues (MUC1 and MUC4 are major major ones expressed in endometriosis), MUC4 SNP associated with endometriosis development and endometriosis-related infertility | 17197898, 21349170 |
| 23 | 148,575,584 | 148,608,166 | MAGEA11 | yes | Complex CNV with duplicated and triplicated regions in a control but CNV is a gain-of-funtion, whereas in the endometriosis patient it loss-of-function (left breakpoint), MAGEA11 is a primate-specific gene and functions as an androgen receptor co-regulator with its mRNA levels expressed in a temporal manner in the endometrium, also found to regulate progesterone receptor during human endometrium development | 18048459, 22891251 |
| 2 | 242,109,998 | 242,153,935 | BOK | yes | Pro-apoptotic protein and apoptosis is linked to endometriosis, highly expressed in ovary, testis, and uterus, role in other reproductive biology (preeclampsia, ovarian development) | 9356461, 19942931, 21196342 |
| 14 | 80,613,390 | 80,649,876 | TSHR | yes | Thyroid hormone receptor protein expression found in macaques, TSHR and thyroid hormone receptors are expressed in human endometrium | 20691434, 22713859, 23806847 |
| 23 | 64,731,495 | 64,811,828 | MSN | no | Implicated in migration rate in endometrial stromal cells from endometriosis patients, MSN and CLDN7 mRNA and protein expression found in endometrial cancer, RNAi-mediated knockdown of related family member ezrin (EZR) reduces migration of endometrial cells in endometriosis, and links to CNV-identified endometriosis candidate TGFB1I1 (via CDKN1A) | 19095664, 19541800, 22225925, 22272721, 22544491, 23856463, 24012495 |

TABLE I-continued

Biological notes for genes impacted by CNVs/CNV Subregions of Interest

| CHR | START | STOP | Gene_symbol | Expression_data_uterus | Biology_notes | PubMed_PMID_No |
|---|---|---|---|---|---|---|
| 2 | 33,773,800 | 33,903,436 | MYADML | no | Associated with diminished ovarian reserve, which is observed in some endometriosis patients | 11209637, 22116950, 23446861 |
| 10 | 104,571,485 | 104,810,431 | CYP17A1 | no | Gain of whole gene for CYP17A1, upregulation found in endometrial cancers, conflicting reports of genotypes correlated wwith endometriosis and endometrial cancer | 11221867, 15823822, 18172694, 20886547, 23609033 |
| 4 | 159,674,653 | 159,683,362 | RXFP1 | NA | RXFP1 (aka LGR7) mRNA expression (and relaxin) are reduced in ectopic endometriotic samples. mRNA expression | 19416175, 20655530 |
| 7 | 30,668,143 | 30,681,882 | CRHR2 | no | Differential expression found in eutopic and ectopic endometrium of endometriosis patients. | 23638035 |
| 19 | 53,252,457 | 53,257,305 | PLA2G4C | no | Involved in endometrial biology and linked to preterm birth; PLA2 enzymes are the rate-limiting step in prostaglandin synthesis and prostaglandins have numerous links endometriosis. | 17459165, 21184677, 22201853, 22658345, 24035605 |
| 2 | 24,798,190 | 24,806,680 | NCOA1 | no | NCOA1 (aka SRC1) is linked to PGR and is proposed to contribute to pathogenesis of endometriosis along with TNF and MMP9. | 22660634 |
| 7 | 139,757,225 | 139,828,667 | MKRN1 | no | Gene family member MKRN3 causes precocious puberty and both endometriosis and precocious puberty involve GnRH and are treatable with GnRH antagonists/agonists. | 23738509, 23817290 |
| 9 | 16,567,785 | 16,576,265 | BNC2 | yes | Involved in pigmentatation in animals and in a zebrafish model results in female infertility; endometriosis and ovarian cancer are associated and BNC2 variants have been associated with ovarian cancer. | 19956727, 21642636 |
| 1 | 16,713,074 | 16,799,710 | NBPF1 | no | NBPF1 interacts with clusterin and 15 PubMed citations for "clusterin AND endometrial" | 20096688, 22211095, 23589125 |
| 15 | 86,943,691 | 86,944,414 | intergenic | NA | Intergenic, 21 Kb upstream of AEN, an apoptosis gene and apoptosis is linked to endometriosis | 18264133, 21196342 |
| 15 | 86,941,339 | 86,943,690 | intergenic | NA | Intergenic, 21 Kb upstream of AEN, an apoptosis gene and apoptosis is linked to endometriosis 21 Kb upstream of AEN, an apoptosis gene and apoptosis is linked to endometriosis | 18264133, 21196342 |
| 2 | 191,869,063 | 191,873,037 | MYO1B | no | Actin expression levels linked to endometriosis and actin; MYO1B and actin links | 15475577, 20080738, 20471271, 22878529, 22735530 |
| 2 | 191,873,038 | 191,874,236 | MYO1B | no | Actin expression levels linked to endometriosis and actin; MYO1B and actin links | 15475577, 20080738, 20471271, 22878529, 22735530 |
| 6 | 47,731,384 | 47,734,315 | GPR111 | no | NA | 22837050 |
| 6 | 70,290,311 | 70,295,413 | intergenic | NA | NA | NA |

Example 2

Pathway analysis software may be used to identify whether the candidate gene is a drug target, which may be FDA-approved, in clinical trials or amenable for development of a new therapeutic. Such information will assist in the design of clinical trials (e.g., patient stratification for genetic subtypes) or will be used to facilitate clinical trials that are in progress, thereby reducing the attrition rate (failure to receive FDA approval) and reducing the time and cost of drug development. When a candidate EN gene is identified as a known drug target of an FDA-approved therapeutic, the drug can be repurposed and approved for use in a new indication (e.g., a cancer or anti-inflammatory agent may be beneficial to EN patients as well). Those skilled in the art will recognize that Phase II and III failures may be rescued with additional clinical trial data that accounts for genetic subtypes, particularly when the drug fails for lack of efficacy. For example, if a drug will be designed or established to target a particular gene defect (e.g., use of an RNAi therapeutic to decrease aberrant overexpression of the gene that is caused by a CNV or other type of genetic variant), it will be expected that only EN patients with that particular genetic subtype will benefit from the targeted therapy.

Example 3

Once a region is identified that has one or more genetic variations associated with EN, probes and/or primers can be prepared to further characterize those variations in test subjects. Targeted sequencing of CNV-identified regions/genes that are associated with EN (FIG. 2) and/or found to have EN-relevant biology (Table I) is a preferred embodiment for further characterization of the genetic findings. Targeted sequencing enables ascertainment of the mutational spectrum in EN patients that are associated with EN. Targeted sequencing can be performed using one or more methods known to those skilled in the art such as, but not limited to, Sanger sequencing of PCR amplified regions, high-throughput sequencing of specific regions of interest, exome sequencing, or whole genome sequencing. Known and novel variants (SNPs/SNVs/indels) identified in sequencing experiments and/or data can be interpreted (mainly for exonic variants, but some adjacent intronic sequence variant data is also available) using NCBI's dbSNP, the Exome Variant Server (EVS) hosted by a website at the University of Washington (evs.gs.washington.edu/EVS/), or the Exome Aggregation Consortium (ExAC) browser hosted by the Broad Institute (http://exac.broadinstitute.org/) to assess their frequency in the general population. In another embodiment, interpretation of EN-associated regions/genes identified on the basis of CNVs can be performed on pre-existing exome or whole genome sequence data (i.e., targeted interpretation). It can be appreciated by those skilled in the art that the genome search space for identifying other EN-associated variants is dramatically reduced by performing targeted sequencing and/or targeted interpretation of CNV-identified regions of interest (e.g., such analyses may involve sequencing/interpretation of variants present in only 20-30 EN candidate genes as opposed to variants present in all approximately 20,000 genes in the human genome). As described herein, genetic variations in TGFBR3 and PDE1C were found to be associated with EN (FIG. 2). TGFBR3 is one of several TGF beta superfamily members involved in endometrial and placental function, which includes activin/inhibin regulation. TGFBR3 is a proteoglycan that functions as a co-receptor for inhibins (INHA, INHBs) and TGF beta isoforms (TGFBs). TGFBR3 and INHA are down-regulated in endometrial carcinoma, and TGFBR3 is down-regulated in 90% breast cancers (via LOH or at the protein level). Restoring TGFBR3 expression inhibits tumor invasiveness, angiogenesis, and metastasis. Along with ARRB2, TGFBR3 regulates integrin α5β1 (ITGA5/ITGB1) trafficking and focal adhesion formation, which are processes implicated in endometriosis.

PDE1C has high affinity for cAMP and cGMP and is a calmodulin-dependent phosphdiesterase. PDE1C regulates collagen homeostasis and is a key regulator of pathological vascular remodeling. PDE1C (HG18; chr7:31759157-32304908) maps to a linkage peak found in familial endometriosis.

Example 4

The CNV analysis described herein (Example 1) revealed the presence of a 4-probe spanning heterozygous TGFBR3 deletion in 3 individuals with endometriosis (FIG. 5). The deletion is within an intron of TGFBR3 and was predicted, on the basis of the array data, to be at least 6.8 kb in size. Since the deletion was observed in 3 unrelated females, it was suspected that either the deletion occurs recurrently in different families; or the deletion represents an individual mutation that occurred some time ago and is present in descendants of the individual in whom it originally occurred (founder effect).

To determine whether the deletion was associated with EN or was an artifact and to map precise breakpoints at each end of the deletion, in order to define the size, the following experiments were conducted: 3 pairs of PCR primers were designed to amplify putative products of a given size only in those individuals who carried the deletion. One of these primer pairs successfully generated a product of the expected size in the deletion carriers but not in either normal DNA or DNA from an endometriosis patient without the deletion. The primer pair that had successfully generated a product in the deletion carriers was used again to amplify a product in all three carriers, for the purpose of Sanger sequencing. Data from Sanger sequencing revealed confirmation of the presence of the deletion in all 3 carriers; the precise sequence at each breakpoint; the precise size of the deletion (8,071 bp); and the presence of an extra 2 bp between the endpoints ('GG').

This data may be used to generate an even more efficient assay of the presence of the deletion in endometriosis cohorts and will be used as both a screening tool and a diagnostic test.

Methods and Results 3 sets of primers were tested:

```
                                       (SEQ ID NO: 150)
OUTER_FWD      57.21 TTTTTGGTTAAACCCTACATCAC (SEQ ID NO: 151)
OUTER_REV      59.52 TCCCTAGCCCATTTCTAAATCTT (SEQ ID NO: 152)
MIDDLE_FWD     59.55 TCCCTTGCCAGTGGAACTAT (SEQ ID NO: 153)
MIDDLE_REV     59.99 TCGGCCAGAAGAGTCTGTTT (SEQ ID NO: 154)
INNER_FWD      60.05 TGAATTTCTGGGCATGTGAA (SEQ ID NO: 155)
INNER_REV      60.13 GAGAGGCCTGAGCACAAAAG
```

Only primers OUTER_FWD and OUTER_REV generated a product that was specific to the deletion carriers (and yielded negative results in normal DNA and in an individual with endometriosis who did not carry a deletion, based on the 1M array data). These PCR primers were used to amplify a product from all 3 deletion carriers, for the purpose of Sanger sequencing (FIG. 7).

Figure 7:
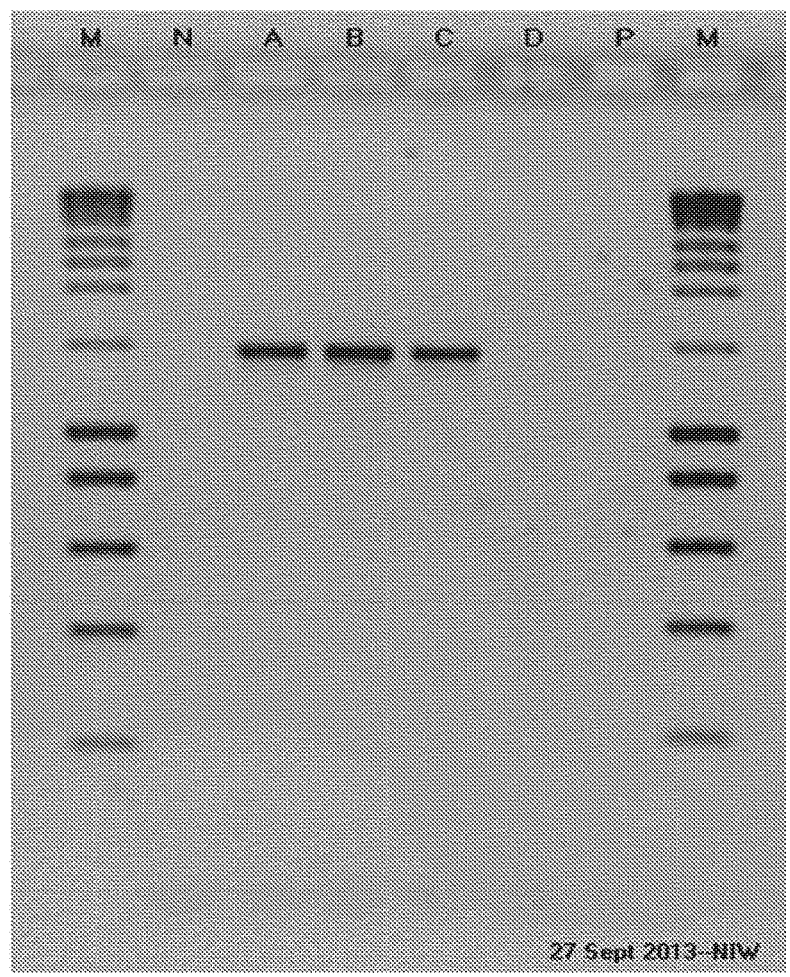
FIG. 7 shows amplification products from the use of a primer set to detect a deletion in TGFRB3. M=marker (Bioline Hyperladder I—200 bp, 400 bp, 600 bp, 800 bp, 1000 bp (bold), 1.5 kb, 2 kb, 2.5 kb, 3 kb, 4 kb, 5 kb, 6 kb, 8 kb, and 10 kb). N=No template control. A=D-001739 template (30 ng). Contains the deletion. B=D-002732 template (30 ng). Contains the deletion. C=D-003697 template (30 ng). Contains the deletion. D=D-001832 template (30 ng). Does not contain the deletion. P=Bioline pooled placental genomic DNA (30 ng).
Figure 8:
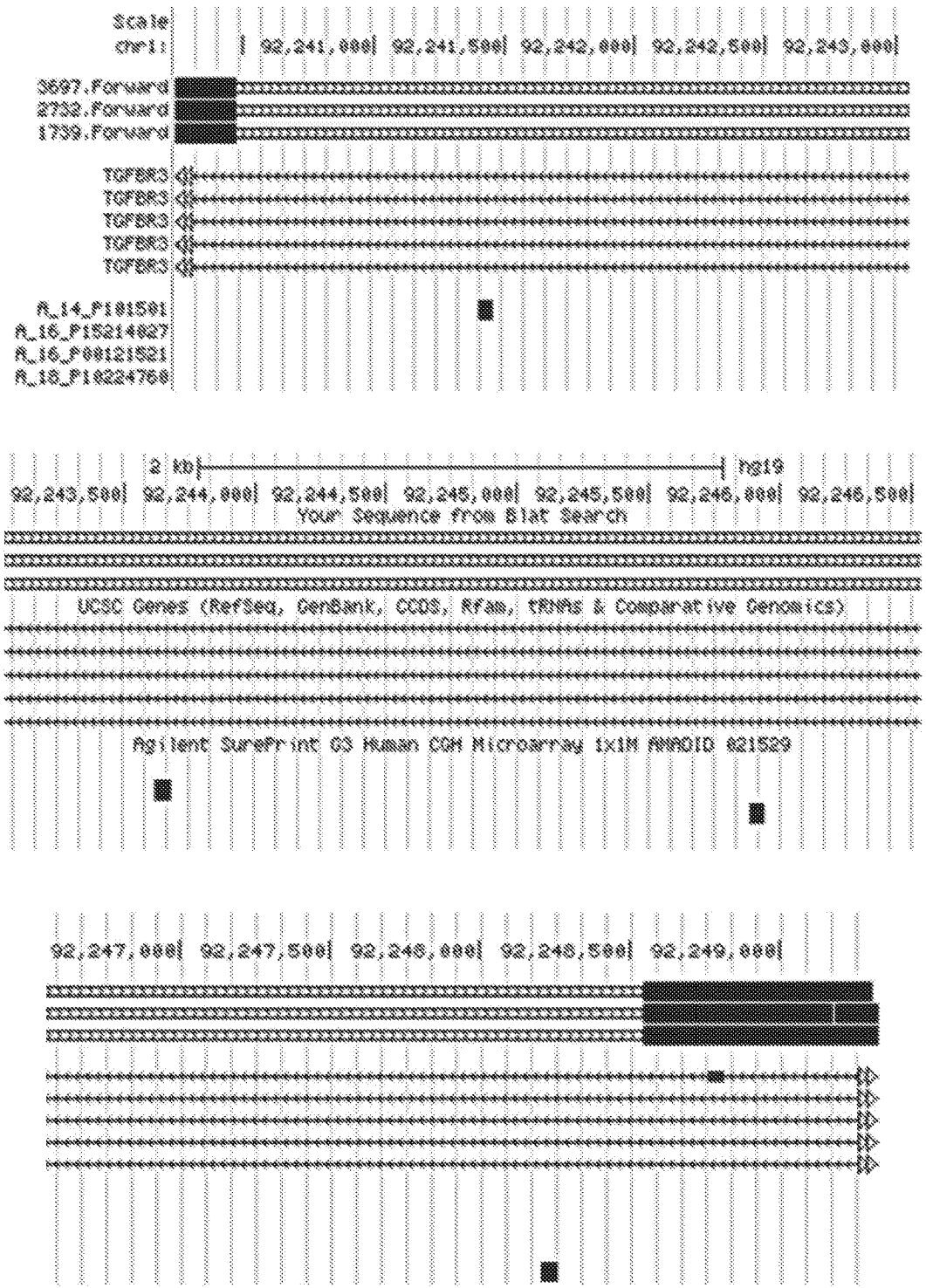
FIG. 8 is a BLAT analysis of Fwd sequence from 3 unrelated endometriosis cases with an approximately 8 kb deletion in an intron of TGFBR3, demonstrating the identical nature of the deletion in all 3 cases and the presence of 4 probes (as observed in the CNV array data herein, see FIG. 5 wherein the 4 probes define a minimal deletion size of approximately 6.8 kb) within the deletion.

The three products shown in FIG. 7 were purified and subjected to Sanger sequencing using the Fwd and Rev primers as sequencing primers. Sequence from the 3 products was queried, using BLAT, at the UCSC server (http://genome.ucsc.edu/cgi-bin/hgBlat?command=start). In each case, the sequence obtained with the Fwd sequencing primers clearly demonstrated the presence of an approximately 8 kb deletion, with apparently identical breakpoints in all 3 individuals (FIG. 8). Further analysis of the sequences revealed the deletion size to be 8,071 bp (which encompassed the expected 4 probes from the Agilent 1M feature (design ID 021529)) and was identical in all 3, unrelated, individuals.

The sequences (hg19 coordinates) obtained were as follows:

>1739.Forward
(SEQ ID NO: 156)
TAATCGACTCATGCGGTGATTGGGAATTCTTTCAGGGCAACAGGCAATGTGTTAAATATG

CACTGTTGAGTACACTGTGCAAAGTTATGAAATTCTCTCTTTCCCTCCTGACATTTTTTT

TTCCAAGTACTTCACTGGCTACTCCAGAAGCAAAGGAATAGAGAAAAGAGTGAAATCAGA

ACTAGTGAGTGGACTTGGTTACTGTAAGATCACTGGTAAAAGTCTGAAAGAAACAAGGT

GGAGCAAATTCAAAATGGATCAGATGTGTGTACACATGTATCAACAAATAGAAGTTAAGC

CATAATGGGCACAAGGGGACACTTCAGCTCCGGGCAAGAGTTAGGCTATGGTAGTGACCT

TGGATCCTAAAGCTGGGCTCTGTCCTTGCTTCACAGTGAGAATCAGTAACACCTCATCTC

ATTAGCTCTCTTATCTTCAAAAGTATCCAAGTCATACCTGTAATTTGCCCCTCATCCTCC

AAGAGTTGTACAAATTTCAGGTTCAGCTGAAGGACTCTGTGGTTCAGGTGAAAAAAAAAG

CCATAAATACAAAGCATTATTGTAGGGTGCTTTGGACTAGAACCCTGTCTAATATCTGGG

CCTTGATATTTCAGCCTTTCAGACAAGGCCAAGGAGCTCAGAGACAAGGACTCCTTCAAT

CAGCCAGCAGTGCCACTGAGGTGCCCCGGCGGGCTGGACAGGAAAGCATGGAGAACATGG

CTGCAATGGAAGCCAAAGCAGCAGGTCTTCCAAACACAGACTCAGATGCCTGTGTCTTTA

AGACCAGACCCTCATAAATGGATTGCTTCTGCTGGACACCACGCTCTAAATAAACAGACT

CTTCTGGCCGACACACAACTTCCTGTAGGATTCTGGGGGGGTAAAGCTTGAAAAGGCTGC

CAAATCCAATGACCAGCAACTTTTGAGCTGACTTAGAAAACAAGCTACAAAGACTTGAGT

CCAGAGTAAACAAGGAAAAAGCCATATTAAACAGGGAACAAATTACTATATCGGCAGGG

AAATTTTAA

>2732.Forward
(SEQ ID NO: 157)
TAATCGACTCATGCGGTGATTGGGAATTCTTTCAGGGCAACAGGCAATGTGTTAAATATG

CACTGTTGAGTACACTGTGCAAAGTTATGAAATTCTCTCTTTCCCTCCTGACATTTTTTT

TTCCAAGTACTTCACTGGCTACTCCAGAAGCAAAGGAATAGAGAAAAGAGTGAAATCAGA

ACTAGTGAGTGGACTTGGTTACTGTAAGATCACTGGTAAAAGTCTGAAAGAAACAAGGT

GGAGCAAATTCAAAATGGATCAGATGTGTGTACACATGTATCAACAAATAGAAGTTAAGC

CATAATGGGCACAAGGGGACACTTCAGCTCCGGGCAAGAGTTAGGCTATGGTAGTGACCT

TGGATCCTAAAGCTGGGCTCTGTCCTTGCTTCACAGTGAGAATCAGTAACACCTCATCTC

ATTAGCTCTCTTATCTTCAAAAGTATCCAAGTCATACCTGTAATTTGCCCCTCATCCTCC

AAGAGTTGTACAAATTTCAGGTTCAGCTGAAGGACTCTGTGGTTCAGGTGAAAAAAAAAG

CCATAAATACAAAGCATTATTGTAGGGTGCTTTGGACTAGAACCCTGTCTAATATCTGGG

CCTTGATATTTCAGCCTTTCAGACAAGGCCAAGGAGCTCAGAGACAAGGACTCCTTCAAT

CAGCCAGCAGTGCCACTGAGGTGCCCCGGCGGGCTGGACAGGAAAGCATGGAGAACATGG

CTGCAATGGAAGCCAAAGCAGCAGGTCTTCCAAACACAGACTCAGATGCCTGTGTCTTTA

AGACCAGACCCTCATAAATGGATTGCTTCTGCTGGACACCACGCTCTAAATAAACAGACT

CTTCTGGCCGACACACAACTTCCTGTAGGATTCTGGGTGGGTAAAGCTTGAAAAGGCTGC

CAAATCCAATGACCAGCAACTTTTGAGCTGACTTAGAAAACAAGCTACAAAGACTTGAGT

CCAGAGTAAACAAGGAAAAAGCCATATTAAACAGGGAACAAATTACTATATCGGCAGGG

ATATTTTAA

>3697.Forward
(SEQ ID NO: 158)
TAATCGACTCATGCGGTGATTGGGAATTCTTTCAGGGCAACAGGCAATGTGTTAAATATG

CACTGTTGAGTACACTGTGCAAAGTTATGAAATTCTCTCTTTCCCTCCTGACATTTTTTT

-continued

```
TTCCAAGTACTTCACTGGCTACTCCAGAAGCAAAGGAATAGAGAAAAGAGTGAAATCAGA

ACTAGTGAGTGGACTTGGTTACTGTAAGATCACTGGTAAAAGTCTGAAAGAAACAAAGGT

GGAGCAAATTCAAAATGGATCAGATGTGTGTACACATGTATCAACAAATAGAAGTTAAGC

CATAATGGGCACAAGGGGACACTTCAGCTCCGGGCAAGAGTTAGGCTATGGTAGTGACCT

TGGATCCTAAAGCTGGGCTCTGTCCTTGCTTCACAGTGAGAATCAGTAACACCTCATCTC

ATTAGCTCTCTTATCTTCAAAAGTATCCAAGTCATACCTGTAATTTGCCCCTCATCCTCC

AAGAGTTGTACAAATTTCAGGTTCAGCTGAAGGACTCTGTGGTTCAGGTGAAAAAAAAG

CCATAAATACAAAGCATTATTGTAGGGTGCTTTGGACTAGAACCCTGTCTAATATCTGGG

CCTTGATATTTCAGCCTTTCAGACAAGGCCAAGGAGCTCAGAGACAAGGACTCCTTCAAT

CAGCCAGCAGTGCCACTGAGGTGCCCCGGCGGGCTGGACAGGAAAGCATGGAGAACATGG

CTGCAATGGAAGCCAAAGCAGCAGGTCTTCCAAACACAGACTCAGATGCCTGTGTCTTTA

AGACCAGACCCTCATAAATGGATTGCTTCTGCTGGACACCACGCTCTAAATAAACAGACT

CTTCTGGCCGACACACAACTTCCTGTAGGATTCTGGGGGGGTAAAGCTTGAAAAGGCTGC

CAAATCCAATGACCAGCAACTTTTGAGCTGACTTAGAAAACAAGCTACAAAGACTTGAGT

CCAGAGTAAACAAGGAAAAAGCCATATTAAACAGGGAACAAATTAC
```

1739, 2732 and 3697 refer to anonymized identifiers for the 3 endometriosis cases.

These sequences, once analyzed using the UCSC server (using BLAT), were found to break down into the following subsequences:

```
>1739.Forward
                                              (SEQ ID NO: 159)
TAATCGACTCATGCGGTGATTGGGAATTCTTTCAGGGCAACAGGCAATGTGTTAAATATG

CACTGTTGAGTACACTGTGCAAAGTTATGAAATTCTCTCTTTCCCTCCTGACATTTTTTT

TTCCAAGTACTTCACTGGCTACTCCAGAAGCAAAGGAATAGAGAAAAGAGTGAAATCAGA

ACTAGTGAGTGGACTTGGTTACTGTAAGATCACTGGTAAAAGTCTGAAAGAAACAAAGG

TGGAGCAAATTCAAAATGGATCAGATGTGTGTACACATGTATCAACAAATAGAAGTTAAGC

CATAATGGGCACAAGGGGACACTTCAGCTCCGGGCAAGAGTTAGGCTATGGTAGTGACCT

TGGATCCTAAAGCTGGGCTCTGTCCTTGCTTCACAGTGAGAATCAGTAACACCTCATCTC

ATTAGCTCTCTTATCTTCAAAAGTATCCAAGTCATACCTGTAATTTGCCCCTCATCCTCC

AAGAGTTGTACAAATTTCAGGTTCAGCTGAAGGACTCTGTGGTTCAGGTGAAAAAAAAG

CCATAAATACAAAGCATTATTGTAGGGTGCTTTGGACTAGAACCCTGTCTAATATCTGGG

CCTTGATATTTCAGCCTTTCAGACAAGGCCAAGGAGCTCAGAGACAAGGACTCCTTCAAT

CAGCCAGCAGTGCCACTGAGGTGCCCCGGCGGGCTGGACAGGAAAGCATGGAGAACATGG

CTGCAATGGAAGCCAAAGCAGCAGGTCTTCCAAACACAGACTCAGATGCCTGTGTCTTTA

AGACCAGACCCTCATAAATGGATTGCTTCTGCTGGACACCACGCTCTAAATAAACAGACT

CTTCTGGCCGACACACAACTTCCTGTAGGATTCTGGGGGGGTAAAGCTTGAAAAGGCTGC

CAAATCCAATGACCAGCAACTTTTGAGCTGACTTAGAAAACAAGCTACAAAGACTTGAGT

CCAGAGTAAACAAGGAAAAAGCCATATTAAACAGGGAACAAATTACTATATCGGCAGGG

AAATTTTAA
```

-continued

>2732.Forward
(SEQ ID NO: 160)
TAATCGACTCATGCGGTGATTGGGAATTCTTTCAGGGCAACAGGCAATGTGTTAAATATG

CACTGTTGAGTACACTGTGCAAAGTTATGAAATTCTCTCTTTCCCTCCTGACATTTTTTT

TTCCAAGTACTTCACTGGCTACTCCAGAAGCAAAGGAATAGAGAAAAGAGTGAAATCAGA

ACTAGTGAGTGGACTTGGTTACTGTAAGATCACTGGTAAAAGTCTGAAAGAAACAAAGG

TGGAGCAAATTCAAAATGGATCAGATGTGTGTACACATGTATCAACAAATAGAAGTTAAGC

CATAATGGGCACAAGGGGACACTTCAGCTCCGGGCAAGAGTTAGGCTATGGTAGTGACCT

TGGATCCTAAAGCTGGGCTCTGTCCTTGCTTCACAGTGAGAATCAGTAACACCTCATCTC

ATTAGCTCTCTTATCTTCAAAAGTATCCAAGTCATACCTGTAATTTGCCCCTCATCCTCC

AAGAGTTGTACAAATTTCAGGTTCAGCTGAAGGACTCTGTGGTTCAGGTGAAAAAAAAAG

CCATAAATACAAAGCATTATTGTAGGGTGCTTTGGACTAGAACCCTGTCTAATATCTGGG

CCTTGATATTTCAGCCTTTCAGACAAGGCCAAGGAGCTCAGAGACAAGGACTCCTTCAAT

CAGCCAGCAGTGCCACTGAGGTGCCCCGGCGGGCTGGACAGGAAAGCATGGAGAACATGG

CTGCAATGGAAGCCAAAGCAGCAGGTCTTCCAAACACAGACTCAGATGCCTGTGTCTTTA

AGACCAGACCCTCATAAATGGATTGCTTCTGCTGGACACCACGCTCTAAATAAACAGACT

CTTCTGGCCGACACACAACTTCCTGTAGGATTCTGGGTGGGTAAAGCTTGAAAAGGCTGC

CAAATCCAATGACCAGCAACTTTTGAGCTGACTTAGAAAACAAGCTACAAAGACTTGAGT

CCAGAGTAAACAAAGGAAAAAGCCATATTAAACAGGGAACAAATTACTATATCGGCAGGG

ATATTTTAA

>3697.Forward
(SEQ ID NO: 161)
TAATCGACTCATGCGGTGATTGGGAATTCTTTCAGGGCAACAGGCAATGTGTTAAATATG

CACTGTTGAGTACACTGTGCAAAGTTATGAAATTCTCTCTTTCCCTCCTGACATTTTTTT

TTCCAAGTACTTCACTGGCTACTCCAGAAGCAAAGGAATAGAGAAAAGAGTGAAATCAGA

ACTAGTGAGTGGACTTGGTTACTGTAAGATCACTGGTAAAAGTCTGAAAGAAACAAAGG

TGGAGCAAATTCAAAATGGATCAGATGTGTGTACACATGTATCAACAAATAGAAGTTAAGC

CATAATGGGCACAAGGGGACACTTCAGCTCCGGGCAAGAGTTAGGCTATGGTAGTGACCT

TGGATCCTAAAGCTGGGCTCTGTCCTTGCTTCACAGTGAGAATCAGTAACACCTCATCTC

ATTAGCTCTCTTATCTTCAAAAGTATCCAAGTCATACCTGTAATTTGCCCCTCATCCTCC

AAGAGTTGTACAAATTTCAGGTTCAGCTGAAGGACTCTGTGGTTCAGGTGAAAAAAAAAG

CCATAAATACAAAGCATTATTGTAGGGTGCTTTGGACTAGAACCCTGTCTAATATCTGGG

CCTTGATATTTCAGCCTTTCAGACAAGGCCAAGGAGCTCAGAGACAAGGACTCCTTCAAT

CAGCCAGCAGTGCCACTGAGGTGCCCCGGCGGGCTGGACAGGAAAGCATGGAGAACATGG

CTGCAATGGAAGCCAAAGCAGCAGGTCTTCCAAACACAGACTCAGATGCCTGTGTCTTTA

AGACCAGACCCTCATAAATGGATTGCTTCTGCTGGACACCACGCTCTAAATAAACAGACT

CTTCTGGCCGACACACAACTTCCTGTAGGATTCTGGGGGGTAAAGCTTGAAAAGGCTGC

CAAATCCAATGACCAGCAACTTTTGAGCTGACTTAGAAAACAAGCTACAAAGACTTGAGT

CCAGAGTAAACAAAGGAAAAAGCCATATTAAACAGGGAACAAATTAC

In each case:

The first part of the sequence maps to: chr1:92240239-92240474 (hg19)

The second part of the sequence maps to: chr1:92248545-92249312 (hg19)

The precise deletion size is calculated as start of second segment—end of first segment: 92248545−92240474=8,071 bp The presence of the dinucleotide 'GG' in between these two sequences is likely a product of the type of event/mechanism that resulted in the deletion.

The outer primers defined above would be expected to generate a product of 9,499 bp (chr1:92,240,188-92,249,686) from a normal, wild-type genomic sequence, which does not harbor the deletion. In the 3 cases described above, the deletion is present heterozygously, so a wild-type, non-deleted allele is also present. A 9,499 bp band was not observed in FIG. 7 because amplification of PCR products in this size range requires specific, special conditions (long extension times, use of special polymerases etc). In standard PCR, products of 9,499 bp will not amplify efficiently and will remain unobserved on DNA gels. The reason that PCR across a deletion can be used as a screening tool is that the primers can be designed to generate a small PCR product only when a deletion is present, a product that cannot be generated from wild-type sequences, in which the primers are too far apart. Note that, in FIG. 7, the approximate size of the PCR product is 1.5 kb, which is consistent with the sequencing results:

Wild-type PCR product would be 9,499 bp (about 9.5 kb)
Outer primer PCR product about 1.5 kb
Deletion size=8,071 bp, and
about 8 kb deletion+1.5 kb PCR product size=about 9.5 kb wild-type primer distance.

Hence, the outer primer sequences described represent a screening tool that can be used diagnostically in endometriosis. By screening individuals with endometriosis using the 2 outer primers and standard PCR conditions, the presence of an approximately 1.5 kb band confirms the presence of the deletion. The deletion includes a transcription factor binding site.

However, other primers may be employed, e.g., as a pair or in a nested set of primers, to allow for a smaller product to be generated (for more rapid PCR). In one embodiment, the primer pair is capable of generating a diagnostic product even when pooled samples are tested (e.g., the presence of 1/10 individuals with a deletion will result in generation of a product, therefore reporting the presence of at least one deletion within the 10 individuals being tested). This will be a useful screening test, which will allow thousands of individuals to be screened very rapidly (for example, 1,000 individuals can be screened using 100 PCR reactions, each containing DNA from 10 individuals). Any pool that is positive can be 'split' and the individual cases tested singly, in order to identify the individual(s) from whom the band originates. Pools that are negative would not need to be 'split' in this way for further analysis.

Figure 11:
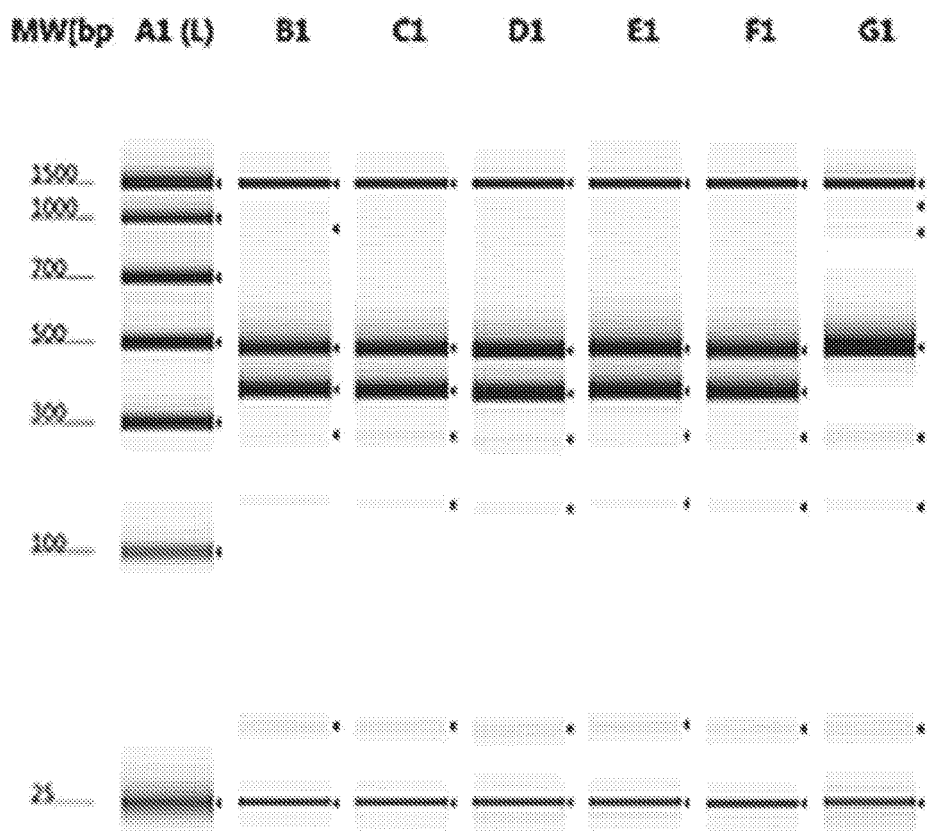
FIG. 11 represents an example of a typical result in a heterozygous deletion carrier and a non-carrier.

For example, using standard PCR conditions, PCR may be performed using a pair of primers designed to generate a product if and only if at least one of the individual's TGFBR3 genes possesses a deletion, for instance, using the primers that yielded the product in FIG. 7. If the band is present, the patient has the deletion, indicating EN or a predisposition or susceptibility thereto. If the band is absent, the patient does not have the deletion and so does not have this marker for EN. In a further refinement of the method to detect the deletion, a new set of primers was designed. The new set of primers, Endo_screen_F=GGAATTCTTTCA-GGGCAACA (SEQ ID NO: 162) and Endo_screen_R=GACAGAGCCCAGCTTTAGGA (SEQ ID NO: 163), generate a product of size 362 bp when the deletion is present. Additionally, a 'control' set of primers was designed to amplify the sequence within the deletion, in order to differentiate del/del homozygotes from del/wt heterozygotes. This 'controls' primer pair was TGFBR3_internal_F=TTGTGTGGCCTCACTCAAAC (SEQ ID NO: 164) and TGFBR3_internal_R=CCCTT-GACTTGCTGTGAGGT (SEQ ID NO: 165), and generates a 460 bp product when at least one copy of the sequence internal to the deletion is present. The 460 bp 'control' band can be easily differentiated from the 362 bp product created when the deletion is present. Thus, using a combination of both primers in the PCR reaction, there are 3 possible outcomes: 460 bp band only→wt/wt (no deletion); 460 bp+362 bp bands→wt/del (heterozygous deletion is present); 362 bp band only→del/del (homozygous deletion). This primer combination was used to screen a total of 911 endometriosis samples (100 discovery samples plus 811 unrelated individuals). A total of 5 heterozygous deletion carriers were found, 3 from the original discovery cohort of 100 (this represented a technical validation) plus 2 further, new, cases. Thus, the heterozygous deletion was present in a total of 5/911 cases=0.55%. In a total of 2,257 non-endometriosis cases, only one positive was found (in a male for whom no family history is available). Thus, the Fisher's exact test for this deletion is FET=0.0089 and the odds ratio is OR=12.45. FIG. 11 represents an example of a typical result in a heterozygous deletion carrier and a non-carrier (these were the only 2 genotypes seen—no homozygous carriers have been observed but are theoretically predicted to exist, albeit rarely).

Example 5

For each CNV listed in FIG. 1, the relevant intron(s)/exon(s) sequence for the CNV was obtained from the consensus HG18 sequence. The sequences in the files are for complete introns/exons, rather than the specific component relevant to the CNV. CNVs that encompass consecutive introns and exons contain multiple features reported per CNV.

All publications, patents, and patent applications mentioned in this specification are herein incorporated by reference to the same extent as if each individual publication, patent, or patent application was specifically and individually indicated to be incorporated by reference.

SEQUENCE LISTING (165 sequences)

SEQ ID NO: 1 - DNA, 6807 bp, Homo sapiens
actgaaacattcattttccaagattcctttccaaattcaactccatggtctttcttttgtctgttttgctaaagggcaaaatactaacctgtttccaagctattcagcaatattttggcacaggtaatccagtaagagaattgtttgtatagaacagagctgatgttaataacagggtgccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagtaaagagcttgagatcatctaaatgggagcgggagcaagggagaactcactatccactgtgtttttgttacctttggcaaattctcaagggtagggggtcaggactgccagtgcctggcactgtgcctgacacattacaaacaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgaccttgggtagaatacttaacctctcttagcctcaatttccacacctgtaaaacagagctaacagaatctcccttccaggggtgttgaaaaaaacaaataaaatgccaggttttgtaattctctggaaagaagcctaccagcgtttgactttggctctgatcagtgtagtgccattacctcctgcctacaggtccctggattttcaagcagggtgacaaattggtggcagctgcatacatgaccctccaaacacttggcttcctcatgaggaactaatggttgttctgtcatttgtctgcttttccttcacctttgggatttggagctcattaaagacgagggccgaaaggtagcacaaacatcaacatctttgctagttgttcctgttcaggcaccactaacctggacaagctcaggttttgctccccaaatctcaccgtagttctggagacttctgaatctaacaaacaaaggtcctgggaagaccacattcattccacacctgaccccaacaccacatctactctgaggttaccccaaatctctgaacaaaaactcaatcacctgtgctcgctgcctttcctccctggcaggtaccttccaaaaaaataggaacataggaagtgccaaagcaaggaactgcttccaaggcagctgacatcactggattgtgaggtaaagctagaggtttctcccaatctgtagtggggaaatctggggacaaacatttatcttcagaggcctgtctacactgccccttccagtgtcacaggctgtcacaattcacctggctttgaagacctgtggtgttcagctgaagaccattctcccagcatcaacaccaacaggcaaaaccatcagatgaagctttcacagctgccaaggtacttgctgtcctcaacatatttcatactcaactcggctctattttatttaccagtctcctcccctagtcttggaaaattctcctttcagccctctgccaaaccacatccccatttcaaacctttccaatttctcacctccaaaaagcagcaccaggcaagcacacctggctccaattattccagcaatgccttcccccagccccagccccaaccccagctctagccccagccctagccccagccccacatccccctaacatgcctgattacttagcacttaacgtgtttatctcagcccagctgtagttgattacatctatttggttaagtttctatctcgtgtatttagggcgatgagatgtttctacgtctccgtactttctgttacaggtgttgctctttgtccctggatgcacggtgaccgtgagctccgagggctgcctgtctcctcactcctgcaatgctttgcaccggtgcccagttcacaaaggcagctgcagctgactgtccaactgcctggttctaatttatgtggagagaggcctccactcaacaaactgaaataattagttcttctaatcttctgcatttcaataaataaaagaaagacagggaaagattcacatgtactctgtcctgacgaaacagtagagctctttggaaaatcatgaaatttttactgtgcaaggcagtaagatataagcaatgaaactcaaaagcattttcccaagtattcagagaccagatctgcccccagatctgtaaatcctacttaatctaggttaaaaaaaaaaaaaaaacacacataagaagacatgagacacccttagtttacatttcagctcttaggtggttccttattcactgaatgctgagggtttctttaaggatattttgtagtttaacaactccagaaatgcttttgactctaattctcaattggtattttgaaatattaattttctcaatgtctttatattgacagaaaataaaaaaagaaactgagatccaaatgggtctacacatttgccctcaagtttaaacaaaaaagatcacaacagagggaagaccaaaaaagagggaagtcttttattaagactcacaatccagtgctgtcttctataccttgaagccttggtttaagaaacattactttatgcccaagccatacataccaatatcaataactagatcttcaaaaaatataattaatgagaaacttccatatatagaatttctagacttaacctatttgctaaactgctacatcaacatacttatttattcatgcaaatgtttatttcacaaatgtttcttgactgcttactatgtagtgggcactgttctaattcctggcaataccaactaaagataaaacatctatactgatgatatactagcagaagagatagacagtgaacatatttaaaaataaatatcaggtggtaatataagttacattttaaagtaaaacagtaaaagagagtgtgtctgttgtggggtgctatgactattttaaatggggtggtcaatgaaggcctctcagtggaggtaatggcaaagcagggactgggtgaaggcagccacatgagtaactgggagaagtacttcaggcaaaacaaagagcccatgccaaggacaggaggcaagatgtcagggcccactgcagcacagtgagcaatggtgagagtgctgggagaagggggaaaagatcattcagggctctggtggggattgcgcattttcattgaaatgtaaaaaaccatggcaggaagctgaactggtgaacttcgtgactggacggaagtctttcaaaagatcatgctggctgccacttagagaatagatcttaattgctaacaatgatagcagctgacatttatggagtgctgatgatattccacgcactgttctaagcaccagtcatgctttaattatttaatcgtcacagcaactctatgaagtagatactatgattatgcccacatgaggaaaatgaagcataaagaagttaactgacttgcccaaagccccacagctcatgagcagtgtagccaggcttccaacactggcgctctaccccagatcttgcactcctaagagggatgggccagaggcccactgcctctcaagtaaaaatgtgatggtgggtcagaccgaaggtggtggtcagaagtgggcagattcagaatatggtcttagggtagaacaaataggattggatatgacatctgagcaaacacaggaagtcatggataataatgccaaggactgtggccctggcaactgtgtggtagcgtcctttacagagctggggaacacaggagtaaacaaactggagacaggagggagcatggaactcaaactaatgtgagtgtgtgctcatttcccatactgctgtaacaaattaccataaactgggtggcttagaacaacagaaggctattctctcacagttctggaggccagaagtccaaaatcagcattgctaggccaaaaccaaggtgtcagcagagccacatgccctccagaggctccaggagagaacctgttcccagcctctttcaggttctcgtggctgctggcattctttggcttgtgggttccagaccaccaatctctgcctgcatggtcacacagtcttcccttttgtctgtgtcatcaaatccctgtcttataaggatacatgtgactgtatttaggggccaccagataatccaggataatcctccatctcacaattcttaatttaatcacacctgctaaggctttttctatataaaggcaacattcccaggtttaggggttagaacgtggatatatctttgggggccattatttagcctatcacagtcaggaataccacaaataaaaacaataaaacgtacaggtgtggataaacagtgagcaaagcttttcccttttacatgagaatttgatcttctgttaactctctcaattctgtaaccctggtaatctggtaagacaatatgtcaattataacacaaggcagcttgctattgggactggaaaattttaagacatctgataagaagtgacatctgggggcttccctgagagcagtgattcttgtaaatggggcatatttatgagacagagtaccatgaaaactattcctacatagttgcctactagttcccgcaagggtctaaggctttttttttttttttttttttttctgacatggagtttcactcttgttgcccaggctggagtgcaatggcatgatattggctcactgcaacctctgcctcccgggctcaagcgattctcctgcctcagcctcccaagtagctgagaatacaggcatgcgtcaccatgcctggctaattttgtatttttagtagagacgggtttcaccattttggttaggctggtctcgaactcctgacctcaggtaacccacccgcctcagcctcccaaagtgctgggattacaggtgtgagccactgcacccggccttcctaaggcttttaaactagagaactacacacacacacacacacacacacacacacacacacacacacacacacagagatctcatctcctggcatttgagccatcagctggagagctctggatggctatgtgaactgatgaactgatgtgtgaacagtcacaaggcacacaacaaggaggaatgccttgctgccatgccgtaagctgtggtccttgtcctatacccttttaagtataatgaagccacccatggcctatgatagtctcatgggtctgaatgtttatttggacccaagaagactccttgcctgagtttgttgccacatgtaataatatcgtttcagttcattatttccatttcttcctccaccacagttactcagcagcaaaaaggagtagagcatttgtttcatctgttcatgctcttgtgtggcctcactcaaacagcaaaatggctaaaaagggcaaagggaaaggaaaagctagagaacaaaaattagtaaattcacaaaaactgagctaactgttccctcagggagaagtgagtactgcctacaaggaacatgctgcgctgcctgtgctatgccttccagaggcctctccagcagaatgaaatgtaaaatccctaacccacagttctgctggaaatgtgcaagtgggctcattactcagagccaagataaaggataaatctttatgagtaccgtaagtatgagtcataaaaaataggaaacatatgtaggacgtatacacagtaatagcaccaagccagagaaagtgtttaggaaatgtatttaagaacacatgacaaaacaggacgaaaaattgcccttgtacattgctctaaaacacatttaaaaaaaaaacctcacagcaagtcaagggcccatatcactttgctgatctctaataaacatagatcatttccatatttggaaataggctggcctttttattttaaatgcaaataggagagctgaatcaagaaaaagtaacttggagtaggctttgaaagattttatgatttgggaaatttgaagagcttccaaataaaatactgggaattagatcttaacagcattaaaaatgaacacaaaagattcttttagaaaaataattgttcacaatggtaatattaccatttcatttagattctcactatcttaacaaccactggaaaaatgagtggaatcttcaaaccttatgaaagcaggaatcaaaaataaactgcaacacatgggctgacaacataccgagagcaatgaagggcctgcgtgaaagccctcacggggatgctgggctcagcaggaagaactcgcagcaaggaagaagcagagccccctggccaaaagcaccaagtgacaatctaggggatgagggcgttcagaatagaagggagggtgatcggcccccagaagtcttttggggccagatgactgaggcaaaatgtatcatcattggaaattaagctcttcagttgcctttgattttggaagatgcccgaatttaagacagcttggcaaggctaggagacacctacatgcccatgtgcccaacacggaatcatgtgtgtcccaacggacctttggctcccttggaccagggctttctcctttaccttcagaaactgctgcctcccaaggaaagcactgcttgcacatcgactgacctgaggttgagaggaggagcagaggaatgtggaaaggattgtttttaccttcattaagtgttaaatttacctaagactcccagagagtcaatgctcttcaggaactattctgaggcagaaa

SEQ ID NO: 2 - DNA, 2560 bp, Homo sapiens
aaactacaatttctcacaaattctctgctcttgccaaattttgttttcctcttttagcccgtcggttccgcaatttcgggcgcaaataaagaccttctggcatttagtggaaagagcctagttgagcacgatccgcagaagcggaatcaggtggctttcggataggcagcgagatccgaggactaaatcccgaggtcttggcgagcaagcagctgccctccgccaggcatcgaggagcgagctgccgccgcgtttctgtcgcggcgccgcggccgaaccgggtagaggtggtctaccatcggcccttcgtggtgggcccaggggtgtttccccgggcaggggagctgactgcaggccaggggcgccaaggccgcggtgcggtgggagcagagggcagcgcagcggggctggacttcatcttcccacgccagaggccgaggcctccgggaatcgcagggccacctcttcaaagcccttggcgatcccagttctgttccccgagggggctggcgaggtgggcggggcgggcaggcgagactaggtctttccctgtttggcctccgtagccggcgccggcgggtcgttctgtttgaatgaatgatcccagcagccgcgcccaatgggcgtccacgcctgcttaatatgcatgaggcccgcagccaatggccaggcgaggaggctgttttaaacggcagagcccgctggccaatcaggcggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtg

SEQ ID NO: 3 - DNA, 1564 bp, Homo sapiens
gggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtg

SEQ ID NO: 4 - DNA, 14930 bp, Homo sapiens
tgttgagtttctgctgctacttgaagtttcatgcttgttataccttcgttatatattctctttttctgcataaaatgacaatttgtatctaatttaatgctttctgccttggactctatcttgtctaagactaaaataatgatcaatatctgctttcaacttttcaaatacccacatatccttatttcccattgagtggggtagaaaaagacaaatagaatctggttagtctctatggcaaagtcatacatatgagatctagaaacatttttcttttgccaagggcattaaaatggcaggtggagaatcagtactacaaacaggcatatctgcttttagttttcttttattaattgtttatgtaacttatactagactgctcatgatcaataaaacatgcaggaagttacaagacctttttccatgactatcactaattcagtcagggtattagtagtgaagaagaaaacacaatctcaatataagcaaatatacctagtatccaacaaaataagctctcagctgggtgtggtggcatgtgcctgtagtcccaggtacttgcgaggatgaagcaggaggatcgcttgagcccaggagttcgagtaggcagagctatgatcgcaccacatccagcccggatgacaaagcgagactccatctttaaaggaaaaaataaaaaaaaaaacctaagcttttaaaattagtcatctaatgaaccactgaatacgataattatgtcttacatatttacaatatacactctctgacttaacgatggtctgacttgggatttttaaatttaagatggcataaaggcacatgcattcagtagaaaccgtactgcaagtacccacacaacaattttagttttcactgttagtgttcaataacttacatgagatatccaatactttattataaaataggcattgtgttagatgattttgcctactctaggctaataaaagtgttctggcaaagcaagctagaatgtttggtaggttagttgtttaaatgcatttttaaatcatgacattttcaatttataaagggtttattgggacataatcccatcagaaattaagggacatctgtatgtaattcttaattgtggataataataataaaagagaggttggatagatgaaaacagctacatttcatgttttactatcaaccttttatttttctcatgcttcaatacctagaagagtggtaaaatattgcagtttgagtgtctacttctttattttatatctaacattaggaagtgctaaagtgtggaaaaccagacaattctggaatgcagagggaggagagaaagctccagtaagctacatgcttcagacataggcactgaataataaagaaacagaaagaaatatagaaactgaattgctaaggcacttttattgccactcctaagaaactcaacattatcagcagtagtaatggccatcatttatacatgttgattttataaacttattttttttaaagttctaaattgctctctctccactccctaaagctggattaaaacctattgcttccaaatgctgaattaaggaaattctgtgccacaatttttgctacagaaaattagtgtgagcacagaacgaagagcaatcttatatgcataggagcctgctgttggagaaagctcaataagagacatcaggaggtttggcttcttttcagaggacttaggaagttttgatacctaaatgatataacataagactaacttttgaagtaagtgctaaaactatttatatatactagacaattttctcaagatttgtcctttttgtctcttagactctcactaaaactccgtcatcaagttgtaattcacacatgtagacaagccttcagcctctccaaacatttttaaaatctgtaaattcaaaacatttaaaaagaagacacatgatctcatctggactgctgcttgatcttgtttgatattcttcagcactctactttttataacgggtcaatagcagacgggcggtaactgatctccttatttcagagctgaaaacacaaggcactttgcgttgggtgcagttctattctgttatgctactcccgtttgtcagtaggtaaaaacttttcccattccccagaaggcagtacttctatgaatagttgctttagacaagcattcattgttcaaagggtttgattcctcactgagcaaaagctacagcattataaagatgccagttgaaatttttttaagcttgaattttttaaagctagaaaggaaccctcactgttggggaagtcatgaaagaaaaccccttttcacaagccctggaacaagtggattaagagagtaagagtaaaagtgcaaagactgggaacctggctttattccaaaaaaaaaaaaaaaaaagccagaaaaaagccacagttagaagtaattgaacactttggaaatccctttgaagacctaatgcagtagaattttttgaaatgaataaaagctaaatgcataataatttcaggtaaaaaaatacaaacgaatgtttgaagaaccaaataataaatttataaatgtttaacgcagcgggacctagcagtaccaacctttgataatgtatggtaagcattagcaatgttgttacttggaaaagacaaattaaaaacctggcaatcttacctcatgttgttttgtactttgtatacttggcttggtttatagtgatgatattatctgtactgattatacttgttcagtagaattttgtacacttgcaaatggaatttttagacacaagaaacaaggtacaaaaattgcctaactacaaaaatttctccctcttttatattgggactaatgatatgttaaacaatctgatgtatcactttagaaaaacagtaatggcagttgcatttgccaggaaaatgttacaatagattttagctctcttaatagaacataaaatattagtttttaatatcttgctatatgtggtgtttttaaataaaaaggcatagaaatcattgatatttgaagaatgttgatataaaataatctgtgtggaggataatgtaggttgtgaactaaaacggaaaaagccccaagagtgtatatcacactaaagaagagtgtattttctgctaaatggagtatagaatgttgtgcatttagtacataggacatatgcttgcaatcctcccctaaatatcccagtggtttctttgtgcaagttttctttagactcatttctccatcttgatctgtgctgactccacgtgaggtcagtcagagaataatgttagtccaaccacttgtgtgcacacctgcatacacacataccagaaagttaatgttgttttactttaaagcagtgattttactctggaccatgtgtatgtggcagaaggatgatagtgacttgtacataagcatctacagaggaggaataactgatatgtatggtggagtttgacagaatcctggatcaggaaaaataacaatcttaaggttggaggagatttttaaaatcatcttgaccagctatccatttcattacatcattcctcactctgaggctcatttctaactggtgttaccttggaagatgactaatttttagtgcttgttttgaatttagtttgtggaatgatttctcagcttgccccataatatctactctgtacagaaaaatgttatccctttttctttgcaaagtgtgaatataaagcaatgaggctgtttttcttttatgagtcatatccggtctctgaaaacagttcctaaattggagttgccaaaatatttcatgtcatggaagcatggttagaataggcttatcaaggtgaattttctgaatggtatttcagtacttatttttatagtctcatagctctataatcacatgttgaatgggattttaatactaaaaaagaggatacataaaaacacattgtgtctattatctgcatagaacaatcgcctactttctttattaatagatcttattttgtgaaagctacaccttacaaaattttatcttgttctcacctaattatctaaacacaaggaatgatcctgctctgaattaaacctttccatttagtgtcaaactgaacagatgcaaactcacttatggggagccatcctttggaaataaactctttaattcaaaaaatatctaatattagaatattccacagaatatgaacacctacttaaattcatttcgagtaccaaagaatatttcagtaataacatttacatactaaattaaacttaattatacagcataaaacatttataaccattaaatacagaacaattattttgaattgttaagtgcttccaacatcattgacataatacattttttgaaataatgatgtaaccatttaagtaaatttttatattttattcacattaaagtttatctgtaacattaagcataacttttttcttttctctctctctttttttttttgacatggagtctctctctgtcacccaggctggagcacagttgcgctatctgagctcactgcaacctctgcctcccaggctcaagcaattctcctgcctcagcctccccagtagctggggttacaggtgcccaccaccacacccagctaatttttgtatttttttgtagagacaggttttcaccatgttagccaggctgttctcaaactcctaacctcaagtgatctgcctgcctgggcctcccaaagtgctgggattacaggcgtgagccatggcacctggccagcatacttaacctttacagaggcatttttagctggacatttacagcatttaaaggatggaattcaattaataaaaaagactttttataacattgaaacagtgagtttaagagagtaaatctgttgccattttagttagttttgacaaagcaaatattataaatggccaaatacataagcctgttattacacattaaaatgtatcctatatttaatgagcattaaaattgaagtttactagtaattccatgggatattattatgaagttataagaataggagagaacttatagtttatttctgtctcattttaggatcttcctattatggcacatgaattttaatcgactttataatggtgtcattgaagcagagtctatgatattatcattctagtatttaactacatctccccttaagaatgattttatcacccattattctttaaacctctcaagatacttcttaggctctgttctctctggagttgtgtaaattctaataatcataacatatattattatcttagaagtcattaagtcttctcttctttatttgtttttagtattcctagtttctcatgggtatagttttacaaacgctttcattctttgtatcagttttcatttcatatttgcctttcccaaaaatgcatcaaactgcttccttttttattttcttgtttcccatggggttggtaaactccttcttaaaaccttacagtagacttatgcaaagtctcatggaatttttaatgctttttatatttttttctgattttattttgttaaactgatctccactatgattctaagatctttttcctcttagactcatgtagctgcccatctaagccttgtaagtcctgttcttcattcaagtggtgtctagctacttttcattgttagcattatttatactgtaattctttcctctctggtgctaattacccaatcacaataatcatcagcaaactcagaaagctcttaatctctcctgttttatgtagagggattctcccagagtacttctttcctgaggaggcttaagagaaaaactgaaccaatgccactactgacttacagaaaacagaagcagaattacatattattttgtcttatctgatccatactttggaagtcaattcgatctttaccattcccatggattggcttaattaacaatattttattttataactataccagggtttgtatagtatatgatactattcaaagaaatacctaatgcagatgacgggttgatgggtgcagcaaagcaccatggcacgtatatacctatgtagcaaacctgcatgttctgcatgtgtatctcagaacttaaactgtaataatgaaaaaaagaaaaaaatctgaaaatatatataaaatatttaaagctagaaagtaacaaatagaaatcaaaatagtaatataattattaaaactataggaaggaaaaagatataggaagtaaatgagtgaactaaatctttactctctatagctgagagtcaaccaatgatattcaagttgataaaccaagaaaatatcagtaaaatcatgttatttggagttatctatgtaaataattgaatgagaaaacaaacatttaacctctggaaaacttgtttaggaatgcaaaagaacagagaagggaactttgctttttgttttatgtcattctctaatattatgtttttttccccatgcatgtgtatctattgacatttttagataaatatgatagatagataaatagatatatagataataggaagggagggaggataggatggagagaggaaaacctacatacctagggtttaacactgcatagtgaaatttcagaagatttttttcttctttatacctttttgtatggcttggatattttacaatgagtaggtaatgtttttataaaaataagaggaaaataaactgtttcccctttgtaaaaaaagaaaatcttaaattaaaacaaagatcaacaacaaaacaacaacaaaacaacaaaaagatcaaaaacaacaaaaaagtgccttcagttaaatgatctcttttaatactggagagaaaaagagttaaagtagctggcctataatccattcacttactttctgaggaaacagaaatgggggtgttgctggaatgatgtggagcagggaatttggtgtaatttccttgtgaaaagataatgactaaacctcctcgtaaatgaactaatagtattagaagaaaaagataccttatctatgaaatactcttagcaggatgttcctggtttaaggttgcttataaaacatcaatccagaatctgtggatttatggaaaatgagaaatataaaagctggctgacaatttagggtgtattaggccattcttgccttgctataaacaccagaggctgggtaattcttaagaaaataggtttaattggctcacggttctgtatgttttacaggaagtatggtgccaacatctgctcagcttctggggaggcctcaggaagcttacaatcatggcagaaggcaaagggggaacaagcgcatcacatggcaaaagcaggaacaagggagagagtatggggggcacactttacaacaatcagatctcatgtgaactcagagtgaaagctcggttattaccaagggaatagctcaagccattcaggggcattcgggggcatgatccagacacctcccaccaggacccacctccaacactggggattacatttcaacatgagatttaggcacagacaaatatcctaactctatcatggggtatgaaatgtaaatatttaataacttatgcttcactgttttgtgagatagatgaaggcaatgaagcattgcagggtcatggatggataaagttactggatctagtgagtacataaagtgggaagcaaaaagttttatctttggagacgtaatttggtgaaggatcctgaagatgccacctataccctgcgcaccaggcagatgcaccaaagtatctcagccaatttcattgagattcagactggcaaggagcttatggtaaagtctttataattgaattaaaaacttaagtaattgtttctgttatttaaactcactggaaaagcttcaaaatgagacaatgatttgaatgaaccagtagtctcttggttacactattagggataatagatatccccatcgatctagaacttataatgtcacaattgctaccaaagttcacaggacagttagtgtaaggaaatccagaactactcacattggggtagaacaattacctcatttttgctagctcaggattaaccattagtggataagttgcttgttcacactggctttctgtgataaagaactcatcctgcacctattattaatgttattaccatggtattcaaccaatagtctcatatcttcatcagaaacttgttacctatgagtttagtactgagacccagcctgggtctccctgctgagaaggagaactgaatgaggggcatagagagtatagtaatggatcatgtggaaaatgatgtgttttctttgagcattcatcaccccatactggcaatgtacaaagagaatgtgactgacttgcaggtgcatagtaaagacagcaaagaaaaaaatgagggggctgatggcgtcattagagcaaggagctcttagagtcttctcattcccatgggagaacttggcacaaaacctctacttggaagtaacttttctttggctcccagcacacacacactgatctacattgaaaaaaatacaaacataaaagtagctcttatatagaaaagtgggtggatctttaatcagtttgatttgtcctctattcttggcttatttgtaagtagcttctattcaaaccattctttatctttatctttcaccttaatacacacacatgcatgcatgtgcacacacacgcaaacacacatacacacaccattcaattttctccccacctcagcctgcattagctattctagaactgaatgtcgaagaaatctgttgagaaagctgctgtgctagccaaagcaatgaagaattattttatgtgtatgaagaaatattgtagcatagaaaagtacatctcaaaatatgttcttagattgctacaacacaatactctaaacagtaaaaatgaaaattcccttgcttcactccacatttggggtagggaccaagaaatctatatttttagtacatgttccatgtgaattttaagaacaatgattagtagaaagaacactagattagatgtttctggaagagttactagtgtcacgtcgtaactcttcttcttcctgtctaggtagacttggccaaattataaaaatattctgagacttagtttccttattgtaagataaggcaattaaactgaattcccatggtggggcagtcaaggtcgaactaataaaattcactgtctagttgttcagtatgaatgttttgaaatgaactagccatacaaacaatgctctcttaaggatttgcctttcaatttttcctctccttgcatgctctgagaagcctcctgtagccacaggagcaagaacacttggaaaaaatatgtttattgagaagattgccaatggttacaaattcctggcaacttgctcagttctctaagtaattggccatgtggctactccatctaatatgatgggatgtgaccagtatgttaataagtacaatattgttctatctctttaagctccaagtctgtgaactttctcgggaatttatatgcaatttgaagaaatgtgaattaaaaaaaattgttagcatttgctttgtttttcataacatttcctcctttgggatatgtatgtagacaacagctacaaaactgctatagatctattactttgaatttttaattacaagctatatgcctaatatactttattagaaagtttggtcctctatgacataaataacaaaattgataggaaattctcagtgaaaatacttaacagttatgatctgcaagataacagaaaggaatagattgttgtcgcaagataatggttgctgactgtgagataagtgtcaaggcaaagtcattccaaagtctggccatttatcaaaaatgaacattgaagaaaagtaggatacatttatcaagcaactgttttagtacaaacattttatttttcttttcctagctaatctatgatttagatgctgtcatttcacttgccaggtatttgtgcagctaaatgactcaggtcaccactgcattgtttagagttacacaaccctgatttttgagtggttattgtgtttatcccaataactaccttatagtaaggaaatagttaagaaagttaattgattgggctctgttttagtttcttttttctttctatttagaattttgcttattctcatctgtttctttaaagtgatttagtatggttcacattaaaatgcacatttaatacatttgtatatcaatataatattgatataggatagaaatttaaataaaaatctagaactaaggggaatgataatcagaattattttattataagcattatgattctaacaagtatactgattgctctacacattgtcctctgtgacagatgtggcttatttaaccacaagtatgatattatcatttggtactgacagggctattgtcatccgaagccatttattcctgtcaccactcataaattactgtaaaaaagaggccactgttctcctaatttaacatgttcttccacattccaaccatgatggtgattttgtaatccatttgtcttcttaaagcaataggaccataggccaacttcctcaaatggaaagcaagcccccaataattagtaagctgatagagtacataaaaatctttgtataactcatacaaatatatgtactttatttccagaactacttgggaaaggcattacttgcggaatagacatagtaaagattttcctcgttctcctccctgaatattcagagaaactgtgtgtggtatacctcttccagaatcttgcctaattcctggatcttgcacactcaattttttcagttgtaggagaggctgaatttttaaaaatgaacatcatggaccctaaaatatggtttacctaaaagctttatattcttcattactttcttaattcattcatgtgttcagccaaaacttattgaatagctgccatgtgcagagtattgtatattgttaaggttaaaaaatatagatcaataaggcatgacctctccattgaggaattcctagcttaaaggatattgatatatatgtatacatatatatatatttatatatttattaggctatggatacataaactcattaggctatgaatatatatatatatgaatatatacatatatgttgtatacgcacatactcatgtttaggtaataataagtaatcattacaactgggaacatatgtttgaggtagggttgaggggcaagtgaagaatgtccagaaacttaatacaactttagaatataaaagaccttgtgtactttgtcaagaagtttgaattttatcctgtatgaaacagaaagattttaaacagaaaacagaagtgctttaaacataggaatgacggagtcacacctgatcgtatcagaggcatcatgaaagcataaaatattggaagtgggaagtctttgctacactttaaataagagttagtggttgcttgaaaaagcaaaggggagtagaggtgatgagaagggcattgagtatgcaagagaccagattgacaggtcttggtaaattatttagggatataagaggaaaaaatgactcaaggatgactctgatgcttttagcttttagcttggaagtatagaattgtggttggaagtatagaattgtggttgtgtttcttttttaaaaaagaaaaaaagaaccaacttcgtgtggagactataaagctagtttttctaccttttattttatcagtatgtccttgggcaatttcctcaaattttgtgcctaaatattcttacttataaaatatgtaatacgtatgtttacttcataggattgttgtgatgattaatgagttagtacatgtaaagctcttaaaatggtgtctggagtataataggtgttgaatgaatgtttcttttttattattactataatgtcactattatcatacatcatttttatcattataattatgcattatctgaattaatgaattccaacagaaaagatgattttgaagaaaatataatgaatccaactttggattaatcattttagtcatccagatagaagtgacaagtttgaaatgcagttctggaaagaggggacagctagtgtatatatttggaaatcaaccatgtacaggtcatatttgaggccatgaaatagcttggcttgcccaagaggaaagtataagaaaagaaaaaaagacagtaatattgagaaacaaaacaatcctcctagaaataacaatacttaaggaatgagtagaagatggtcctcgtagtagtctgaagatcagagatatactagaagaccatgcaaagacgggtgagttaaccaaaaatacccaatatgaagatgaagaaaactgcattgtcaaattctataataatagtatgactcagcctaaagaatgttagttggaattctacaaataattgttatgaatgaagcaattaatttgataattgagacatcattggtgacatagcaaactatttttatccttcctctatcgcattgattagcatctgaataaattgaaaaataaatgtgagacttaaagcagtttaagtagtgttaggtatgaacttcagatttcagtgggctaagctgttactagagaaacgaggaaagttatgctttggtaaaaatataattgtagataatatcttctcttaaaatgagttatatgccacctaaacttgctatccttcatgccattgtgaaaatagtgtttgtaaattttgtccatgggctgaggaaagaagctacccatatatggagaacctaagaaaatgaactggagaaaaaaagaagtaaaattgtgaagtcagataaactgtctggaaacaagcatgttaaaatccaaagactttttgtacgcagataataaccaattaaaaatataaagaaaataggattctatttacagaaacaaatgtaaaatatgatagttaagaatcattgaccgggcgcagtggcttacgcctgtcattccagcactttgggaggccgaggctggcggatcacgaggtcagaagttcaagactagcctggccaacatagtgaaaccccatctctactaaaaatacaaaaattagctgggcatggtggcacgtgcctgtaatcccagctactcgggaggcacaggcaggagcattgcttgaaccgggacgctggtggcggaggttgcagtgagccgagatcgcgccactgaactccagcctgggctacagagcatgactccatctcaaaaaaaaaaaagtaaagacaagaaaagaatcatcttaccaagaaatgaatgagatctacaatattttgctgggcttaatggaatgagtaatcagattgccaaatgagaagattggaaaaaatcttagtgacaagatttttaaaaatatagttaatttaattttaataaaaatctcaatagaatacctttaggaaatttaaaaatcaattttaaaattcagagaagtgaataatttttggtaagataatttcaaggaagattagtaagtagctaaacagaacaaactattatttttttatttttttattttttattttatttttttgagatggagtctcaaggctctgtcgcccaggctggagtgcagtggtgcgatcttggctcactgcaacatccacctcccaggttcaagcgattctccaacctcagcctccctagtagccgaactacaggcgcgcgccaccatgcccagctaatttttttgtatttttagtagagatggggtttcgccgtgttagccaggatggtctcaatatctggacctcgtaacttaccctcctcggcctctcaaagtgctgggattacaggcgtgagccaccgcacccagctaacagagcaaattattaaaacacagctaaaaaaacacacaaaataattaaaacagagatcaaagaaaaaaatataatgggcacaattcatgaataaattataaattattcattattttacaaacaatagtgaatgaattacagaatatttaacttccttaataataaaaatatgcaaacaaaaagcacttgagaaatattatcttaccttgttgatgagctgataagtgaggggacacctatcctagtatgtttgataaaaataattacatacttaaaatgtttacattctttgtcccagaattgatatttctgtgaagctatttgaacaacattgaaatacagaaaaaagacatttatttaaatacatttattaaagcattatttgtaatcacaaaatattgggaaccttataaatgtcccacaaaatgagaaaagttaactatggcaaaccatattatgtaatactatacaagccttaaaattgtaattatgcctgtaattccagcactttgggaggccaaggtggcaggatcgcttgagctcaggagtacgagaccagcctgggcaacacggggaaactccatctctacagaaaatacaaaaagttagctgggcatggtgtggcacacctgtagtcccagcaacttgggaggctgaagtgggaggattgcttgagcctggggagcagaggttacagtgagccgagattgtgccactgcactccagcctgagcgacagaggaaaaccccatctcaaaaaaaaattaattaattaatttaattaagttagaattacatggaaaatcattattataaaattttgaataaaaacttgaatgtgaaaatatgtatgcagtttaacttacaaaccagaatgtatatgtatatgtataatatatcctagattctctttcaatcatttttctcttgggatctgaattatgcattgctttgctaaggatgcagtaatctaaatagaaacattgaagcatatgtaagtaggggcttatcagatagatgttagtcttctcgcttaaatttagcatatatatttaatattactgcatgacaaaataaatat

SEQ ID NO: 5 - DNA, 19193 bp, Homo sapiens
tgttgagtttctgctgctacttgaagtttcatgcttgttataccttcgttatatattctctttttctgcataaaatgacaatttgtatctaatttaatgctttctgccttggactctatcttgtctaagactaaaataatgatcaatatctgctttcaacttttcaaatacccacatatccttatttcccattgagtggggtagaaaaagacaaatagaatctggttagtctctatggcaaagtcatacatatgagatctagaaacatttttcttttgccaagggcattaaaatggcaggtggagaatcagtactacaaacaggcatatctgcttttagttttcttttattaattgtttatgtaacttatactagactgctcatgatcaataaaacatgcaggaagttacaagacctttttccatgactatcactaattcagtcagggtattagtagtgaagaagaaaacacaatctcaatataagcaaatatacctagtatccaacaaaataagctctcagctgggtgtggtggcatgtgcctgtagtcccaggtacttgcgaggatgaagcaggaggatcgcttgagcccaggagttcgagtaggcagagctatgatcgcaccacatccagcccggatgacaaagcgagactccatctttaaaggaaaaaataaaaaaaaaaacctaagcttttaaaattagtcatctaatgaaccactgaatacgataattatgtcttacatatttacaatatacactctctgacttaacgatggtctgacttgggatttttaaatttaagatggcataaaggcacatgcattcagtagaaaccgtactgcaagtacccacacaacaattttagttttcactgttagtgttcaataacttacatgagatatccaatactttattataaaataggcattgtgttagatgattttgcctactctaggctaataaaagtgttctggcaaagcaagctagaatgtttggtaggttagttgtttaaatgcatttttaaatcatgacattttcaatttataaagggtttattgggacataatcccatcagaaattaagggacatctgtatgtaattcttaattgtggataataataataaaagagaggttggatagatgaaaacagctacatttcatgttttactatcaaccttttatttttctcatgcttcaatacctagaagagtggtaaaatattgcagtttgagtgtctacttctttattttatatctaacattaggaagtgctaaagtgtggaaaaccagacaattctggaatgcagagggaggagagaaagctccagtaagctacatgcttcagacataggcactgaataataaagaaacagaaagaaatatagaaactgaattgctaaggcacttttattgccactcctaagaaactcaacattatcagcagtagtaatggccatcatttatacatgttgattttataaacttattttttttaaagttctaaattgctctctctccactccctaaagctggattaaaacctattgcttccaaatgctgaattaaggaaattctgtgccacaatttttgctacagaaaattagtgtgagcacagaacgaagagcaatcttatatgcataggagcctgctgttggagaaagctcaataagagacatcaggaggtttggcttcttttcagaggacttaggaagttttgatacctaaatgatataacataagactaacttttgaagtaagtgctaaaactatttatatatactagacaattttctcaagatttgtcctttttgtctcttagactctcactaaaactccgtcatcaagttgtaattcacacatgtagacaagccttcagcctctccaaacatttttaaaatctgtaaattcaaaacatttaaaaagaagacacatgatctcatctggactgctgcttgatcttgtttgatattcttcagcactctactttttataacgggtcaatagcagacgggcggtaactgatctccttatttcagagctgaaaacacaaggcactttgcgttgggtgcagttctattctgttatgctactcccgtttgtcagtaggtaaaaacttttcccattccccagaaggcagtacttctatgaatagttgctttagacaagcattcattgttcaaagggtttgattcctcactgagcaaaagctacagcattataaagatgccagttgaaatttttttaagcttgaattttttaaagctagaaaggaaccctcactgttggggaagtcatgaaagaaaaccccttttcacaagccctggaacaagtggattaagagagtaagagtaaaagtgcaaagactgggaacctggctttattccaaaaaaaaaaaaaaaaaagccagaaaaaagccacagttagaagtaattgaacactttggaaatccctttgaagacctaatgcagtagaattttttgaaatgaataaaagctaaatgcataataatttcaggtaaaaaaatacaaacgaatgtttgaagaaccaaataataaatttataaatgtttaacgcagcgggacctagcagtaccaacctttgataatgtatggtaagcattagcaatgttgttacttggaaaagacaaattaaaaacctggcaatcttacctcatgttgttttgtactttgtatacttggcttggtttatagtgatgatattatctgtactgattatacttgttcagtagaattttgtacacttgcaaatggaatttttagacacaagaaacaaggtacaaaaattgcctaactacaaaaatttctccctcttttatattgggactaatgatatgttaaacaatctgatgtatcactttagaaaaacagtaatggcagttgcatttgccaggaaaatgttacaatagattttagctctcttaatagaacataaaatattagtttttaatatcttgctatatgtggtgtttttaaataaaaaggcatagaaatcattgatatttgaagaatgttgatataaaataatctgtgtggaggataatgtaggttgtgaactaaaacggaaaaagccccaagagtgtatatcacactaaagaagagtgtattttctgctaaatggagtatagaatgttgtgcatttagtacataggacatatgcttgcaatcctcccctaaatatcccagtggtttctttgtgcaagttttctttagactcatttctccatcttgatctgtgctgactccacgtgaggtcagtcagagaataatgttagtccaaccacttgtgtgcacacctgcatacacacataccagaaagttaatgttgttttactttaaagcagtgattttactctggaccatgtgtatgtggcagaaggatgatagtgacttgtacataagcatctacagaggaggaataactgatatgtatggtggagtttgacagaatcctggatcaggaaaaataacaatcttaaggttggaggagatttttaaaatcatcttgaccagctatccatttcattacatcattcctcactctgaggctcatttctaactggtgttaccttggaagatgactaatttttagtgcttgttttgaatttagtttgtggaatgatttctcagcttgccccataatatctactctgtacagaaaaatgttatccctttttctttgcaaagtgtgaatataaagcaatgaggctgtttttcttttatgagtcatatccggtctctgaaaacagttcctaaattggagttgccaaaatatttcatgtcatggaagcatggttagaataggcttatcaaggtgaattttctgaatggtatttcagtacttatttttatagtctcatagctctataatcacatgttgaatgggattttaatactaaaaaagaggatacataaaaacacattgtgtctattatctgcatagaacaatcgcctactttctttattaatagatcttattttgtgaaagctacaccttacaaaattttatcttgttctcacctaattatctaaacacaaggaatgatcctgctctgaattaaacctttccatttagtgtcaaactgaacagatgcaaactcacttatggggagccatcctttggaaataaactctttaattcaaaaaatatctaatattagaatattccacagaatatgaacacctacttaaattcatttcgagtaccaaagaatatttcagtaataacatttacatactaaattaaacttaattatacagcataaaacatttataaccattaaatacagaacaattattttgaattgttaagtgcttccaacatcattgacataatacattttttgaaataatgatgtaaccatttaagtaaatttttatattttattcacattaaagtttatctgtaacattaagcataacttttttcttttctctctctctttttttttttgacatggagtctctctctgtcacccaggctggagcacagttgcgctatctgagctcactgcaacctctgcctcccaggctcaagcaattctcctgcctcagcctccccagtagctggggttacaggtgcccaccaccacacccagctaatttttgtatttttttgtagagacaggttttcaccatgttagccaggctgttctcaaactcctaacctcaagtgatctgcctgcctgggcctcccaaagtgctgggattacaggcgtgagccatggcacctggccagcatacttaacctttacagaggcatttttagctggacatttacagcatttaaaggatggaattcaattaataaaaaagactttttataacattgaaacagtgagtttaagagagtaaatctgttgccattttagttagttttgacaaagcaaatattataaatggccaaatacataagcctgttattacacattaaaatgtatcctatatttaatgagcattaaaattgaagtttactagtaattccatgggatattattatgaagttataagaataggagagaacttatagtttatttctgtctcattttaggatcttcctattatggcacatgaattttaatcgactttataatggtgtcattgaagcagagtctatgatattatcattctagtatttaactacatctccccttaagaatgattttatcacccattattctttaaacctctcaagatacttcttaggctctgttctctctggagttgtgtaaattctaataatcataacatatattattatcttagaagtcattaagtcttctcttctttatttgtttttagtattcctagtttctcatgggtatagttttacaaacgctttcattctttgtatcagttttcatttcatatttgcctttcccaaaaatgcatcaaactgcttccttttttattttcttgtttcccatggggttggtaaactccttcttaaaaccttacagtagacttatgcaaagtctcatggaatttttaatgctttttatatttttttctgattttattttgttaaactgatctccactatgattctaagatctttttcctcttagactcatgtagctgcccatctaagccttgtaagtcctgttcttcattcaagtggtgtctagctacttttcattgttagcattatttatactgtaattctttcctctctggtgctaattacccaatcacaataatcatcagcaaactcagaaagctcttaatctctcctgttttatgtagagggattctcccagagtacttctttcctgaggaggcttaagagaaaaactgaaccaatgccactactgacttacagaaaacagaagcagaattacatattattttgtcttatctgatccatactttggaagtcaattcgatctttaccattcccatggattggcttaattaacaatattttattttataactataccagggtttgtatagtatatgatactattcaaagaaatacctaatgcagatgacgggttgatgggtgcagcaaagcaccatggcacgtatatacctatgtagcaaacctgcatgttctgcatgtgtatctcagaacttaaactgtaataatgaaaaaaagaaaaaaatctgaaaatatatataaaatatttaaagctagaaagtaacaaatagaaatcaaaatagtaatataattattaaaactataggaaggaaaaagatataggaagtaaatgagtgaactaaatctttactctctatagctgagagtcaaccaatgatattcaagttgataaaccaagaaaatatcagtaaaatcatgttatttggagttatctatgtaaataattgaatgagaaaacaaacatttaacctctggaaaacttgtttaggaatgcaaaagaacagagaagggaactttgctttttgttttatgtcattctctaatattatgtttttttccccatgcatgtgtatctattgacatttttagataaatatgatagatagataaatagatatatagataataggaagggagggaggataggatggagagaggaaaacctacatacctagggtttaacactgcatagtgaaatttcagaagatttttttcttctttatacctttttgtatggcttggatattttacaatgagtaggtaatgtttttataaaaataagaggaaaataaactgtttcccctttgtaaaaaaagaaaatcttaaattaaaacaaagatcaacaacaaaacaacaacaaaacaacaaaaagatcaaaaacaacaaaaaagtgccttcagttaaatgatctcttttaatactggagagaaaaagagttaaagtagctggcctataatccattcacttactttctgaggaaacagaaatgggggtgttgctggaatgatgtggagcagggaatttggtgtaatttccttgtgaaaagataatgactaaacctcctcgtaaatgaactaatagtattagaagaaaaagataccttatctatgaaatactcttagcaggatgttcctggtttaaggttgcttataaaacatcaatccagaatctgtggatttatggaaaatgagaaatataaaagctggctgacaatttagggtgtattaggccattcttgccttgctataaacaccagaggctgggtaattcttaagaaaataggtttaattggctcacggttctgtatgttttacaggaagtatggtgccaacatctgctcagcttctggggaggcctcaggaagcttacaatcatggcagaaggcaaagggggaacaagcgcatcacatggcaaaagcaggaacaagggagagagtatggggggcacactttacaacaatcagatctcatgtgaactcagagtgaaagctcggttattaccaagggaatagctcaagccattcaggggcattcgggggcatgatccagacacctcccaccaggacccacctccaacactggggattacatttcaacatgagatttaggcacagacaaatatcctaactctatcatggggtatgaaatgtaaatatttaataacttatgcttcactgttttgtgagatagatgaaggcaatgaagcattgcagggtcatggatggataaagttactggatctagtgagtacataaagtgggaagcaaaaagttttatctttggagacgtaatttggtgaaggatcctgaagatgccacctataccctgcgcaccaggcagatgcaccaaagtatctcagccaatttcattgagattcagactggcaaggagcttatggtaaagtctttataattgaattaaaaacttaagtaattgtttctgttatttaaactcactggaaaagcttcaaaatgagacaatgatttgaatgaaccagtagtctcttggttacactattagggataatagatatccccatcgatctagaacttataatgtcacaattgctaccaaagttcacaggacagttagtgtaaggaaatccagaactactcacattggggtagaacaattacctcatttttgctagctcaggattaaccattagtggataagttgcttgttcacactggctttctgtgataaagaactcatcctgcacctattattaatgttattaccatggtattcaaccaatagtctcatatcttcatcagaaacttgttacctatgagtttagtactgagacccagcctgggtctccctgctgagaaggagaactgaatgaggggcatagagagtatagtaatggatcatgtggaaaatgatgtgttttctttgagcattcatcaccccatactggcaatgtacaaagagaatgtgactgacttgcaggtgcatagtaaagacagcaaagaaaaaaatgagggggctgatggcgtcattagagcaaggagctcttagagtcttctcattcccatgggagaacttggcacaaaacctctacttggaagtaacttttctttggctcccagcacacacacactgatctacattgaaaaaaatacaaacataaaagtagctcttatatagaaaagtgggtggatctttaatcagtttgatttgtcctctattcttggcttatttgtaagtagcttctattcaaaccattctttatctttatctttcaccttaatacacacacatgcatgcatgtgcacacacacgcaaacacacatacacacaccattcaattttctccccacctcagcctgcattagctattctagaactgaatgtcgaagaaatctgttgagaaagctgctgtgctagccaaagcaatgaagaattattttatgtgtatgaagaaatattgtagcatagaaaagtacatctcaaaatatgttcttagattgctacaacacaatactctaaacagtaaaaatgaaaattcccttgcttcactccacatttggggtagggaccaagaaatctatatttttagtacatgttccatgtgaattttaagaacaatgattagtagaaagaacactagattagatgtttctggaagagttactagtgtcacgtcgtaactcttcttcttcctgtctaggtagacttggccaaattataaaaatattctgagacttagtttccttattgtaagataaggcaattaaactgaattcccatggtggggcagtcaaggtcgaactaataaaattcactgtctagttgttcagtatgaatgttttgaaatgaactagccatacaaacaatgctctcttaaggatttgcctttcaatttttcctctccttgcatgctctgagaagcctcctgtagccacaggagcaagaacacttggaaaaaatatgtttattgagaagattgccaatggttacaaattcctggcaacttgctcagttctctaagtaattggccatgtggctactccatctaatatgatgggatgtgaccagtatgttaataagtacaatattgttctatctctttaagctccaagtctgtgaactttctcgggaatttatatgcaatttgaagaaatgtgaattaaaaaaaattgttagcatttgctttgtttttcataacatttcctcctttgggatatgtatgtagacaacagctacaaaactgctatagatctattactttgaatttttaattacaagctatatgcctaatatactttattagaaagtttggtcctctatgacataaataacaaaattgataggaaattctcagtgaaaatacttaacagttatgatctgcaagataacagaaaggaatagattgttgtcgcaagataatggttgctgactgtgagataagtgtcaaggcaaagtcattccaaagtctggccatttatcaaaaatgaacattgaagaaaagtaggatacatttatcaagcaactgttttagtacaaacattttatttttcttttcctagctaatctatgatttagatgctgtcatttcacttgccaggtatttgtgcagctaaatgactcaggtcaccactgcattgtttagagttacacaaccctgatttttgagtggttattgtgtttatcccaataactaccttatagtaaggaaatagttaagaaagttaattgattgggctctgttttagtttcttttttctttctatttagaattttgcttattctcatctgtttctttaaagtgatttagtatggttcacattaaaatgcacatttaatacatttgtatatcaatataatattgatataggatagaaatttaaataaaaatctagaactaaggggaatgataatcagaattattttattataagcattatgattctaacaagtatactgattgctctacacattgtcctctgtgacagatgtggcttatttaaccacaagtatgatattatcatttggtactgacagggctattgtcatccgaagccatttattcctgtcaccactcataaattactgtaaaaaagaggccactgttctcctaatttaacatgttcttccacattccaaccatgatggtgattttgtaatccatttgtcttcttaaagcaataggaccataggccaacttcctcaaatggaaagcaagcccccaataattagtaagctgatagagtacataaaaatctttgtataactcatacaaatatatgtactttatttccagaactacttgggaaaggcattacttgcggaatagacatagtaaagattttcctcgttctcctccctgaatattcagagaaactgtgtgtggtatacctcttccagaatcttgcctaattcctggatcttgcacactcaattttttcagttgtaggagaggctgaatttttaaaaatgaacatcatggaccctaaaatatggtttacctaaaagctttatattcttcattactttcttaattcattcatgtgttcagccaaaacttattgaatagctgccatgtgcagagtattgtatattgttaaggttaaaaaatatagatcaataaggcatgacctctccattgaggaattcctagcttaaaggatattgatatatatgtatacatatatatatatttatatatttattaggctatggatacataaactcattaggctatgaatatatatatatatgaatatatacatatatgttgtatacgcacatactcatgtttaggtaataataagtaatcattacaactgggaacatatgtttgaggtagggttgaggggcaagtgaagaatgtccagaaacttaatacaactttagaatataaaagaccttgtgtactttgtcaagaagtttgaattttatcctgtatgaaacagaaagattttaaacagaaaacagaagtgctttaaacataggaatgacggagtcacacctgatcgtatcagaggcatcatgaaagcataaaatattggaagtgggaagtctttgctacactttaaataagagttagtggttgcttgaaaaagcaaaggggagtagaggtgatgagaagggcattgagtatgcaagagaccagattgacaggtcttggtaaattatttagggatataagaggaaaaaatgactcaaggatgactctgatgcttttagcttttagcttggaagtatagaattgtggttggaagtatagaattgtggttgtgtttcttttttaaaaaagaaaaaaagaaccaacttcgtgtggagactataaagctagtttttctaccttttattttatcagtatgtccttgggcaatttcctcaaattttgtgcctaaatattcttacttataaaatatgtaatacgtatgtttacttcataggattgttgtgatgattaatgagttagtacatgtaaagctcttaaaatggtgtctggagtataataggtgttgaatgaatgtttcttttttattattactataatgtcactattatcatacatcatttttatcattataattatgcattatctgaattaatgaattccaacagaaaagatgattttgaagaaaatataatgaatccaactttggattaatcattttagtcatccagatagaagtgacaagtttgaaatgcagttctggaaagaggggacagctagtgtatatatttggaaatcaaccatgtacaggtcatatttgaggccatgaaatagcttggcttgcccaagaggaaagtataagaaaagaaaaaaagacagtaatattgagaaacaaaacaatcctcctagaaataacaatacttaaggaatgagtagaagatggtcctcgtagtagtctgaagatcagagatatactagaagaccatgcaaagacgggtgagttaaccaaaaatacccaatatgaagatgaagaaaactgcattgtcaaattctataataatagtatgactcagcctaaagaatgttagttggaattctacaaataattgttatgaatgaagcaattaatttgataattgagacatcattggtgacatagcaaactatttttatccttcctctatcgcattgattagcatctgaataaattgaaaaataaatgtgagacttaaagcagtttaagtagtgttaggtatgaacttcagatttcagtgggctaagctgttactagagaaacgaggaaagttatgctttggtaaaaatataattgtagataatatcttctcttaaaatgagttatatgccacctaaacttgctatccttcatgccattgtgaaaatagtgtttgtaaattttgtccatgggctgaggaaagaagctacccatatatggagaacctaagaaaatgaactggagaaaaaaagaagtaaaattgtgaagtcagataaactgtctggaaacaagcatgttaaaatccaaagactttttgtacgcagataataaccaattaaaaatataaagaaaataggattctatttacagaaacaaatgtaaaatatgatagttaagaatcattgaccgggcgcagtggcttacgcctgtcattccagcactttgggaggccgaggctggcggatcacgaggtcagaagttcaagactagcctggccaacatagtgaaaccccatctctactaaaaatacaaaaattagctgggcatggtggcacgtgcctgtaatcccagctactcgggaggcacaggcaggagcattgcttgaaccgggacgctggtggcggaggttgcagtgagccgagatcgcgccactgaactccagcctgggctacagagcatgactccatctcaaaaaaaaaaaagtaaagacaagaaaagaatcatcttaccaagaaatgaatgagatctacaatattttgctgggcttaatggaatgagtaatcagattgccaaatgagaagattggaaaaaatcttagtgacaagatttttaaaaatatagttaatttaattttaataaaaatctcaatagaatacctttaggaaatttaaaaatcaattttaaaattcagagaagtgaataatttttggtaagataatttcaaggaagattagtaagtagctaaacagaacaaactattatttttttatttttttattttttattttatttttttgagatggagtctcaaggctctgtcgcccaggctggagtgcagtggtgcgatcttggctcactgcaacatccacctcccaggttcaagcgattctccaacctcagcctccctagtagccgaactacaggcgcgcgccaccatgcccagctaatttttttgtatttttagtagagatggggtttcgccgtgttagccaggatggtctcaatatctggacctcgtaacttaccctcctcggcctctcaaagtgctgggattacaggcgtgagccaccgcacccagctaacagagcaaattattaaaacacagctaaaaaaacacacaaaataattaaaacagagatcaaagaaaaaaatataatgggcacaattcatgaataaattataaattattcattattttacaaacaatagtgaatgaattacagaatatttaacttccttaataataaaaatatgcaaacaaaaagcacttgagaaatattatcttaccttgttgatgagctgataagtgaggggacacctatcctagtatgtttgataaaaataattacatacttaaaatgtttacattctttgtcccagaattgatatttctgtgaagctatttgaacaacattgaaatacagaaaaaagacatttatttaaatacatttattaaagcattatttgtaatcacaaaatattgggaaccttataaatgtcccacaaaatgagaaaagttaactatggcaaaccatattatgtaatactatacaagccttaaaattgtaattatgcctgtaattccagcactttgggaggccaaggtggcaggatcgcttgagctcaggagtacgagaccagcctgggcaacacggggaaactccatctctacagaaaatacaaaaagttagctgggcatggtgtggcacacctgtagtcccagcaacttgggaggctgaagtgggaggattgcttgagcctggggagcagaggttacagtgagccgagattgtgccactgcactccagcctgagcgacagaggaaaaccccatctcaaaaaaaaattaattaattaatttaattaagttagaattacatggaaaatcattattataaaattttgaataaaaacttgaatgtgaaaatatgtatgcagtttaacttacaaaccagaatgtatatgtatatgtataatatatcctagattctctttcaatcatttttctcttgggatctgaattatgcattgctttgctaaggatgcagtaatctaaatagaaacattgaagcatatgtaagtaggggcttatcagatagatgttagtcttctcgcttaaatttagcatatatatttaatattactgcatgacaaaataaatatgagcactctcaaaatgagttgatgaaaagtgacattaaaacaatctcagtctatcaaggtagctaatgcatattggataaaaattctttgaaatctaattttgcattttatgaacaaattgaaagtaaagaaatttcagatgtagtagaggactttttagaattaggatggaattctgacagcagatgtgtctgcagttggaaattgactgcaggtcagaggtgctgttctgcagcagcagtcattaaaacagctcctgtaagtgaggaagtatgtggggctatctctgggagcaatttacctcagataggatttgttctagttgtctggtaagggatagtatgttctgggaggtagttattatggagaggataaagctgaaaaatatgatgcaaaaattaagaatttataacaatgtttacacatttgcccagatataataactattaattttctgcctctattattcattctgattaatgatcacagataaaataattctggaagtaaaaaaattggtttgcccatggcaaatcaattattttaaaaatgaagcttaaatgtcgttttagtgaagagtataaagagcaatgggctgcaaatctgaatacctggaagctatggcagtttaaccattactacatcaacaaaggagcaagactcacggcatttttaaaaattgtcactaagatctcttctatccctaaacatctatgaccaaaattttaacaacagccaatcaataattatataaatgataatagttaatatttaaaattaaaatttaagtttttttttcttttgtagagacagggttccactatgttacccaggctggtctcaaactcctgggctcaagcaatgctctcatctcagcttcccaaagtacttggattataggcgtgagccaccacacccagcccaataatagttaattttatttattgtgactattaaactagatgtggtgcaaaatgctctctatgaattattctttttaatacttgcaatgacttcatgaaatacattctataggctgggttcctaggcaatatagtaagaccttatctctatttaagaagaaaagaaaagaaataggttctattatagactccatttcttaatgagaaactaggggtttagagatgttaattaacttgctgaggtcatatagctgcaagtagcagagtcaagattcaaacccaattgactataaatcccagactcagaaccactacactaccctctctccatatctcttatcttatttcgtaccaccttatttctaagcagtcagagcataggaatgactgattataaatatggaaaatgtgcattaaaaacactaatgatgtaaaaaattgtatctttctcctattattctctgcatcactttgtagattgcatcacaaatatatctttgtcaaatacactgaaagagcatttttttcctctctatatactcacttgtcggaatctttaaaaacaaaacaagggagaggatcatgtttaaaattactattccataaaattactagtccataatgatgtccacaattcactaagcttggcacgtacctctatggggtatgcacatggttatttttataatgcctttgtgttccatgaatttttgccttattcagatagaaaaaggcaacttttttttctatctgaataatgaagttcactggttaattcattagtgaaagaagattttttaaagtttgtcattttgtgctatattttaactgaagtactttgatgttaataaaaattgcacaaacatagctatgtaaagtttatagttactctaagcatgagtaaatgtggctaatggatactttctagtatattgagcagatagtaattatgcaccatacataaagccttatttgacaggcatatgtcagagccagcatatgtagggcactggagttacagagaagaagcagacactcctcctacctttaggagtctttccatctagctggagagatacacatgaacaaacaatcagaaaacagaacaaatgctctgacttgcaatgtgagcacagggaacaccacgttatttctacctggatatagtgggaggatggaaatcagatgtctcacagagaagaagagatttgaactgtcattagaagaaacattggccaggtgtggtggctcatgcccgtaatctcagcactttggggggccaagacaggtggatcacaaggtcaggtgtttgagaccagcctggtcaatatggtgaaacctcatctctactaaaaatacaaaaattagccaggcgtggtgacacacccctgtagtcccagctactcgggaggctgaggcagaatagtcgcttgaacccaggaggctgaggttgcagtgagctgagattatgccactgcactccagcttgggagacagagtgagactccgtctcaaaaaaaaaaaaaaaaagcattgaaaagataaaggatggtattactgataaacatgcaacgcaagtaaaggcctaaaggccagtgagtgtgtagtattcaataggatataggataagcaggtctaaatatcaagagtgaggtcaggttgagaaatggattgaacattatcagtatcttgctattaattaaaatctttgcacagcatgagaagcagagctagaagaatagaggcttgaaagggcgatggggaacagaaacattaaaggcgcgagatgctaatgaggggcccaagatggtgctttaacaaattgtttccctccttataaattgttctatatccagtgctgcctctcattagctgtgtaaccttgtacaaccctcatcctgacacaacatctgtcatctgtggaatgaagaaagactcattcattcattcccaacttgaatccccacaggtagtaatggagttttcaaactaaactaaaattccatttagattttcagtattacaaaataacagtataactacggcttgtttactgatttaaaatcttttaaaatttagggcctgcaattaaaataataaaaaatatctactagtgagaaggttgcaaaccattagcccagatgattccagttctaaaaacctgttattttattatctcaccgaatattagcagtagttggtttttaacataaaatttgtactgcaccaaacaatatccacagtgtccccatccctgagaatgcagcctgcctggcagctgcacgtggcctattagcacagccgtttacataaaatttgatgatgtctgttttctttggtttgttaaaaaataaaacacagcatttacaagcagagctagaagaatagggtcttgcaatgactttcttcccagtcatttcttgggaagaaagcaaatggtataatgaaagtaatattgagtttggacatgaatttcctgaagaagccaagtttattaatatatagttaggagtcagatttttgtttaataataaggctcttggaagaaactaaaattagtcttctggcatgtcccttttcttctttgttaaagggataggatcataactgctctcacttcatacttcatggacatttcctaaagaatattttggagtctcattgttcttttgaacattaggttcaaaaataaggtcatttaaaagcaatatggtcacctatataactatagtttttagaagaaaaattacctttatctctaaaactttgctgttacaatcaaatattgtcactgtataaaatataggcaataaagtaattagatggttttagttttaatttaattattgttttttttaagagacagggtctcattctgtctcccaggctggagtgctgtggtatgaacacagctcacttcatcctggaactcctgggttcaagtgatctttctgcctcagcctcctgagtagcaaggactgcaagctcacgccaccatggccagcgaattttttttttttaattctttgtagagacagaggtctcactgtgttgcccaggctcattagaaactcctggcctcaagcaacccttccaccttggcctcccaaagcactgggattacaggcatgagccagcacactgggcctgattttagtttttaggcaatacacctatgtattatatagatgtgtgtgtgcgtgtgtgtgtaggtgtgtgtgtgtatttctgctttgtcagttactagcagaaagctactatagcacataaatcagaaatacaacaaaaagtttgttgtgttaggagccaagtttgaaactaataatagtgaagactttaa

SEQ ID NO: 6 - DNA, 6725 bp, Homo sapiens
gaaaataatccttggaggtaaattaatcatccgtatttcacattggatacaggtattccatctttttaaaaatagcttgatttttaatagagttttaggttgacagaaaaattgagcttatagtatagctagttctcatgttacctcacttccagcacagttttcttatttttaaagtcttgtgttaatgtggtgcatttgttacaactagtgaatcaatattgatacattatgttaactacagtccatagtttacattaaggttcactgggcatgctgtacagttctaccagttttgacaaatgcataatgccatgtatccaccatcacaatatccatacagaatagattcagcaccctaaaatcccctgtgctccttcgattcacccctctcttttttccctcaacccctgccaatcactgatctttttactgcctctaacgactttattgaggtataatttacatagaataaactgcttacaatttacataaattgcagaatgtaatgagtttaacagttgagtaagtttttgaaaataccactgtaatcatgataccaaatacttccatcatcctcaaacctagccccaggcaaagtttgatctggcttatgtctatctaaaatagtttgaattttctagttttatacatgtgtacataaagtatacacatatatatttagtatatatttcaaatatttaatatatattatagatttcaatatttatatattatatacacatatatttcatacatatatacatatttattatatacatacatgtagacatacatagatacacatatatgtattatatattaaatatgtgtgtatatatgtatatatagattatgtatatatgtatgtatacacacatacatatacgtatgtatacatacatacatacgtatatgtgtgtatacatacgtatatgtatgtatgtgtgtatatatacatacatatatacacacattattttaaaatagtcacacattgaaaatatacacacatattattttaaaatataatagataatacatattatacacacatacatacgcattatatattaacacagatactagatatatacacacgtgtttccatgtatatacatagacacacacacacacacatatataatacaaaatgtactctttctttactcagcataatgatttacaattcatctatatagtggttcatcaatagttcattttctcttattgctgagtggtattctatcatatgagcataccacagtttgttatccatttactagctaacggacattcaagttattagattctagtttggaactattgtgaataaagctactatgggtattcatacataaatctttgtgtagacacatatgttttcatttatctggggtgaatacctagaagcagaatggctggtttataagacagctgagtgtttataagaaactgccagccgggcatagtggctcatgcctgtaatcccaacactttgggaggctgaggcaggtggatcacctgaggtcaggagttcgagactagcctgaccaatatggtgaaaccccgtctctactaaaaatacaaaaattagctgggtgttgtggcatgcgcctgtagtcccagctacttaggaggctgagacaggagaattgcttgaacctaggaggtggaagttgcaatgaggtgatatcatgccactgcactctagcctgggtgacagagagagactgcatctcaattaaaaaagaaaaaagaaactgccaaatatttgtgaaagtggttgtatcactttacatttgaccactagcatataacattttcagtttttctttgcctcctctaatgagtctttaatttcagccattcttctgatggatatgtagtgttatctcatcttggttttaatttacatttctttgttgactatgtcaggcacattttcatgtacttatattccatttgtatacattttttagggaaatgtctgtttcaaacctttctcattttaaaattgaattgtttacttattattgagttataaaagtaccttacacattttggattcaaaacctatgtaaaacataagtgttgtgaataatttctccaatgtcttggcctgcttttttttaacggtgtcttccaaagagcaaaaggtttaatttttataaagttcaatttatcattaaaaaaatgcttcatgctttttctctcctatctgagaaaccgccacctacttccaaggacttcagtattttcctctggaagtcttgccattttagcttttacgtttaggtttataaccaattttgagctattttttgagtatggtatgtgataagggtcaaagttatcttttcccattgttccaaaaccatttgttgaaaatattttcttttccccattgaattaatttggcatcataaatcaattgatgagtcaatttcaaaactctcaattctgtcccatagttacgtatgtccatctttcaccagtgaaatgctgccttgaatactgtaacttaagcatgcttggaatcaagaaatatgagtcctctaaccttgttcttcatttaaaaagtattatttggcatttctatataaagtttataataatcatggcaatttccaacataattctgctggaattttgattggaattgtattgaaacaataaataaattttggaagatttgacatctttataataccgagtgttccactacatgatgacagtatatctctctatgtatttagttcctctataatcagcaatactacataatctttagtgaacatgagctgcatttgtttttgaaagctactactaagtattttatatgttatgtgctattgtaaaaaattattttattttccaatggtttgctgctagtgtctctctccctctctctgtctctctctctctctctctatatatatatatatatgtatatgtgcatatatgcatatgtgtatatataatgttttttacattaaccttgtattctgtgaccttgcaaaattcattatcggttccagtagctcctttacagatccttaggattttctacttaggcaatcatgtcatttgctattaacatcttaacaatgttgatgaatgtaagatcaagcatctttgtcttactcccagtcttaaggaaaaaacattcaatatttcaccattaagcttgatgttagttataggtttttcacacatgcactttatccagttgaggaagctcccttctgtttctggcttgctgagagtttttatgatgaatgtgttgaattttgtcaaatgcttgttatatatctattaagatgactgtatgattttctgtttgtttttaaatatggggaattcttttaattaatttttgaatgctgaattaatcttgcattccttggataagcccaatatatgagtcaggattctccagagaaaccaataggatagaaagagatttattatgaggaagtggctcacataattatgaaggctgacaagtcccaagatctgcagggtaaatcagcaagtggagatccaggacacccaatattgtacttccaacttgaaggctgacagctcaagacccaggaggagccattgttttagttcaaagacaggcaaaaagaattctctcttacttgggaggtggtcagcctttttgttctagttaggccttcaactggttgaatgaggtcaactcatgttaggaagggcaatctgctttactcagtctaccctcttatatgttaatctcatccaaaaacaccctcacagaaacaacagaataatgcttgaccaaatatcagcacacactgaggcccaggcgagttgatacataaaattaactatcacacatgatatattacctttttagtatattgttacatttaattagttaatattttactgagaattgttatagctatgttcataaaatacattagtctttaacattcctttttatgaatttttttccagagtgtggtatcaaaattatgtcttataaaacaaattgcacagtatttcttccttctctaaatacatttgcataagattggtattatctgttctttacatattgatagaattcaccagttaaactatccaaggctggatatttctttgtgggaatatttttgatgacaaagtcaattttttaacagacataggattgttcagactttctgtttcatcttgtgtgaattttggtaagttgtattttgcaaggaatttatccacttcatcaaagttgtcaaatttattgagataaagttgtttgtaacattttcttatgtatttcatatgtataggatatactgttggtactttgtgttctctcctttttattgaccagtctaggtagaaggttgtcaatcatgttgctcttttcaaataacagcttgagctttcttaattttttctttttattttttctattttattgatttttcctcttatcattactaatttcttctatctactttgaatttacattactgttttggtctagcttcctgaagtcattgtgtttggaacttttttctttcctactatgaacatttatagctgtaaatttcctctaggcactgttttaatagtattgcacacatttttaatatattgcattttcattcttgataaatttgaaatgtttcctactttcctctgattactttttgatccacaaatgatttagaagaatgttgtttaattttcaaatatacaggattttcctagatatcttattgatctctaatttaaatccattaaggtcaaagaacatactctttaagcttatgatattttaaaattattaaaacttattttaaaatgtctcagcatgtgtacttgaaaagaatatgtatattgcagttgttgcatggtgttctataaatattaattaaggcaaagtggctgatgttgttcaaatcctcttaggtccttagtgatatttttgtccagtttgtctatcaactgctgacgcaagaatcttaaaacctcctatgattgtgaaaatatatatttctcctttttctcctatcaatttttacattttatgttttggaagtctacagttacctaatagttatttatgactgatgtatctttctgatgacactcttattatcagaaaatctcctttctctttcacaatatcctttttcttgcagttcattttagctaatattaataacaccactgcattctacttattcttactgtttggtacatcttacatacttttactttgaacctttttgtgtatttatatttaaagtgtatctcttgtacaattgcagttggagcttgcctttttatcaattctaataaccttttccttttaagtagaatgtttagtcctttaacatttaatgtaattattaatatagttgcatttgggtctagcatgttattatttgttttctaattatcacctttgcttttttccctttgcattaacttttctgcttgagatattttttgtattatttattttttaaatcaattttaatttatctactgctaaatggtcaatttaaatttatcttttgataaataggtaaactttaacaatctttagctattatggttaatctttttagtggttgcttggggattacaacatacatctttaattttctgtctactgtataactttatgtaacatttaaaaatcctgcaacagtataggtccatttactaacattaactggtctttatgttatcattgtcacatgtattacacctctctacatacaaacctcatgagatggtgttgtaatttttgcttcaaatggtcaaatgcacaatttaaataagtgaagaaaaatggtattttacatttacccagatatttatcagtttattcttttctaaaagtctgatttcactatcatatcattttccttccaataaatatttagatttattaatctaaaaattaataaaatataaaataacaaaataatatttttgaaactaccttaaagaaagctctaaagaaatttctttagcatcccttgtaacgcagctccattagtgacacattcctgttgttttctattatctgaaaataattttatttcatcttcattcttgaagttcatgttcacaggatgtagcatcctgtgttggctttttgttttctttttagcactttaaataaattattctattgttttctggcctctatagtttctgatgaatagtctactgtgattcaacttgttctcctaagtgtaatttgtcatttttctttattttatctttgcctctcagcagtttgactataatatgtgcctcagtgttcttttcatcgaatttaacctgttttaggtttgctgagtttcttgaatctgtatatttatatgtttggcaatatttggaaactgttcagtcattatttcttcaaattctttttctttcccattctctctcttttctctccttctgagactcaaattgcccttatgttggctcatataaaattatcccacatgtccctaacttctactcatttaaaacagctttttcctcttactttttcaaatcaaataatttccaactttgaaacctgaaaaatgaatttttaaaagtcactgtttccttcttctgtcttctctatcatgcactaagcctatgtagcaaattctaaatgtagacattttatttttcagttctaaactttgtttttaatttatgttttcatttta

SEQ ID NO: 7 - DNA, 12447 bp, Homo sapiens
tgggtaatatcatatttcaaaaactcagatccttgagcacttttttgaaagcaaggtctctacaaaagctatatggaaaaaagtaaaaattagcctggaaaagctacatagcacatatttgtgtagtaactgagcacaggtctgattaatcctcctacttaagattaggcaaatttacttagagctagaaactagaaattagggataaacacactgacatgtttggataaggccagagtgctagatgttgccatttttcaaagaagatttactaattttattatccccaagaaacatattcaaaaccaattattacatatgcaaatgtacatattattaccaataataacagggtaaaaacttaatagtatcccctctggggaaaaaatgaatgggaagttcatgggaaagggacattataaataggcattcctcctaagacttttcaccctctttggtacattataaagaaaaaaaatagcagggagaaaatgacaacgaattaatgtgaaattctgatttaggatgatgaaaatccagctaaacggaaataaaacagcatattcaagttcatctaaaagctgaactaaaactactagatctgtgaaaagagtttcaacattaactagtgaaatggtgtttacaacacatagtagaagatatgcattcttttgcataatttctgtcatagaagcaaacagtttgtttacacttgaaataaaatcagttgacattgatcaccaaggaagctcatgaataagacaagattgcttaggatacgaaaccattctccaaacgataacatcataatttaaagtggaagatggcaatactctaggactgcccagcgggctctacctagaagaggtaacggatgaaagaaaaaaaaaagaaacattttagggattttaaaactcgcatatgctgcttgtcctgctgcctctgttctgatccacagaattaaatatccacattgtctaacttgttctgacattgctgccccataaagccatggactatgacaagacagaatttcttggtgccctgtgtgagttaatctgaggttggagcatgtggttgattgtactgtgacttccctgtatccacacccttcttcagtgtcctcccactctgactctggattcagcaacggtagcaaacttaaacagaaacttgaaacctgtttgcatgttttcagcttcttcttctggactcctaactacaactcagagaaatgcctgggctagcctgctgaaatatgagacacatcgtcctacccgcacccccagatgacctgccagctgattctagagacataagtctagccaagatcagcagaactgcccagccaacttgcagatccatccaaataataaagggggttaagacttacgctgccacttcggggtgttatgcagcaataattgtggatagagtggtcaggctagtccatgatttagattgattatcccctccacctctgacataacttgggtgggtcagggccaaccactatgaagagtggaaactgagagttaaaacgagtaagaatgaaaagttatggtattacagtttctttatgaatttataaatatgaggatgttctttgaactggattcaagcctcgaaagctataaactaggtctatttacctgaagtctatgatctttaaagtgtatgaggtgagactggttactcctccgtgcactatctccacaagatgcttccacactcatcattttccttgagtccattccaaggcactttaacaatttatgttaactttcattaaataataattttaaagaccttcctagctcctcttagaaagacttggttttcaacatttcttggcatttgagccaattgtaccatgtcatttacgcccaaagcacctctagaatgttgtcagatgacaactacaatgtaattaacaagcatacgcagattattttcttaggttggcaaagtagtaactatttacacagaaataaaaaaaggccaatggcacaaataatagaaaataacaagtttatcattacaggactcccaaaacttgttgcaggaggcatggtttaatgcccttgacattaactttccaatgaactttttcttccaactaagagtggccagcgttatattaagccatttctggctgtattttcttcacattctaagcccatttccttttctgttgccagcactctctcttggctttccaacagctctggttgggcctctgttcaagtggtagtgcacaccctacctccaaggaacttgttgcaaatcttgttagtcaaaagtgtggtccatggaccagcatcagagtccagtccagtctacttaatcagaatctgcatttgaacaaaatccccacgtgattatttttacttattttataattattttcactttttattctttctctttagcttttatttagtctttacacttagctataacttggggactgtggcagtggggttccatgttattcttttcagcagttaggcagcttatcttaatcaggagggaaaaaactactagatcacatagtattgctcctccccatagcattcacaaagaagcaggcattaaggtggaattcaatacaaccttctttagcactatgatgttataaaccacactctcttcttcctcttgcatgctatagaatgacttctctgtcttcacaaccctgctggatattgagaagtcaatcataattccactattttatcccacactgacatgttttttttctcttccagccagtatatatcttgataataggtactgaatcctttttaactaataatgaaaataataacttggtcactaatttctgaaatttcgaatacatgcaaaaaaaaaaaaaaaaaaaaaaaaaaaccttacctacttaagcttaagttactgcattttcatagccatatcaatttgtttctcctatggcccacttctcccttctaggttgattccaaagatttgtttatgtgacagaaaaaataaatatccatggaaaatggtttacatactttatcatttccaatgtgtacacttaaaaaaaaaatcccttccccaatttgtctgaaagcatggatctttccactgatgcactttgtcatctttgattccccagtgattcctatagtttctgatacacaacattcaatatctgttgaatgaatgagttatttttaaaccacgttagcatgttacaattaatgaaaaaagttccaatgcaaaacattttaataggttgtcaaatatacagttattagaattatgtaaatatcacttataaaaattggtatatcacattagatgattctataaaataaaaacacaaatcacacattgacaataacccctgcagtccaagtatacccccacaatagtacaaattacaaacacatttaaaaaaaaaccctaaagacatttatacatttaaaccaaagtaactgtgactaaatacattcattcatcaagtacaataaatttagcattgctgcttatagtcactaataacacaattttaggtgcaatttcacatgctttcataaatcttccagtacagttcccatagtaaagtgtctttgtgcacgccattttcatttatatgcaggtgcatcatacatcatacttaaaactatttcactttacaaactgttaaattatatttaagtggacagtaggtaaaaaatttaaactttgatgacaaaatctaaaattaaagaaaagtcttaaaagcctatagtgacttgtttacttgcataaataatattttcacttagtacaggctattaatataagtaatgagaatttaagtattaactcaaaaaaagatagaggctccaaacttttctaagaaattaatgcattttcaaagtaataatataatcaatctgtaagtcaaaagtaatttcatattcattgccaaatttaaaataccagtgatgttaagattgaggcctaaaactgttgtactaaattgtaaaatacagtaaagaagatgcagctcatttgcttgggaatatgtaatggaatgtttttcacagtaatgtttatgttaaacattactttaaatggacagtctaaataaatgtacctttgccagcaaggaaagtgaaaaattaaggcttttttatgctatctgtaactaatacccaaacttaaatagaggttacaatactgtaaaatattacttctaacttcaactattgttagatgcttcatttcaaccccacacttattatcttatttagatgcctatttttctatatctctattttaattaagtccccaatcccaccccatccaaagagaatgctgaaaatggttagggccttatccgtttggttcacagttgtaatactgggggctaaaaatgcttaatacatggcataaatccaaggaatatttttgaatgaactaagaagcctggcctccaaaggcaaccctacttgtttttccaaagcattaacagataattgttacctctttaaataatcagattgacaattattaaaaaggaatcgatgtttcctaggctatgaaaacatcaaaaacatgtaatagaaagggtaactgagggtacaaacatatcaaatcaagactaaaggcactggagaaagaaggtaagcattataaacaatttttaaagcaaaacaagttttaaagtataaaatgccaaactactaagagaaaatgtactaaaatgacaatgctttaccatagtggacacaattcctgtaatttcataaacagaattctttcgttgttctatcgttttctttcatcctacatcttctataatattccaacccctagaaacaaatgtattttcagtagcatgaaacaaaaaattgcaactgaagtatctgtggaaattcctttttcttaaatgatgttataaatttgatacatagacttgatagacataagaacatcatcttggaaatcataaaatactaaattatgctcaatcaaaatacagacgaaggttcttcagttaaacagtttagagccccataagagcaaactgtagtgtaaagaggaaaagtaagtacaatctttccagacacacaactaataatgaatactgagttgaaataccacaagctccacattagagccatttaatatacacatttccataactgtttcttgaaaaactatttagataaaatatttagcatttatcattgattttaatttatttgaatctatgcaatgtctatccatattaaaatatcaattaatgtaaatattataaaactattatacaatttaaatttttattagagaaaggtattattcacatccacaatttcttaaagtcctttttaaatgagtgtattccataagaaatacactaaaatcattacttatgtttcataggggaaaaaaaactatgagaatcctattaacccaaactatatccgcattatgcttatttcttaagcatttacatgttcaaatatacttggtgaatagcgatcattcatccccacagtggtaaatttcagcataatattaagtgaccgagagagactaagatagtcacatgtagattagataaacagatacttattctgttatacctaagcctacttataaagcaacataaaatgagcattggataacaatgataacaaatgtaaacaaacagaattaaatgttaatcccttccctgaaaaacaacagataaaagggcttcttgctttattaaaaacaaaacatgatctattgtatcaaaaaggtaagacattgattttacaaaattgtatttccaaatgcagataaaaaaatcttgaacattaagattttattgagctaaaatgtgcaaaaaatctgacaatacttaagtttattaaattcattgtacataggttgatatcatcccatacaaaaaaagcctcagtatcttgttaagattcaaaatagtgtttaattatctgagcttaagatttattgaaccactatccaaataacaacaaaatccatattgtaaaagaaaaaagtaaaactaaaaattctgattattatgacttgaaattcattcccgttaaaacataaaactatagccaatatccattcaaaaagtgaagaaaaattggaagtccctatgataaatacaccaattctaaataaaaaattaaaatcaaattttgctattacaaaatgaacatgatcttttaaattattcaggtttaatagatttactaaggatagagttcatagagcatttagttggtacttctgtttggactcaggtatttgcaaagtgccctcagagaaggctgagaaggtaaaataaacataaaattgtgataattttctccacaccacaataaaggtgctcggatttaaaaattcaatttgtaactccagaagaaaaagaggagaaagaatttacaaccccaaaatattttccaggaatatgacaaaactgataactacctagaaatgttattagtgaatggaagtgcaagtaatggcagcattaacatcaaatgtatttgaagactcaaagttttaaatgttttaaatgacaaataactagttgatttttttttaaggtggtgggtgtgaaacaaagataatacaaatctaatttttccaggaactgtagcactgcccctgtccccatgaaattaagttacaatttcactggtcaacataatataaaactgttttgaggaagagtgaaatagaagcatgaatatagatacgcaccaaaccctatattacggactaatttacacacagtatttttgataacaacctaattagatattgtctttcattgcttactataattctgagaaactgtttttaacaacatacatttacactaccacttaactaaatggggacatataaatacataaatttttaaagaaaaaaattcaagttatttagaggagaaataaaacttcaattatttacttttttgaagctgcatttagatacaaaggtatatggtttatgatactttcacaatgtaataaatttatattccaattttctcatgaatgaaagattgtaaaggaaaatattttgttccttgaaaataatatctctcttcccctaaccccagtaaggacaattagtgtgcccttaatttcaagactttgttgttgtcatccacatcaattgtctttttcatgaagtataatattttgagagagagatgtaaaaattaaagagaaaacctgcttttggaatgcaacaattctaaatcatttcactaaggagcaccctttgatatgctggtctgaacttttaatataaaacctaaacagtacttatttctgaagtagaattttctccagttttagtaacttcatacatagcaatactaaggacatcaacctgtgctttcgagattttggtaggtgttctaataatgtaatattttagatatggctcattgtcaaggctgggtggacagagatttcatgaattggctacagaaagctaactaaactcttaatgactgaataatggtttgcattttgcttgagccaaaaaagatgtttaagccatgtaccaccacattccctgcttaacattcctaagtttctttattcttcatagttttctaatgaacaaatagttagttttcctgagtaagattataaaaaagttaaccattcttccaaaagtataaagacaaataaaatgtcgactcataatacaaattttttacatagcattaaaggtgcagatattgactgcccctcttcattatgattggcccaccccttaaaaagactgcaacagaggattcaattgtctaaaatacttcgaagtacagaaattaaatgctttagcccataaacatatccctcatctattgtgttgctagggaacacatgagcaaaatctatcattcgcacttctacttcagcaatctcttggcaaccagtgggaagatggtagaaaactttttccagttgggaaagtacatttccatttaaatgttcctgtgacatgcttttccacccattgtcttgctccagattttcaactttcaatgaagtctgactgtgatgcttttttgtatatattttcctgtgacgcgcatacatcttggacaagcttttgcccactgaagactctatttttccattagctgtggaacttaacacatgaaagttattattgtactctagtacttctgtgtctgacagttgtcctttggacaaaaacttttctgccaaagttctgtcattcaattttgtagtggttggctgagatgaaccttcataaacaaagagtaatgaacttgcgtaaaaattaagctgcttctggttttcaaaccactgcagaattttctcaatcttctgaatactggcagcaacagcatcttttcttaagcagtacccattatgaaaaaatctggagactcctataaaaagaaaaatatgagcgttataatcaaattatgaaataactattatttgggaagtaaactcatcacagaattctccaatattttccccatcatcccttagaattaagtgaacagttaatcctagaattctaagaattctagtcagatatagaagtctgacctcagcttgatttttggtgaagatgctcttattagaaaacatttaaatgacactaatataatatgaaatatcctatttagacaaaaggaaatttattacaggtagactggtagtttacttctctcactatattctcttaagaaacaggattccaggctgggcacggtggctcacgcctgtaatcccagcactttgggaggccaaggcgggcggatcacgaggtcaggagatccagaccatcctggctaacacagtgaaaccccgtctctactaaaaatacaaaaaattagccggggatggtggcgggcacctgtagtcccagctactccggacgctgaggcaggagaatggtgtgaacccgggaggtggagcttgcagtgagccaagattggccactgcacgccagcctgggtgacagagcgagactccgtctcaaaaataaataaataaataaataaataaatacataaatacataaacacataaataaaaaataggattccaggccgggtgcggtggctcacgcctgtaatcccagcactttgggaggccgaggtgggcggatcacgaggtcaggagatcgagaccatcttggctaacacggtgaaacctcgtctctactaaaaacacaaaaaattagctgggcatggtggcggacgcctgtagtcctagatactcgggaggctgaggcaggagaacggcgtgaacccagaaggcggagcttgcagcgagccgagatcgccccactgcactccagcctgcgcaacagaacgagactccgtctcaaaaaaaaaagaaaagaaaagaaaaaaaaaaaaaagaaataggattcaagacttgctctatttgctatcttgagcaattttacagtaaaattacttgttcgggctgggcgcagtggctcacgcctgtaatcccagcactttcggaggcagaggcgggtggatcacctgaagtcaggaattcaagaccagcctggccaacatggtaaaacctcgtctctactaaaaatacaaaaattaggcatggtgacgcatgcctgtagtcccagctacttgggaggctgaggcacgagaatcacctgaacctgggaggttagaggttgcagtgagccgagatcgtgccactgcactccagcctgggtgatacagcaagactgtcttgaaaacaaaaaacaaaacaaaacaaaaaacaaaaacttgcttattagaatctcatttagagctaactaaaacctagagtcaaatttaattattttttaatggtaccattactaaataccaaaccataactctaccataactctactaattttcatttgctctcaataatattgattaagtcaatttttccaaaaagttaagctcacttttgggaatagcactttcccacgttaggtatattattgaaaattgagacctttaaatgttttaacctatcagattattaggcctttttaaaaactatgcctattttatcatacttgggaatttataggtatatataatttgatttctgctttcaaataacttgttcccccaatttgggacagaaactattaaaagatatattcagatatgactaaattattagcctgggaaaatattttttaaatagcccagctgaatgttattttgttgttgattaagtactccaaagcaaacactaattgttaagctcatgctatggatgtttgctttctatatataaaataagaattcttctacaaactttttacactatgcataagttcttctctaaatatcttagtagagctaagaataaacttgtaatataatgttatttccaggaatctaggatattgttgcttttgtagtatcttggccgtaaatactttagaagcatgtatgtatgttaacagattttatttaaatcagtttaatgccacttaattattcattatgtagctctagaaacttacatagctcaactacacatgggaaaattcaataaaaatacattaaatgctacaacacatattttaaagcctcttatgtaacaagcagttttaatatactatgatctataacgtttacttacaaaataattttatacacaacctctagttccagtattgagttagatggctggtacacagctgttcattttttttttaagtatattaataagaaataaatgaaaatgtaacagagggccattcatagtcccatgctcttgatatattatgaaccagggcttatggttaatccaattctgtaaatctaagtttcattattatttaaaaaatgtttattatgaatcaaatcacttttccaaatgacaactaaaactgaaataactttagaagtcttttaactgttcaatcataaaagcattagttttttagtccttaccatcctttatagtttcttttgttaagcttcttccgtaatgctggttttctgtctcatagctatcggaatgaacatgataaacctgtcaaaaaaagcagtgaatattaaaaagctaatactccttgaccatgtggggttatcccagccacaagggtggctaaagatgaaatctactcaggtaattcattctaatagatttgagaagaaaaaaaaaaatcgcagttatatcaatggatgctgaaaaagcactttacaaatttaacatccactactgatgaaaactctctgtaatataaggatagatgaatatttccaatatgataaaactatctacctcaacctacgaggagttagtctcaagtttaaaggagagaactgaaaaagcacttcttttaaaatacaagaagccttcacaaaaatattttatcatgatgtcttttatattattatcatctaatattctggagttcctagtaaatgcaattagagagaaagaaattagaggtataataatttggaaaggtggagataaagttaatactctgaagataatagttgtacactggaaaataaaattaaagacaaatacaaataataaaatatatgacacggcatttgaatacaaattagtaaacagaaaataagctttctaaacacaaataactcattagaaaatgtaatgaaagaccccatttataaaatgtaacccccaaagaacatgaaaataagctagataagtaaaagatgtaaaagaagatatctttaaaacattcctaaaacacacacctatgttctcaaaaaagattcagcataataaactatatcaattttacttaaattaatctacaactaaagtgagattataataaaaataccaacttttttttggttgggggagggacggagtctctctctgttgcccaggctggagtgcagtggcgtgatctcagctcactgcaacccctgcctccgggattcaagtgattcttgagcctcagcctcccgagtacctgggattacaggtgcgtgacaatacagccaggtaatttttgtatttttagtagaggtgaggtttcaccatgttggccaggctggtctcaaactcctggcgtcaaacgatccacccgcctcagcctctcaaagtgctgggattacaggtgtaagccaccacgcccggcctcaataattttttttaaccataagccaactctgaagttcacatatttaaaaataaataaataaataagagccaagaaaagttaaaataagattaataaggtagaactaaccttgccatcctaccagatattaaaacacattttagaatcaaacatatgtgagaatttagtatatgataatgggattttaaatcaatgggaaaagattatttattaaattgtgttagtctgattaaacagtgatcaggaaaaaagtaacttgtattcatacctgatatcttatgtcaggataaattccaaatgtatcaa

SEQ ID NO: 8 - DNA, 12677 bp, Homo sapiens
tgcaaataatattttggtttttgcaatagaagattctcaaactagcaaatgagatcacaatagtattttataatagtattattaaaaaaacacatcatggatgccctgaaagagtttggaggtccatagattgtactttgtaaactgctgctttgaggagtggaacacgtttcaatgttacatttatgtatgttacattgattttttaaaaaacgatttaaaaacataagtgtttgaaattggaataaacatatcactgaaggtttttagatattactgagtttttagtgctaagtagataagagtttgtttataagttaggatgagttataattttctgctatgaagaaaatgttctatgaacctccaccatccagtactataactactagccagttgtgtctgttgagcgcttgagatgctactagctggtgtgactgaggaactgcatttttaaaaagtgtagaaaaaacttctttttttttttttgaagtggagtcttgttctgtttcacaggctggagtgcagtggcatgatctctgctcactgtaaccaccgcctcttgggttcaagctattctccagcctcagcctcccgaatagctgggattacaagcacccgccatcatgtgcaactgattttttgtattttttggcagagacagggtttcaccatgttggccaagctggtcttgaactcctgacctcaagtgatcggctgactttggcctcccaaagtgctgggattacaggcatgagccactgggcccagccttaacttctaaattttaactttttttctttaataataggctttagtttttacaacaattgtagatttacagaaaattgagaagatagtgcggaattccagttattaacatcttacattactatggtacattgttataattaataaaccaatgttgatacattgtcattaattaaagtccctcatttatttacatttccttaattgtacctagtgtctttttctgtttcagaattccatccaggataccatgttatacctagtcatgcatccttaggcttctttagctatgacagtttctcttgtctttccttgtttttgatgaccttgacaagtttgaggagtactagttattttgtagaatgactctcttttagaatttgatgtttttcatgattagactggggttatggatttttagaggaagatgacaaagtgtcattttcatcatattaagagtatatatgtcagcatgatttatcatccttgatgttgaccttcatactttgctaggtttgtccactgtgaagttagttattccccctggtgcccttgaggaactgattttttttttttctctttttttttttttgagacggagtctcgctctgtcacccaggctggagtgtagtggtgcgatctcggctcactgcaagctacgcttcccgggttcatgccattctcctgcctcagcctccagagtagctgggactacaggcacccaccaccatgcatggctaatttttttgtattttttagtagagacagggtttcaccatgttagccaggatggtttcgatctcctgacctcgtgatccgcccgtctcggcctcccaaagtgctgggattacaggcgtgagccaccatgccggaccgaggaactgattttaaaattttggttaatcttaatttaactttacatagccacatgtatgtggctaatgggtgctgtgtcaacagtacatttgtagataatgttcttcagttttaagttttagctaaaactttaacatctgttttaatacctttaaagaaggtaatttaacataaaaaatattaaagcttagtcttggaatacattgcttttttggggggtgcagtctatttacttttagtaagtttagtctttttaaaaaagaacttttctgaggtaaaatttacatacaataaaatacctttattttaagtatactcattaagtgtacattttgatgagttttcagaaatgcacacactgatgtaactgttactgtaatcaagatatgtaacattttcattatccccagaagtttcccccagctgttttgtagtcatttttcctcctccaccactgttctgttttctgtgacttattgattaatatttgcgtcttctagaaattcatgtaaatggaaatcatatttaggtctggcatctttttttttttcctattttaatacttttatgttcaggggtacatgtgcagatttgttacataggtaaatgtgtgtcatgggggtttgtggtatagattagtacccattagttatttttcccgatcctctcccttctcccactctccaccctccaccctctgagaggcctcagtgtgtgtggtttccctgtgtgtccatgtgttcttattatttagctgccacttttaagtgagaacatgcggtatttggttttctgttcctgcattggtttgctaaggataatggtcttcagttccatccatgttcctgcaaaggacatgatctttttcttttttatggctgcagggtctggtatcttttgcttaacataattatctgtgattcatccgtattgctgcatgcaaatagtttgttttttaatgccaagaattttccaaggtatgactttacagtatttgttcataacattatttatgaacatttggattgtcctcagttttgggctattagacgtaaagctgaccttaatttcatggcataggtaatgattcagaattgtattgggttgcagtgtttatcacaatactgtaaattagaaatttaaattcctgttaggaaggagaaaagccagcagtaattgtaattacagataagcagtatctgtaatttttttgaagacatgccatagaaagaataattcacatagaaataatgttttgcaaggtttcatgtatagtgtacgggccaggtagatgtagacaattccttggacttttgttggctttctgggaaaaaaaaaaaaaagttctttgttaattccttaggtaaaatgtttagtaataaagtgaatattgaagcctaagtttgcttcatgaagttttgtcatcagtaaatgtgttaacagatcatattttaaaagttactcaaaaatgttggtgtatttattagtgaagagatttagtattgccagatgaggtggatgccgaaggaaaaggtgttttctgttataatagatgggagaagaatttcctttttttttttttttaaccttaaaattcgtcttaaaccaagttaaagttgaaatgagtgataacttttatgacatttatgttgggactgtaaaagtatttcaacaggccaggcctatgctttttgtgataattaaaatacattttgttataaagtaattaaagaatattgcaagttatgagagtagaggacaaatcattaatttcacctcactaatattcctttgtcttgtgttctttttgcctttttttggacatatgtataactatactgtgtgcagatgttactatagctgtcttttgttgagtgaatgtgccacttttacaagattgcttccagtcttttactattataagtaatgtgggtccccctcatgtttggacttttccttttcatcttacttagctgttttctgacatttgaaaaaaagcatttgaagatctacattcttttagcctagtaaatgagtcttgcttcatttgaatgtaggcctctttatggtcttaggagctgacagatttgaagattattttatcaagataatggtgttatttgttttttttttttttttttttttgagacagagtctcactctgtcactctggctggagtgtagtggcacgatctcggctcactgcaacttccacctcccgcgttcaagcaatcctcatgcctcagtcatccctactagctgggattgcaggcatgtgccaccacacctggctaatttctttttgcatttttagtagtaatggggtttcaccatgttggctcagctggtcttgaactcctggcctcatgtgatctgccgccttggcctcccaaagtgctgggattacaggcatgagccactgcgcctggccagtgttttttttgttttgttttgttttttcttttctaatcgcaaaaatttaagcagggaatgaatttaatatgttatcggaagacattcatttaaaatagtttaaatagctttgtttcatgctcactgaagttttttttttgatacagggtctcactttgtagcccaggctggagtgcagtgtcatgatcacagctcactgctgcctcaacctcctgggctcaggtgatcctccaacttcagcctccccagtagctgggaccacaggctagcaccaccacacctagctaatttttgttgtttttttttttttgtagtgatggggttttgccatgttgcccaggctggtctcaaactcctgggctcaagcaatccagctgcctcggcttcccaaagtcctgggattacaggcgtgagccaccatacttggccttgaagtatttgtaattgctaaagcatttatgatttatttaacacaactggagctgggcatagtagctcatacctgtaatcccagtgctttgggaggctgaggcaagaggatcatttgaacccaggagtttgaggttacagtgggctatgggcacagccctgcactctagcctgggcaacagtgttgagacactgtctctaagaaacaataataataattgataggtaaaatatggtaaatacatgcacaaatgtgaagtttatagttcaatacatttttacatgtacatatacatgtatatgtacttttgtagtcaccacttagatcatgatagtgaacttttccagcactccaattccctctccttcctgtttagtagtctcctcttcccatgatgagtactttcctgacatctatcaccatttattatctatttgtcttagtctgtttgtgttgctataaaggaatacctgagactgggtgatttataaagaaaagaggtttatttggctcatggttctgtaggcggtacaagaaacatctgcttctggtgagggcttcaggctgcttacactcatagtggaaagcaaaggggagccagtgtgtgtagatctcatggtgaggggagcaagagagagagagaggagggaggtgtcaggctgtttttaacaactagctctcttgggaacaaatcaagtaaggactcactcattactgtgagagtggcaccaaggcattcatgagggatctgcccataatccagacacctcccattagacctcacctccagcatctgtgatcagatttcaacatgagatttgcaggggtcatatacccaaaccatagtactcttcttgaacatcacataaaaggaatcatacagtatatatttttttctagccagcttgtttttctaaacatgatatctgggtgatttcgcagtatcattgtgaatatcagtaattttttttgttgttgttgtttgttttttgagacgaattctcactctgttgccaagctgcagtgcagtggcaagatcttggctcactgcagcctcactgcaacctccacctcccaggttcaagctgttctcctgtctcagcctcccaagtagctaggattacaggcgcccaccaccatgcccagctaatttttgtaatttaagtagagacagggtttcaccgttgttggtcaggctggtctcgaactcctgacctcacgcgatccactcaccttagcctcccacagtgctgggattataggcatgagccaccgcacctgactagttcctttttttaaactgctgagtaatatttcattatatgagtatactgcagattggtttgcctgttgatgtacatttacattgatggacataatacccaaatgtcagtttttgacaattataaataaagctactatgaatctcttgtcttttggtagaaatataacttcagtttccttggatgtatgtgtagcagtttgttatgggatcacagggtaggcatacagtttagatttaatggatattgccaattctttttgaagtagttgaactaatttgcactaataaagttattaatcttgtgttatcttaatccagatctggctaaactaaaaattgctggctgctgtggtggggacagaactactgattcgtttagtatatgtggagagtgctagaggagttggtcttttttctgcttttggaaaaacgtaggtaggcagtgggaatgggggcagattcaggttccttggtattcattctgtgttagttttgtggcagactatacatagtactggctggactccatcccaaattttgccatattttttctgggtaagttttgcatagctaggaaatagagatttgtagtagcacttttttttttttttgagacggagtctcgctttgttgcccaggctggagcacagtggcgtgatctcggctcactgcaaactctgccttcgagcaattcttctgcctcagcctcccgagtagatgggattacaggtgagagccaccgtgccggccacataatttttataacaaagatccagggggttttcaaagatgtgtatgttttgagttcttagtggaatagtggtggtagctaatctgtcttcaagacttctggaaagcagtattcgggaacactgtcaaagttaagtatcagacactgtgctggaatctgactcagcacctactttggcttctccttgctgattttacccacatgggacttactacgtagatttgtcaccttttttttgaaagtgatttcctgagctcagaagttgcttggttcctctaggctgttccaggctgtaagaaaatggtaggctaagagggagaggtcagagtctgtcttttctttattgtaaactcaacaataagaaggacctaggttgatttcttttctttcttctcctgtgaaaatgtactcagaggcccacaaagtgatagatgaggtcccaaagaggagatgaatagttaaaataaagaggaagtcatggaaattatagaaaaatatagggagaaaaagaaaaataattatactaataatcagataaaataacttacagtgaggtctaaatttagctcagttatttagaagttgacaaaaagtctagcttatataatattcactgtcaagtacaaggatacaatttattgaagaagacagcttattggtattattgcataaggaatatattacttgaagtcacttatgtgtaattttgagtaatggacaaagtctgaaaaagcagttatgtagaaatattctctcagctgttttttttttgttatagattaagttctagggtacatgtgcacaacgtgcagttttgttacatagttgtacatgtgcacaacctgcagttttgttacatagttgtacatgtgccatgttggttttctgcacccattaacttgtcatttacattaggtatttctcctaatgctatccctccccaagtcccccatcctatgacaggccccagtgtgtgatgttccccaccctgtgtccaagtgttctcattgttcaattcccacctgtaagtgagaatgtgtggtgtttggttttctgtccttgtgatagtttgctcagaatggtggtttccagcttcatctgtatccctgcaaaggacatgaactcatccttttttatggctgcatagtattccatggtgtatatatgccacattttcttaatccagtctatgatggacatttgagttggtttcaagtctttgctattgtgaatagtgctacaataaacatatgtgtgcatgtgtctttatagtagcatgatttataatcctttgggtatatacccagtaatgggatcgctgggtcaaatagtatttctagttctagatccttgaggaactgccacactgtcttccacaatggttaaactagtttacactcctaccaacagtgtaatatatatatatatatatatttttgtttgtttgtttgtttgtttgtttgagacggaggctcactctgttgtccaggctggagtgcaatggcgtgatctcagcttactgcaacctctgcctctcaggttcaagcagttctcctgcctcagcctcctgaatagctgggattacaggcatgaaccaccatgcctagctaatttttgtatttttagtagagacggggttttgccatgttggccaggctggtttcgaactcctggcctcaatcgatctgcccacctcagcctcccaaagtgctgggattacaggcatgagccaccgtgccctgcctctctcagctgtttttaagtcaagtctttaaaatatgtgatagacctacttgtttgaagtccttatccctagagttggaatagccaaagagagaaaaggccagaggagggagggaagaacccgatcatcttctctgtcagagttgctttcagcatgagaaagatatgctaatagggtggtctcagaactaacaatattttgcccacattccttcagaggcactgtctttttctgactccttcctcaaaggtttgagtgcccctgtctttcagagatgtgaggacaagttctctcagaattcctgagacctgccaattccactatgccatgcattcctgtcatctgtcattgtccagaatgaaagtccatctgatcttcataccactcagagtttcttcttcccttgaccaaatctcttgtttaattcctaaggctttcctcttgaattctctgaaatgttatttttgtgttaaacctctccctcgtgttcataagatgttttttggctttcttgtggtaacttaagcccatctgccctggtaatcttacctttcctttagccctctgaggttagcagtaggttttcttgcactatggtatgtcaggatgcagaatcagggtcttcatccttctccattcacaggctcattctattcctttattagggtggcccttctgcctagcttgctgttgttcctttatgcagttccttaatatcctttcacacattttctagtttaggtgatagatcatacacggtcaggttagccattttttctctatctttgtgcaaaactctctttcctctgaagttcatgctgtttgacaatgcatctctcttcccttccttattatcagaaaaggaccctgtggtcttaccctttgattcattgttttttctatttttgtctctgccattatcctgaggttactttagagtctatgtagctgatccatctggtcctcccatgttcctggtttcttgtcttttactttcatctctagttctactagtgctttcatttttatttctactatacttgctttttggcattaccaacatcttaaatttgtcaactctcttctgtttttacacccttccccatagtgtctaaatcacacttctgccagcaccctctactttgccttcttattcttccctttaccgtgctgacaaaaccctaaccctggtttcctgtgggctctctgccccatactcaggctgctaagttggagaaagaagcccacaaccaccttgcagattagcttccctcttgtattagcccattttcatattgctgtaatgaactgcctgagactgggtaatttatgaaagaaagaggtttaattgactcacaggttttcatggctggggaggccgcaggaaagttacagtcatggcagaaggagaaggggaagcaaggcaccttctacacaaggcagcaggagagagaagtgccaaccgaagcgggaagagccccttataaaaccatcagatctgatgagaacagcatgggggaaaccgcccccatgattcagttacctccccctggtctctcccttgacacgtggggtttacagggattacaattcaagatgagatttgagtggggacacaaaccctaaccatatcacttctctatctttattggtctttagagatactgtagctaagtgcaacaaggtgtcctgaattggagactggcacagaacaaggatgttgttggaaaaactgatgaaatctgaataaactctgaagtataggtaatagtgatgtatcaatgttggtttcttagttttgacaaagtattgtgtaatgtaagttgttaacattaggggaaactgacggtactttctgtattatctttgtagctttttaaactataatttctcaagtttatttaaaaaaaacaaacaaactctagcatagaacacagcagctatcaatttctttagtttcctcaaaccctaccttatcatcttctctgtcatttgcctacttttctgagaagattgaagccatcagtttgatgaattcccctcagtttcctttatttttgtttttttgttggtttgtttattttaaaattattttttatgtaagttttgtagagacaggatcttgctgtgtttcccagcctggtctcaaactcctgggctcaagcaatctgcctacctcagcgtcagtgctgggattcctggcatggacattagcttggcctcagtttccttttaaattcccctacccccttcaataaaactctacataaccttggaagcattctaagtcatttggatctactttcctctggttacaagtagataggagcagtttttgtttctgtttgttctgtgaaaccctaatacttcctgccttctcagagatttcatttacataatatttttattgaattattaaaattcaccttttgactctgctagtaactttccattgggaatatatctaaaataaaaaaatggaaattttctttccattctttctcttctctcttccacagctaagattcttttcttttcttttttttttttttttgagacagagtctcgctctgtcacccaggctggagtgcagtggcacgatctcagctcactgcaaccccgccccctgggttcaagcgattcttctgcctcagcctcccgagtagctgggagtacaggtgcacgccaccatgcccagctaatttttgtgtttttagtagagacgggggtttcaacatattggccaggctggtcttgaacgcctgacctcgtgatccacctgctttggcctccaaagtgctgggattacaggtgtgagccactgtgcccggccttttttttttttttttttttttgagatggagtttcgctcttgttgcccaggctggagtgcagtagcacgatctcggctcaccgcaacctccgcctcccgggttcaagtgattctcctgcctcagcctcctgagtagctggaggcttttgcaggcttttgccaccacgcctggctaattttttgtattttcagtagagacggggtttctccatgttaggctggtctcgaattcccgacctcaggtgatacgcctgcctcggcctccgaaagtgctgggattacgggtatgagccactgcgcccagccttccacagctaagattcttatttttgagatggagtcttgctctgtcacccaggctggagtgcagtggtgtgatctcagctcacagcaacctctgccttccgggttcaagtgattctcctgcctcagccttctgagtagctgagattaacaggcgcccgctgccacacctggctattttttttttttttttttttttgtatttttagtagagacggggtttcaccatgttggccaggctggtcttgaacacctgacctcaagtgatccacccatcttggcctcctaacgtgctgggattgcaggtgtgagcaactgtgctggcctcacatgtaagattcctgaaagagttgactgcatttgtggtcttcccttctcacctcccagtcatgcctcactccattgaaatctggctttgtccccacggcactcctaactgcattcttcagatcatcaataagttagttttcgaagccaatgaagaattttcagtctttctcttttttggcttaaatatctgaaacattttttttttccttttagagactgtctcgctctgtcacccaggctagagtgcagtggtgctatcgtaactcactggagccctgatctaggctcaaaccatcctcccacctcagcctcccaagtagctgggactaaggcaagtaccaccatacctggctaattaaaattttatttttttgtagagatgagctctcactatgttgcgtaggctgatctcaaacttctgacctcgagtaatcctcctgcctcagtctcctaaagctttgggattacaggcgtgagccacggcacctggcctaatatttgaaactttcaaatacttcccttaaaaaaaatgtaccactaccatctttgttgtatgcacaaattagaaacttaataggaaaagagaattatccataatcctaccacttagaagtattaacattttggggcatatctatatatatccagtgtattttaaaatattttaaatataatcatattctctgtattctgtaacttgtcttgaacacttaatatgttgttggtaacctttcatgtcggtgaagtttagttactcatcatcttactcttccctactagattgaattcattctcctccaggtaactatcctcagtcatctttctaaagtacaaattttgtcctggaaactttcctgcccaagtcttttcataacctttcatttcccttggaatatgaaatgcaaagacttttgtgatgta

SEQ ID NO: 9 - DNA, 15178 bp, Homo sapiens
tgcaaataatattttggtttttgcaatagaagattctcaaactagcaaatgagatcacaatagtattttataatagtattattaaaaaaacacatcatggatgccctgaaagagtttggaggtccatagattgtactttgtaaactgctgctttgaggagtggaacacgtttcaatgttacatttatgtatgttacattgattttttaaaaaacgatttaaaaacataagtgtttgaaattggaataaacatatcactgaaggtttttagatattactgagtttttagtgctaagtagataagagtttgtttataagttaggatgagttataattttctgctatgaagaaaatgttctatgaacctccaccatccagtactataactactagccagttgtgtctgttgagcgcttgagatgctactagctggtgtgactgaggaactgcatttttaaaaagtgtagaaaaaacttctttttttttttttgaagtggagtcttgttctgtttcacaggctggagtgcagtggcatgatctctgctcactgtaaccaccgcctcttgggttcaagctattctccagcctcagcctcccgaatagctgggattacaagcacccgccatcatgtgcaactgattttttgtattttttggcagagacagggtttcaccatgttggccaagctggtcttgaactcctgacctcaagtgatcggctgactttggcctcccaaagtgctgggattacaggcatgagccactgggcccagccttaacttctaaattttaactttttttctttaataataggctttagtttttacaacaattgtagatttacagaaaattgagaagatagtgcggaattccagttattaacatcttacattactatggtacattgttataattaataaaccaatgttgatacattgtcattaattaaagtccctcatttatttacatttccttaattgtacctagtgtctttttctgtttcagaattccatccaggataccatgttatacctagtcatgcatccttaggcttctttagctatgacagtttctcttgtctttccttgtttttgatgaccttgacaagtttgaggagtactagttattttgtagaatgactctcttttagaatttgatgtttttcatgattagactggggttatggatttttagaggaagatgacaaagtgtcattttcatcatattaagagtatatatgtcagcatgatttatcatccttgatgttgaccttcatactttgctaggtttgtccactgtgaagttagttattccccctggtgcccttgaggaactgattttttttttttctctttttttttttttgagacggagtctcgctctgtcacccaggctggagtgtagtggtgcgatctcggctcactgcaagctacgcttcccgggttcatgccattctcctgcctcagcctccagagtagctgggactacaggcacccaccaccatgcatggctaatttttttgtattttttagtagagacagggtttcaccatgttagccaggatggtttcgatctcctgacctcgtgatccgcccgtctcggcctcccaaagtgctgggattacaggcgtgagccaccatgccggaccgaggaactgattttaaaattttggttaatcttaatttaactttacatagccacatgtatgtggctaatgggtgctgtgtcaacagtacatttgtagataatgttcttcagttttaagttttagctaaaactttaacatctgttttaatacctttaaagaaggtaatttaacataaaaaatattaaagcttagtcttggaatacattgcttttttggggggtgcagtctatttacttttagtaagtttagtctttttaaaaaagaacttttctgaggtaaaatttacatacaataaaatacctttattttaagtatactcattaagtgtacattttgatgagttttcagaaatgcacacactgatgtaactgttactgtaatcaagatatgtaacattttcattatccccagaagtttcccccagctgttttgtagtcatttttcctcctccaccactgttctgttttctgtgacttattgattaatatttgcgtcttctagaaattcatgtaaatggaaatcatatttaggtctggcatctttttttttttcctattttaatacttttatgttcaggggtacatgtgcagatttgttacataggtaaatgtgtgtcatgggggtttgtggtatagattagtacccattagttatttttcccgatcctctcccttctcccactctccaccctccaccctctgagaggcctcagtgtgtgtggtttccctgtgtgtccatgtgttcttattatttagctgccacttttaagtgagaacatgcggtatttggttttctgttcctgcattggtttgctaaggataatggtcttcagttccatccatgttcctgcaaaggacatgatctttttcttttttatggctgcagggtctggtatcttttgcttaacataattatctgtgattcatccgtattgctgcatgcaaatagtttgttttttaatgccaagaattttccaaggtatgactttacagtatttgttcataacattatttatgaacatttggattgtcctcagttttgggctattagacgtaaagctgaccttaatttcatggcataggtaatgattcagaattgtattgggttgcagtgtttatcacaatactgtaaattagaaatttaaattcctgttaggaaggagaaaagccagcagtaattgtaattacagataagcagtatctgtaatttttttgaagacatgccatagaaagaataattcacatagaaataatgttttgcaaggtttcatgtatagtgtacgggccaggtagatgtagacaattccttggacttttgttggctttctgggaaaaaaaaaaaaaagttctttgttaattccttaggtaaaatgtttagtaataaagtgaatattgaagcctaagtttgcttcatgaagttttgtcatcagtaaatgtgttaacagatcatattttaaaagttactcaaaaatgttggtgtatttattagtgaagagatttagtattgccagatgaggtggatgccgaaggaaaaggtgttttctgttataatagatgggagaagaatttcctttttttttttttttaaccttaaaattcgtcttaaaccaagttaaagttgaaatgagtgataacttttatgacatttatgttgggactgtaaaagtatttcaacaggccaggcctatgctttttgtgataattaaaatacattttgttataaagtaattaaagaatattgcaagttatgagagtagaggacaaatcattaatttcacctcactaatattcctttgtcttgtgttctttttgcctttttttggacatatgtataactatactgtgtgcagatgttactatagctgtcttttgttgagtgaatgtgccacttttacaagattgcttccagtcttttactattataagtaatgtgggtccccctcatgtttggacttttccttttcatcttacttagctgttttctgacatttgaaaaaaagcatttgaagatctacattcttttagcctagtaaatgagtcttgcttcatttgaatgtaggcctctttatggtcttaggagctgacagatttgaagattattttatcaagataatggtgttatttgttttttttttttttttttttttgagacagagtctcactctgtcactctggctggagtgtagtggcacgatctcggctcactgcaacttccacctcccgcgttcaagcaatcctcatgcctcagtcatccctactagctgggattgcaggcatgtgccaccacacctggctaatttctttttgcatttttagtagtaatggggtttcaccatgttggctcagctggtcttgaactcctggcctcatgtgatctgccgccttggcctcccaaagtgctgggattacaggcatgagccactgcgcctggccagtgttttttttgttttgttttgttttttcttttctaatcgcaaaaatttaagcagggaatgaatttaatatgttatcggaagacattcatttaaaatagtttaaatagctttgtttcatgctcactgaagttttttttttgatacagggtctcactttgtagcccaggctggagtgcagtgtcatgatcacagctcactgctgcctcaacctcctgggctcaggtgatcctccaacttcagcctccccagtagctgggaccacaggctagcaccaccacacctagctaatttttgttgtttttttttttttgtagtgatggggttttgccatgttgcccaggctggtctcaaactcctgggctcaagcaatccagctgcctcggcttcccaaagtcctgggattacaggcgtgagccaccatacttggccttgaagtatttgtaattgctaaagcatttatgatttatttaacacaactggagctgggcatagtagctcatacctgtaatcccagtgctttgggaggctgaggcaagaggatcatttgaacccaggagtttgaggttacagtgggctatgggcacagccctgcactctagcctgggcaacagtgttgagacactgtctctaagaaacaataataataattgataggtaaaatatggtaaatacatgcacaaatgtgaagtttatagttcaatacatttttacatgtacatatacatgtatatgtacttttgtagtcaccacttagatcatgatagtgaacttttccagcactccaattccctctccttcctgtttagtagtctcctcttcccatgatgagtactttcctgacatctatcaccatttattatctatttgtcttagtctgtttgtgttgctataaaggaatacctgagactgggtgatttataaagaaaagaggtttatttggctcatggttctgtaggcggtacaagaaacatctgcttctggtgagggcttcaggctgcttacactcatagtggaaagcaaaggggagccagtgtgtgtagatctcatggtgaggggagcaagagagagagagaggagggaggtgtcaggctgtttttaacaactagctctcttgggaacaaatcaagtaaggactcactcattactgtgagagtggcaccaaggcattcatgagggatctgcccataatccagacacctcccattagacctcacctccagcatctgtgatcagatttcaacatgagatttgcaggggtcatatacccaaaccatagtactcttcttgaacatcacataaaaggaatcatacagtatatatttttttctagccagcttgtttttctaaacatgatatctgggtgatttcgcagtatcattgtgaatatcagtaattttttttgttgttgttgtttgttttttgagacgaattctcactctgttgccaagctgcagtgcagtggcaagatcttggctcactgcagcctcactgcaacctccacctcccaggttcaagctgttctcctgtctcagcctcccaagtagctaggattacaggcgcccaccaccatgcccagctaatttttgtaatttaagtagagacagggtttcaccgttgttggtcaggctggtctcgaactcctgacctcacgcgatccactcaccttagcctcccacagtgctgggattataggcatgagccaccgcacctgactagttcctttttttaaactgctgagtaatatttcattatatgagtatactgcagattggtttgcctgttgatgtacatttacattgatggacataatacccaaatgtcagtttttgacaattataaataaagctactatgaatctcttgtcttttggtagaaatataacttcagtttccttggatgtatgtgtagcagtttgttatgggatcacagggtaggcatacagtttagatttaatggatattgccaattctttttgaagtagttgaactaatttgcactaataaagttattaatcttgtgttatcttaatccagatctggctaaactaaaaattgctggctgctgtggtggggacagaactactgattcgtttagtatatgtggagagtgctagaggagttggtcttttttctgcttttggaaaaacgtaggtaggcagtgggaatgggggcagattcaggttccttggtattcattctgtgttagttttgtggcagactatacatagtactggctggactccatcccaaattttgccatattttttctgggtaagttttgcatagctaggaaatagagatttgtagtagcacttttttttttttttgagacggagtctcgctttgttgcccaggctggagcacagtggcgtgatctcggctcactgcaaactctgccttcgagcaattcttctgcctcagcctcccgagtagatgggattacaggtgagagccaccgtgccggccacataatttttataacaaagatccagggggttttcaaagatgtgtatgttttgagttcttagtggaatagtggtggtagctaatctgtcttcaagacttctggaaagcagtattcgggaacactgtcaaagttaagtatcagacactgtgctggaatctgactcagcacctactttggcttctccttgctgattttacccacatgggacttactacgtagatttgtcaccttttttttgaaagtgatttcctgagctcagaagttgcttggttcctctaggctgttccaggctgtaagaaaatggtaggctaagagggagaggtcagagtctgtcttttctttattgtaaactcaacaataagaaggacctaggttgatttcttttctttcttctcctgtgaaaatgtactcagaggcccacaaagtgatagatgaggtcccaaagaggagatgaatagttaaaataaagaggaagtcatggaaattatagaaaaatatagggagaaaaagaaaaataattatactaataatcagataaaataacttacagtgaggtctaaatttagctcagttatttagaagttgacaaaaagtctagcttatataatattcactgtcaagtacaaggatacaatttattgaagaagacagcttattggtattattgcataaggaatatattacttgaagtcacttatgtgtaattttgagtaatggacaaagtctgaaaaagcagttatgtagaaatattctctcagctgttttttttttgttatagattaagttctagggtacatgtgcacaacgtgcagttttgttacatagttgtacatgtgcacaacctgcagttttgttacatagttgtacatgtgccatgttggttttctgcacccattaacttgtcatttacattaggtatttctcctaatgctatccctccccaagtcccccatcctatgacaggccccagtgtgtgatgttccccaccctgtgtccaagtgttctcattgttcaattcccacctgtaagtgagaatgtgtggtgtttggttttctgtccttgtgatagtttgctcagaatggtggtttccagcttcatctgtatccctgcaaaggacatgaactcatccttttttatggctgcatagtattccatggtgtatatatgccacattttcttaatccagtctatgatggacatttgagttggtttcaagtctttgctattgtgaatagtgctacaataaacatatgtgtgcatgtgtctttatagtagcatgatttataatcctttgggtatatacccagtaatgggatcgctgggtcaaatagtatttctagttctagatccttgaggaactgccacactgtcttccacaatggttaaactagtttacactcctaccaacagtgtaatatatatatatatatatatttttgtttgtttgtttgtttgtttgtttgagacggaggctcactctgttgtccaggctggagtgcaatggcgtgatctcagcttactgcaacctctgcctctcaggttcaagcagttctcctgcctcagcctcctgaatagctgggattacaggcatgaaccaccatgcctagctaatttttgtatttttagtagagacggggttttgccatgttggccaggctggtttcgaactcctggcctcaatcgatctgcccacctcagcctcccaaagtgctgggattacaggcatgagccaccgtgccctgcctctctcagctgtttttaagtcaagtctttaaaatatgtgatagacctacttgtttgaagtccttatccctagagttggaatagccaaagagagaaaaggccagaggagggagggaagaacccgatcatcttctctgtcagagttgctttcagcatgagaaagatatgctaatagggtggtctcagaactaacaatattttgcccacattccttcagaggcactgtctttttctgactccttcctcaaaggtttgagtgcccctgtctttcagagatgtgaggacaagttctctcagaattcctgagacctgccaattccactatgccatgcattcctgtcatctgtcattgtccagaatgaaagtccatctgatcttcataccactcagagtttcttcttcccttgaccaaatctcttgtttaattcctaaggctttcctcttgaattctctgaaatgttatttttgtgttaaacctctccctcgtgttcataagatgttttttggctttcttgtggtaacttaagcccatctgccctggtaatcttacctttcctttagccctctgaggttagcagtaggttttcttgcactatggtatgtcaggatgcagaatcagggtcttcatccttctccattcacaggctcattctattcctttattagggtggcccttctgcctagcttgctgttgttcctttatgcagttccttaatatcctttcacacattttctagtttaggtgatagatcatacacggtcaggttagccattttttctctatctttgtgcaaaactctctttcctctgaagttcatgctgtttgacaatgcatctctcttcccttccttattatcagaaaaggaccctgtggtcttaccctttgattcattgttttttctatttttgtctctgccattatcctgaggttactttagagtctatgtagctgatccatctggtcctcccatgttcctggtttcttgtcttttactttcatctctagttctactagtgctttcatttttatttctactatacttgctttttggcattaccaacatcttaaatttgtcaactctcttctgtttttacacccttccccatagtgtctaaatcacacttctgccagcaccctctactttgccttcttattcttccctttaccgtgctgacaaaaccctaaccctggtttcctgtgggctctctgccccatactcaggctgctaagttggagaaagaagcccacaaccaccttgcagattagcttccctcttgtattagcccattttcatattgctgtaatgaactgcctgagactgggtaatttatgaaagaaagaggtttaattgactcacaggttttcatggctggggaggccgcaggaaagttacagtcatggcagaaggagaaggggaagcaaggcaccttctacacaaggcagcaggagagagaagtgccaaccgaagcgggaagagccccttataaaaccatcagatctgatgagaacagcatgggggaaaccgcccccatgattcagttacctccccctggtctctcccttgacacgtggggtttacagggattacaattcaagatgagatttgagtggggacacaaaccctaaccatatcacttctctatctttattggtctttagagatactgtagctaagtgcaacaaggtgtcctgaattggagactggcacagaacaaggatgttgttggaaaaactgatgaaatctgaataaactctgaagtataggtaatagtgatgtatcaatgttggtttcttagttttgacaaagtattgtgtaatgtaagttgttaacattaggggaaactgacggtactttctgtattatctttgtagctttttaaactataatttctcaagtttatttaaaaaaaacaaacaaactctagcatagaacacagcagctatcaatttctttagtttcctcaaaccctaccttatcatcttctctgtcatttgcctacttttctgagaagattgaagccatcagtttgatgaattcccctcagtttcctttatttttgtttttttgttggtttgtttattttaaaattattttttatgtaagttttgtagagacaggatcttgctgtgtttcccagcctggtctcaaactcctgggctcaagcaatctgcctacctcagcgtcagtgctgggattcctggcatggacattagcttggcctcagtttccttttaaattcccctacccccttcaataaaactctacataaccttggaagcattctaagtcatttggatctactttcctctggttacaagtagataggagcagtttttgtttctgtttgttctgtgaaaccctaatacttcctgccttctcagagatttcatttacataatatttttattgaattattaaaattcaccttttgactctgctagtaactttccattgggaatatatctaaaataaaaaaatggaaattttctttccattctttctcttctctcttccacagctaagattcttttcttttcttttttttttttttttgagacagagtctcgctctgtcacccaggctggagtgcagtggcacgatctcagctcactgcaaccccgccccctgggttcaagcgattcttctgcctcagcctcccgagtagctgggagtacaggtgcacgccaccatgcccagctaatttttgtgtttttagtagagacgggggtttcaacatattggccaggctggtcttgaacgcctgacctcgtgatccacctgctttggcctccaaagtgctgggattacaggtgtgagccactgtgcccggccttttttttttttttttttttttgagatggagtttcgctcttgttgcccaggctggagtgcagtagcacgatctcggctcaccgcaacctccgcctcccgggttcaagtgattctcctgcctcagcctcctgagtagctggaggcttttgcaggcttttgccaccacgcctggctaattttttgtattttcagtagagacggggtttctccatgttaggctggtctcgaattcccgacctcaggtgatacgcctgcctcggcctccgaaagtgctgggattacgggtatgagccactgcgcccagccttccacagctaagattcttatttttgagatggagtcttgctctgtcacccaggctggagtgcagtggtgtgatctcagctcacagcaacctctgccttccgggttcaagtgattctcctgcctcagccttctgagtagctgagattaacaggcgcccgctgccacacctggctattttttttttttttttttttttgtatttttagtagagacggggtttcaccatgttggccaggctggtcttgaacacctgacctcaagtgatccacccatcttggcctcctaacgtgctgggattgcaggtgtgagcaactgtgctggcctcacatgtaagattcctgaaagagttgactgcatttgtggtcttcccttctcacctcccagtcatgcctcactccattgaaatctggctttgtccccacggcactcctaactgcattcttcagatcatcaataagttagttttcgaagccaatgaagaattttcagtctttctcttttttggcttaaatatctgaaacattttttttttccttttagagactgtctcgctctgtcacccaggctagagtgcagtggtgctatcgtaactcactggagccctgatctaggctcaaaccatcctcccacctcagcctcccaagtagctgggactaaggcaagtaccaccatacctggctaattaaaattttatttttttgtagagatgagctctcactatgttgcgtaggctgatctcaaacttctgacctcgagtaatcctcctgcctcagtctcctaaagctttgggattacaggcgtgagccacggcacctggcctaatatttgaaactttcaaatacttcccttaaaaaaaatgtaccactaccatctttgttgtatgcacaaattagaaacttaataggaaaagagaattatccataatcctaccacttagaagtattaacattttggggcatatctatatatatccagtgtattttaaaatattttaaatataatcatattctctgtattctgtaacttgtcttgaacacttaatatgttgttggtaacctttcatgtcggtgaagtttagttactcatcatcttactcttccctactagattgaattcattctcctccaggtaactatcctcagtcatctttctaaagtacaaattttgtcctggaaactttcctgcccaagtcttttcataacctttcatttcccttggaatatgaaatgcaaagacttttgtgatgtagccactgctttaccaatcttcacattagttttttagcctgttgaacaaattgattatcttccaaaagatcctaggtctttcttctttaccctttcctgcacctccccctgtccccctttatccttaaagactgcctcattcttagtatatggtttttggagtccttataatacaggtttgaccttgtgtgagctgcttaacttttctctgtgcctcatttcctcatctacaaaattgggccaaagaatctatgtcaaattaagcgaatacatatgaagcactttgaactcttagtaagcacatagttagctctcaataaatgctagcaaatattataattcaacagatcttcagtgttatgcttctcattttaggataatcttcccagtattcccagagcttacttcgcatagttcattgtagtccttatcacatggtactcattgtttttttattagactggcgccttgagggcaggagttatcgtattccttgttcataatgcatccaagtaatctggttaggggttaccagataatattagcagtatccattagattgttatgttggatcaaagaaaatatttcatgggattttgtttagaaaatctacccttatttatatatttctgtatatgaagtgtgttattctgtagaagaggttggggctacttgtaaaagtttggagaccgggagagctcaggacatggatcctttggccagcccttcaggtggccagtagtagtaatggctttttaactttttgcagtttggagtttaaaaggtaagcaagatgaggctgggcgccgtggcccacacctgtaatccacctgtaatccaccactttgggaagccaaggcgggtggatcacttgaggtcaggagtttgggactggcctggccaatatgcaaaaccctgcctctactaaaaatacaaaaattatctgggtgtggtgttcggcgcctgtaatcccagctactggggagactgaggcagaagactcgcttgaacctgggaggcggaggttgcagtgagccgctgtcgcaccactgcactccagccccagtgacagagcaaggctctgtctcaaaaaaaaaaaaaaaaaaaatcatatgggagcacacccttctccccaccgccaaataccctttgttaaaaattttaaaaagagcaaagtaaataagccacagtggtgcatgcctatagtttcagccactggggaggctgaggtgggaggattgcttgagctgaggagttcaagtccagcctgggtaacagtgagaccctgtctcaaaaatataaaagttaaaaaataaataaataagagagttttttgtttttttagtttttaaataggtcctatagcttttgaggatttgagatttctactaggttaaaatttattttaaaatatacgtgacaagatttcgaaagtacaaaaagataactcagtggaagatagatcttgcccgctccatacctctagttcttctttctagaggactatcacttaggtgaacttcaattttctataaagaaatcattatgcactaagcaactgtgattttacaagtctgtctagtagagataaaagcataaatatatgaataaaaggttgtttattgcagcattgttcataaaggcaaaaaagtaaaggtcatccatttctgtggaatgttacacagcttgctttttttttgggggcgcagagtcttgctctgttgcccaggctggagtgcagtggcacgatgtcagctcactgtagcctctgcctccagggatcaaatgattctcatgcctcagcttcctgagtaactgggattataggcgtgcaccaccacacccagctaattttttgtatttttagtagagacagggtttcactatattggccaggctggtcttgaactcctggcctcaacttgattcaccttccttggcctcccaaagttctgggattacaacatgagccactgtgcccggcccatcatacagcttttaaaaactgcaacttaactctatatctgtttattagaagtttgtccatgcaaatatattgagagaattgcctgtctcagaataaggtatagtgtatgattcttgctttataatagcaaatagctaatcccctttccccaccacatatatgtgaacatgtttgtctgaatgtgaagtatggagggatacacactaggctgttaacatgtttacctcaggaaatgggaatagcggggaggcaagagtaattatgaacttggaggttaatatgggtctattttagttacagagaatgtggtgagaatagtacctcagggggagaaaactagagtcagtgaatttgagtttagtgaagggtttgggctagagatctctacctctgtggtctttctctttcttcctgtatcagcctgtacagtgattgctgaggctttgttcctgttctttcttgagatttctgctttggggtagccttattcaatttttgattgtaactctgtggat

SEQ ID NO: 10 - DNA, 25688 bp, Homo sapiens
tgcaaataatattttggtttttgcaatagaagattctcaaactagcaaatgagatcacaatagtattttataatagtattattaaaaaaacacatcatggatgccctgaaagagtttggaggtccatagattgtactttgtaaactgctgctttgaggagtggaacacgtttcaatgttacatttatgtatgttacattgattttttaaaaaacgatttaaaaacataagtgtttgaaattggaataaacatatcactgaaggtttttagatattactgagtttttagtgctaagtagataagagtttgtttataagttaggatgagttataattttctgctatgaagaaaatgttctatgaacctccaccatccagtactataactactagccagttgtgtctgttgagcgcttgagatgctactagctggtgtgactgaggaactgcatttttaaaaagtgtagaaaaaacttctttttttttttttgaagtggagtcttgttctgtttcacaggctggagtgcagtggcatgatctctgctcactgtaaccaccgcctcttgggttcaagctattctccagcctcagcctcccgaatagctgggattacaagcacccgccatcatgtgcaactgattttttgtattttttggcagagacagggtttcaccatgttggccaagctggtcttgaactcctgacctcaagtgatcggctgactttggcctcccaaagtgctgggattacaggcatgagccactgggcccagccttaacttctaaattttaactttttttctttaataataggctttagtttttacaacaattgtagatttacagaaaattgagaagatagtgcggaattccagttattaacatcttacattactatggtacattgttataattaataaaccaatgttgatacattgtcattaattaaagtccctcatttatttacatttccttaattgtacctagtgtctttttctgtttcagaattccatccaggataccatgttatacctagtcatgcatccttaggcttctttagctatgacagtttctcttgtctttccttgtttttgatgaccttgacaagtttgaggagtactagttattttgtagaatgactctcttttagaatttgatgtttttcatgattagactggggttatggatttttagaggaagatgacaaagtgtcattttcatcatattaagagtatatatgtcagcatgatttatcatccttgatgttgaccttcatactttgctaggtttgtccactgtgaagttagttattccccctggtgcccttgaggaactgattttttttttttctctttttttttttttgagacggagtctcgctctgtcacccaggctggagtgtagtggtgcgatctcggctcactgcaagctacgcttcccgggttcatgccattctcctgcctcagcctccagagtagctgggactacaggcacccaccaccatgcatggctaatttttttgtattttttagtagagacagggtttcaccatgttagccaggatggtttcgatctcctgacctcgtgatccgcccgtctcggcctcccaaagtgctgggattacaggcgtgagccaccatgccggaccgaggaactgattttaaaattttggttaatcttaatttaactttacatagccacatgtatgtggctaatgggtgctgtgtcaacagtacatttgtagataatgttcttcagttttaagttttagctaaaactttaacatctgttttaatacctttaaagaaggtaatttaacataaaaaatattaaagcttagtcttggaatacattgcttttttggggggtgcagtctatttacttttagtaagtttagtctttttaaaaaagaacttttctgaggtaaaatttacatacaataaaatacctttattttaagtatactcattaagtgtacattttgatgagttttcagaaatgcacacactgatgtaactgttactgtaatcaagatatgtaacattttcattatccccagaagtttcccccagctgttttgtagtcatttttcctcctccaccactgttctgttttctgtgacttattgattaatatttgcgtcttctagaaattcatgtaaatggaaatcatatttaggtctggcatctttttttttttcctattttaatacttttatgttcaggggtacatgtgcagatttgttacataggtaaatgtgtgtcatgggggtttgtggtatagattagtacccattagttatttttcccgatcctctcccttctcccactctccaccctccaccctctgagaggcctcagtgtgtgtggtttccctgtgtgtccatgtgttcttattatttagctgccacttttaagtgagaacatgcggtatttggttttctgttcctgcattggtttgctaaggataatggtcttcagttccatccatgttcctgcaaaggacatgatctttttcttttttatggctgcagggtctggtatcttttgcttaacataattatctgtgattcatccgtattgctgcatgcaaatagtttgttttttaatgccaagaattttccaaggtatgactttacagtatttgttcataacattatttatgaacatttggattgtcctcagttttgggctattagacgtaaagctgaccttaatttcatggcataggtaatgattcagaattgtattgggttgcagtgtttatcacaatactgtaaattagaaatttaaattcctgttaggaaggagaaaagccagcagtaattgtaattacagataagcagtatctgtaatttttttgaagacatgccatagaaagaataattcacatagaaataatgttttgcaaggtttcatgtatagtgtacgggccaggtagatgtagacaattccttggacttttgttggctttctgggaaaaaaaaaaaaaagttctttgttaattccttaggtaaaatgtttagtaataaagtgaatattgaagcctaagtttgcttcatgaagttttgtcatcagtaaatgtgttaacagatcatattttaaaagttactcaaaaatgttggtgtatttattagtgaagagatttagtattgccagatgaggtggatgccgaaggaaaaggtgttttctgttataatagatgggagaagaatttcctttttttttttttttaaccttaaaattcgtcttaaaccaagttaaagttgaaatgagtgataacttttatgacatttatgttgggactgtaaaagtatttcaacaggccaggcctatgctttttgtgataattaaaatacattttgttataaagtaattaaagaatattgcaagttatgagagtagaggacaaatcattaatttcacctcactaatattcctttgtcttgtgttctttttgcctttttttggacatatgtataactatactgtgtgcagatgttactatagctgtcttttgttgagtgaatgtgccacttttacaagattgcttccagtcttttactattataagtaatgtgggtccccctcatgtttggacttttccttttcatcttacttagctgttttctgacatttgaaaaaaagcatttgaagatctacattcttttagcctagtaaatgagtcttgcttcatttgaatgtaggcctctttatggtcttaggagctgacagatttgaagattattttatcaagataatggtgttatttgttttttttttttttttttttttgagacagagtctcactctgtcactctggctggagtgtagtggcacgatctcggctcactgcaacttccacctcccgcgttcaagcaatcctcatgcctcagtcatccctactagctgggattgcaggcatgtgccaccacacctggctaatttctttttgcatttttagtagtaatggggtttcaccatgttggctcagctggtcttgaactcctggcctcatgtgatctgccgccttggcctcccaaagtgctgggattacaggcatgagccactgcgcctggccagtgttttttttgttttgttttgttttttcttttctaatcgcaaaaatttaagcagggaatgaatttaatatgttatcggaagacattcatttaaaatagtttaaatagctttgtttcatgctcactgaagttttttttttgatacagggtctcactttgtagcccaggctggagtgcagtgtcatgatcacagctcactgctgcctcaacctcctgggctcaggtgatcctccaacttcagcctccccagtagctgggaccacaggctagcaccaccacacctagctaatttttgttgtttttttttttttgtagtgatggggttttgccatgttgcccaggctggtctcaaactcctgggctcaagcaatccagctgcctcggcttcccaaagtcctgggattacaggcgtgagccaccatacttggccttgaagtatttgtaattgctaaagcatttatgatttatttaacacaactggagctgggcatagtagctcatacctgtaatcccagtgctttgggaggctgaggcaagaggatcatttgaacccaggagtttgaggttacagtgggctatgggcacagccctgcactctagcctgggcaacagtgttgagacactgtctctaagaaacaataataataattgataggtaaaatatggtaaatacatgcacaaatgtgaagtttatagttcaatacatttttacatgtacatatacatgtatatgtacttttgtagtcaccacttagatcatgatagtgaacttttccagcactccaattccctctccttcctgtttagtagtctcctcttcccatgatgagtactttcctgacatctatcaccatttattatctatttgtcttagtctgtttgtgttgctataaaggaatacctgagactgggtgatttataaagaaaagaggtttatttggctcatggttctgtaggcggtacaagaaacatctgcttctggtgagggcttcaggctgcttacactcatagtggaaagcaaaggggagccagtgtgtgtagatctcatggtgaggggagcaagagagagagagaggagggaggtgtcaggctgtttttaacaactagctctcttgggaacaaatcaagtaaggactcactcattactgtgagagtggcaccaaggcattcatgagggatctgcccataatccagacacctcccattagacctcacctccagcatctgtgatcagatttcaacatgagatttgcaggggtcatatacccaaaccatagtactcttcttgaacatcacataaaaggaatcatacagtatatatttttttctagccagcttgtttttctaaacatgatatctgggtgatttcgcagtatcattgtgaatatcagtaattttttttgttgttgttgtttgttttttgagacgaattctcactctgttgccaagctgcagtgcagtggcaagatcttggctcactgcagcctcactgcaacctccacctcccaggttcaagctgttctcctgtctcagcctcccaagtagctaggattacaggcgcccaccaccatgcccagctaatttttgtaatttaagtagagacagggtttcaccgttgttggtcaggctggtctcgaactcctgacctcacgcgatccactcaccttagcctcccacagtgctgggattataggcatgagccaccgcacctgactagttcctttttttaaactgctgagtaatatttcattatatgagtatactgcagattggtttgcctgttgatgtacatttacattgatggacataatacccaaatgtcagtttttgacaattataaataaagctactatgaatctcttgtcttttggtagaaatataacttcagtttccttggatgtatgtgtagcagtttgttatgggatcacagggtaggcatacagtttagatttaatggatattgccaattctttttgaagtagttgaactaatttgcactaataaagttattaatcttgtgttatcttaatccagatctggctaaactaaaaattgctggctgctgtggtggggacagaactactgattcgtttagtatatgtggagagtgctagaggagttggtcttttttctgcttttggaaaaacgtaggtaggcagtgggaatgggggcagattcaggttccttggtattcattctgtgttagttttgtggcagactatacatagtactggctggactccatcccaaattttgccatattttttctgggtaagttttgcatagctaggaaatagagatttgtagtagcacttttttttttttttgagacggagtctcgctttgttgcccaggctggagcacagtggcgtgatctcggctcactgcaaactctgccttcgagcaattcttctgcctcagcctcccgagtagatgggattacaggtgagagccaccgtgccggccacataatttttataacaaagatccagggggttttcaaagatgtgtatgttttgagttcttagtggaatagtggtggtagctaatctgtcttcaagacttctggaaagcagtattcgggaacactgtcaaagttaagtatcagacactgtgctggaatctgactcagcacctactttggcttctccttgctgattttacccacatgggacttactacgtagatttgtcaccttttttttgaaagtgatttcctgagctcagaagttgcttggttcctctaggctgttccaggctgtaagaaaatggtaggctaagagggagaggtcagagtctgtcttttctttattgtaaactcaacaataagaaggacctaggttgatttcttttctttcttctcctgtgaaaatgtactcagaggcccacaaagtgatagatgaggtcccaaagaggagatgaatagttaaaataaagaggaagtcatggaaattatagaaaaatatagggagaaaaagaaaaataattatactaataatcagataaaataacttacagtgaggtctaaatttagctcagttatttagaagttgacaaaaagtctagcttatataatattcactgtcaagtacaaggatacaatttattgaagaagacagcttattggtattattgcataaggaatatattacttgaagtcacttatgtgtaattttgagtaatggacaaagtctgaaaaagcagttatgtagaaatattctctcagctgttttttttttgttatagattaagttctagggtacatgtgcacaacgtgcagttttgttacatagttgtacatgtgcacaacctgcagttttgttacatagttgtacatgtgccatgttggttttctgcacccattaacttgtcatttacattaggtatttctcctaatgctatccctccccaagtcccccatcctatgacaggccccagtgtgtgatgttccccaccctgtgtccaagtgttctcattgttcaattcccacctgtaagtgagaatgtgtggtgtttggttttctgtccttgtgatagtttgctcagaatggtggtttccagcttcatctgtatccctgcaaaggacatgaactcatccttttttatggctgcatagtattccatggtgtatatatgccacattttcttaatccagtctatgatggacatttgagttggtttcaagtctttgctattgtgaatagtgctacaataaacatatgtgtgcatgtgtctttatagtagcatgatttataatcctttgggtatatacccagtaatgggatcgctgggtcaaatagtatttctagttctagatccttgaggaactgccacactgtcttccacaatggttaaactagtttacactcctaccaacagtgtaatatatatatatatatatatttttgtttgtttgtttgtttgtttgtttgagacggaggctcactctgttgtccaggctggagtgcaatggcgtgatctcagcttactgcaacctctgcctctcaggttcaagcagttctcctgcctcagcctcctgaatagctgggattacaggcatgaaccaccatgcctagctaatttttgtatttttagtagagacggggttttgccatgttggccaggctggtttcgaactcctggcctcaatcgatctgcccacctcagcctcccaaagtgctgggattacaggcatgagccaccgtgccctgcctctctcagctgtttttaagtcaagtctttaaaatatgtgatagacctacttgtttgaagtccttatccctagagttggaatagccaaagagagaaaaggccagaggagggagggaagaacccgatcatcttctctgtcagagttgctttcagcatgagaaagatatgctaatagggtggtctcagaactaacaatattttgcccacattccttcagaggcactgtctttttctgactccttcctcaaaggtttgagtgcccctgtctttcagagatgtgaggacaagttctctcagaattcctgagacctgccaattccactatgccatgcattcctgtcatctgtcattgtccagaatgaaagtccatctgatcttcataccactcagagtttcttcttcccttgaccaaatctcttgtttaattcctaaggctttcctcttgaattctctgaaatgttatttttgtgttaaacctctccctcgtgttcataagatgttttttggctttcttgtggtaacttaagcccatctgccctggtaatcttacctttcctttagccctctgaggttagcagtaggttttcttgcactatggtatgtcaggatgcagaatcagggtcttcatccttctccattcacaggctcattctattcctttattagggtggcccttctgcctagcttgctgttgttcctttatgcagttccttaatatcctttcacacattttctagtttaggtgatagatcatacacggtcaggttagccattttttctctatctttgtgcaaaactctctttcctctgaagttcatgctgtttgacaatgcatctctcttcccttccttattatcagaaaaggaccctgtggtcttaccctttgattcattgttttttctatttttgtctctgccattatcctgaggttactttagagtctatgtagctgatccatctggtcctcccatgttcctggtttcttgtcttttactttcatctctagttctactagtgctttcatttttatttctactatacttgctttttggcattaccaacatcttaaatttgtcaactctcttctgtttttacacccttccccatagtgtctaaatcacacttctgccagcaccctctactttgccttcttattcttccctttaccgtgctgacaaaaccctaaccctggtttcctgtgggctctctgccccatactcaggctgctaagttggagaaagaagcccacaaccaccttgcagattagcttccctcttgtattagcccattttcatattgctgtaatgaactgcctgagactgggtaatttatgaaagaaagaggtttaattgactcacaggttttcatggctggggaggccgcaggaaagttacagtcatggcagaaggagaaggggaagcaaggcaccttctacacaaggcagcaggagagagaagtgccaaccgaagcgggaagagccccttataaaaccatcagatctgatgagaacagcatgggggaaaccgcccccatgattcagttacctccccctggtctctcccttgacacgtggggtttacagggattacaattcaagatgagatttgagtggggacacaaaccctaaccatatcacttctctatctttattggtctttagagatactgtagctaagtgcaacaaggtgtcctgaattggagactggcacagaacaaggatgttgttggaaaaactgatgaaatctgaataaactctgaagtataggtaatagtgatgtatcaatgttggtttcttagttttgacaaagtattgtgtaatgtaagttgttaacattaggggaaactgacggtactttctgtattatctttgtagctttttaaactataatttctcaagtttatttaaaaaaaacaaacaaactctagcatagaacacagcagctatcaatttctttagtttcctcaaaccctaccttatcatcttctctgtcatttgcctacttttctgagaagattgaagccatcagtttgatgaattcccctcagtttcctttatttttgtttttttgttggtttgtttattttaaaattattttttatgtaagttttgtagagacaggatcttgctgtgtttcccagcctggtctcaaactcctgggctcaagcaatctgcctacctcagcgtcagtgctgggattcctggcatggacattagcttggcctcagtttccttttaaattcccctacccccttcaataaaactctacataaccttggaagcattctaagtcatttggatctactttcctctggttacaagtagataggagcagtttttgtttctgtttgttctgtgaaaccctaatacttcctgccttctcagagatttcatttacataatatttttattgaattattaaaattcaccttttgactctgctagtaactttccattgggaatatatctaaaataaaaaaatggaaattttctttccattctttctcttctctcttccacagctaagattcttttcttttcttttttttttttttttgagacagagtctcgctctgtcacccaggctggagtgcagtggcacgatctcagctcactgcaaccccgccccctgggttcaagcgattcttctgcctcagcctcccgagtagctgggagtacaggtgcacgccaccatgcccagctaatttttgtgtttttagtagagacgggggtttcaacatattggccaggctggtcttgaacgcctgacctcgtgatccacctgctttggcctccaaagtgctgggattacaggtgtgagccactgtgcccggccttttttttttttttttttttttgagatggagtttcgctcttgttgcccaggctggagtgcagtagcacgatctcggctcaccgcaacctccgcctcccgggttcaagtgattctcctgcctcagcctcctgagtagctggaggcttttgcaggcttttgccaccacgcctggctaattttttgtattttcagtagagacggggtttctccatgttaggctggtctcgaattcccgacctcaggtgatacgcctgcctcggcctccgaaagtgctgggattacgggtatgagccactgcgcccagccttccacagctaagattcttatttttgagatggagtcttgctctgtcacccaggctggagtgcagtggtgtgatctcagctcacagcaacctctgccttccgggttcaagtgattctcctgcctcagccttctgagtagctgagattaacaggcgcccgctgccacacctggctattttttttttttttttttttttgtatttttagtagagacggggtttcaccatgttggccaggctggtcttgaacacctgacctcaagtgatccacccatcttggcctcctaacgtgctgggattgcaggtgtgagcaactgtgctggcctcacatgtaagattcctgaaagagttgactgcatttgtggtcttcccttctcacctcccagtcatgcctcactccattgaaatctggctttgtccccacggcactcctaactgcattcttcagatcatcaataagttagttttcgaagccaatgaagaattttcagtctttctcttttttggcttaaatatctgaaacattttttttttccttttagagactgtctcgctctgtcacccaggctagagtgcagtggtgctatcgtaactcactggagccctgatctaggctcaaaccatcctcccacctcagcctcccaagtagctgggactaaggcaagtaccaccatacctggctaattaaaattttatttttttgtagagatgagctctcactatgttgcgtaggctgatctcaaacttctgacctcgagtaatcctcctgcctcagtctcctaaagctttgggattacaggcgtgagccacggcacctggcctaatatttgaaactttcaaatacttcccttaaaaaaaatgtaccactaccatctttgttgtatgcacaaattagaaacttaataggaaaagagaattatccataatcctaccacttagaagtattaacattttggggcatatctatatatatccagtgtattttaaaatattttaaatataatcatattctctgtattctgtaacttgtcttgaacacttaatatgttgttggtaacctttcatgtcggtgaagtttagttactcatcatcttactcttccctactagattgaattcattctcctccaggtaactatcctcagtcatctttctaaagtacaaattttgtcctggaaactttcctgcccaagtcttttcataacctttcatttcccttggaatatgaaatgcaaagacttttgtgatgtagccactgctttaccaatcttcacattagttttttagcctgttgaacaaattgattatcttccaaaagatcctaggtctttcttctttaccctttcctgcacctccccctgtccccctttatccttaaagactgcctcattcttagtatatggtttttggagtccttataatacaggtttgaccttgtgtgagctgcttaacttttctctgtgcctcatttcctcatctacaaaattgggccaaagaatctatgtcaaattaagcgaatacatatgaagcactttgaactcttagtaagcacatagttagctctcaataaatgctagcaaatattataattcaacagatcttcagtgttatgcttctcattttaggataatcttcccagtattcccagagcttacttcgcatagttcattgtagtccttatcacatggtactcattgtttttttattagactggcgccttgagggcaggagttatcgtattccttgttcataatgcatccaagtaatctggttaggggttaccagataatattagcagtatccattagattgttatgttggatcaaagaaaatatttcatgggattttgtttagaaaatctacccttatttatatatttctgtatatgaagtgtgttattctgtagaagaggttggggctacttgtaaaagtttggagaccgggagagctcaggacatggatcctttggccagcccttcaggtggccagtagtagtaatggctttttaactttttgcagtttggagtttaaaaggtaagcaagatgaggctgggcgccgtggcccacacctgtaatccacctgtaatccaccactttgggaagccaaggcgggtggatcacttgaggtcaggagtttgggactggcctggccaatatgcaaaaccctgcctctactaaaaatacaaaaattatctgggtgtggtgttcggcgcctgtaatcccagctactggggagactgaggcagaagactcgcttgaacctgggaggcggaggttgcagtgagccgctgtcgcaccactgcactccagccccagtgacagagcaaggctctgtctcaaaaaaaaaaaaaaaaaaaatcatatgggagcacacccttctccccaccgccaaataccctttgttaaaaattttaaaaagagcaaagtaaataagccacagtggtgcatgcctatagtttcagccactggggaggctgaggtgggaggattgcttgagctgaggagttcaagtccagcctgggtaacagtgagaccctgtctcaaaaatataaaagttaaaaaataaataaataagagagttttttgtttttttagtttttaaataggtcctatagcttttgaggatttgagatttctactaggttaaaatttattttaaaatatacgtgacaagatttcgaaagtacaaaaagataactcagtggaagatagatcttgcccgctccatacctctagttcttctttctagaggactatcacttaggtgaacttcaattttctataaagaaatcattatgcactaagcaactgtgattttacaagtctgtctagtagagataaaagcataaatatatgaataaaaggttgtttattgcagcattgttcataaaggcaaaaaagtaaaggtcatccatttctgtggaatgttacacagcttgctttttttttgggggcgcagagtcttgctctgttgcccaggctggagtgcagtggcacgatgtcagctcactgtagcctctgcctccagggatcaaatgattctcatgcctcagcttcctgagtaactgggattataggcgtgcaccaccacacccagctaattttttgtatttttagtagagacagggtttcactatattggccaggctggtcttgaactcctggcctcaacttgattcaccttccttggcctcccaaagttctgggattacaacatgagccactgtgcccggcccatcatacagcttttaaaaactgcaacttaactctatatctgtttattagaagtttgtccatgcaaatatattgagagaattgcctgtctcagaataaggtatagtgtatgattcttgctttataatagcaaatagctaatcccctttccccaccacatatatgtgaacatgtttgtctgaatgtgaagtatggagggatacacactaggctgttaacatgtttacctcaggaaatgggaatagcggggaggcaagagtaattatgaacttggaggttaatatgggtctattttagttacagagaatgtggtgagaatagtacctcagggggagaaaactagagtcagtgaatttgagtttagtgaagggtttgggctagagatctctacctctgtggtctttctctttcttcctgtatcagcctgtacagtgattgctgaggctttgttcctgttctttcttgagatttctgctttggggtagccttattcaatttttgattgtaactctgtggattcacttccgttaaatctgtctttctattctgactactcttcaactctaggtcttttggatacttcctcagtcaagcaccttgcacttactttgttcaaaaccatcctcgttatctgtctccccaaattcgtttttctgttttctgcttccttttaagctttataatacacatttgaaaaatacccgcaacattgagtcctatagattccattccatttctgtatcctgtgttttagattttcccttccagagggagcagtgcttttactactttgggaactattttatggagtaggtgtttgaatagatccttggttttgtatgagccattctaagggagggaggtcaggcttctgggggaagggtatgtcatagcacaactaaagaggaaggaaaatgcagtggacggtagaaagttctcatttggctttgagttgggaggtgaaacaataggagattgagttggggagggaggcatgggttgtcagattgacgatacatagtaggttcgattggacttttttagaggagtgtaggccatgatcagaaaggtgccttaggaaaattgatcttgaggcccagtcagggaagcaaataagaacttttgttagaataatccagacatgcattaatagagtttggactataatgaaagaggaatcttgaagaagtaggctaaatttgagacaaaatgaatggatataagggatggagtagagagagtttcagatgatctaggcttttgagactggctgaccagtaaactgaaaacagtagtgccttgatgatatgatcagtcagtgatcccatgccacattggtcatgggagaaaaaaatcaaatttgtaattaattgcaggggtgggatcatctctcccagctagtggccggttacaaatttgtgggcagatgttttaattgctgttgttaaaatgacacccctactctctgcatgccctctttgccattccgtaatttagagggaaataaagatgggcaaagaaataccaggatagtgctggtaatggaggaaaagggaggtcatagtttcaacaaaaaacagtctacagaggcaggatagcatgatggagcagagtgtccagagtctggttcaaatcctgaattgctttataaactcagagacctttccttttccttttccttttccttttctctttccttttccctttcccttctctttttcttttcattttccttactgggtctggctctgttgcccaggctggagggcagtggtgtgaacaaggctcactgcagtctcgacctcctgggctcaagcagtcctcccacctcagcctcccaagtagcttggactgcaggagcataccaccacgcgtgactaacttttgtattttgtgtagagatgaggtttttgtcatgttgtccagactgttcttgaacttctgagctcaagtgatctgcatgcctcagcttcccaaagtgctgagattacaggtgtgaggcactgcatccggcctccagagctgttttctaaaggttacaagtcttctaggcgtttgagctgaaaacatttggatagctggggtttaaatgttgccctaagctgctttgaatcataaagaagaatgagcagaacactgttctgagtaatgcaggtctctttatttgataattaaataacttggtttattatttttaggtttttttttttaattaacctctcaagcttttatttaaatgccatgacccaggatggattttagattttgttgaaagcagccacatccatggactgcacatagtcttcaaaagcagtgatctgcttctccagcttatctgttccaactttatcatcttcaacttcacaacgtatttgaagtttcttaattctgtatcccacttgaactagtttagatgagccccagactaagccatctgcttgaatgcctctgatgcactcctctaattttgccatatctgtcttatcatcccaaggtttcacatctataagatggaagacttggcaacgagtgcaggttttttggctttcttcgattcatattgtggaaggtgttcttcccttagcctcttcgtttcttcacttttctcctcccatcagctccaaagagatcaatgtcatcatcatctttactatctttagctcctcttcctatagtgtcttccatatccacaggaccatacttgaccaaagccttcttcactcctggaaggctggccttttctttttcgtaagacttgatgtgattataccaacgaagggcataacacaagtcagcaggcggtgggccagatgctgcttcaaatactgccacatctgcttgtgatggcacatacccctcgatgtagctcttgtccgccaggtaattgttgagcacctggaggccggcagggcttttcaggtctctgaaatccatggcatcagctgtacctgagagctgaggagcagcagaaagagctcaagttgtgggcaccctgtgctgaaagaggaaaaaaatattcttaggtttttaagagttcttcagaaatctttactttaggggccgggtgcagtggctcacgcctgtagtcccagcactttgggaggccgaggcaggtggatcatttaaggttgggagttcgagaccagcctggccaacatggtgaaaccccgtctctactgaaaatacaacaattagctgggtgtggtggtgcatgcatgtaatcccagccactcaggaggctgaggcaggacaatcacttgaacctgggagacgaaggttgcagtgagccaagatcatgccactgcactccagcctgggcagtagagcgagactcagtcttaaaaaaaaaaaaggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaaatctttacattaggaaataattttcttacagaaaccatgttgtaaatggtagttgggttcccagctcaagacattaaaaaatcttctgagctcttaatggttgtacattgtagtagttttgtagtactcaaagatttataggtgcaatgataaagtggacccaaacagaatttccttgcttgttgttgttccttagatgctgcttgaatctggggcttcgtttatatttcaagactgctgcctgtaggagctccatctgtatcatttgtgttaatagtgaccctggagttttgtacttccagaacctatgtgagcatatgtgatggccttgtagtaagttaaaggggaaaaaattaaatcactaacaatgaatttagtattttcacaaatagcaaatactttgaattttagttgagatttacctgctttataaattcagtctgatttaaatcctgacttgctttataaatgcagagccattattcaatgctctaaaatcctctacgggtttgagtttaaaacatttggctagatggggcttaaaatggtggtaaaaccgctccttcaggatgtttagtattaaagaaaaaccttacaattgatgtggtctctacagctctagttgatgtagtctcttcatctctgtttgtcatccaagtaggtccacatacttttagaaaacacactgaattgatttatgttacaaaaagtcataagactgttgtgtaagcagtgatgcctgttttagtttaacagtgggcacctttcctggggtctgatcattgctaccttgacaagtcattcatttggaatgtaccataattttaattgaatctaacatgtgtcaactataagattaatcattttgtgcattactgagaaagaaaggaatactgccaagaaggctccggcacatctggcacaggcttttcttgttagaattattttatattttttaaaaaagctctgttaaacttatttagcaaataagaatggatttttattaaacagtgtatccttctattgcatgtatgaaaatgaaaatagaagtaaaataaatttgttaagatagtcgtaagatttctgggtatttagagtctgacttttctaaatcacttttcaacttggcatcatagaagtctcctgctttcttcctccctctccccaccagtcatgcaaagtattggtgatgcagtagttaagggaattctctattactctgtcatcaatttaaaatttagtcgtttgatgcttgtgaagattttaagagcaatataagctatttaatttttaatcccttttagtacttcagggctgctgcatgtggtcatatgggttgtgcagtgtcatcagtatcggtagcaaaccataacagactccattggcttgtgtgtttttcccccctttctttctgaggtcctgtaaatcacttggaatcattctttgaatgatgaatagttacttcactaatactccatggctgtatttgcttcttttctgttatacaataaatttagttttgatacagaatcatattattttgaagacatttaaaacagcggtttaaaaaattggcccttgttcagacagctgtaacacaactcgcacccagccagtagcagttgtaacttggcatcagttttaagatgcattctaatttcagagaaattaaaatgttaaaaatagtgttttcttttttattttaatttttttaattttttttttttttaattgagacaaggtcttgctctgttgcccaggctggagtgcagtggtgcaatcacgactcattgtagtctcaagctccacagcataagtgatcctcccacctcagctgggactacaggctcgcaccatcatgcccagctaatttttatatatttttgtggagacagggttttgccatgttgcccaggctggtcttgaacttccgggctcaagcgatccacccaccttggcctcccaaagtgctgggattacaggtatgagccaccatgctcggcagttatgttttctttgaatcactagttgttttaagagatgaggaggggcggggcgcagtggctcacgcctgtaatcccagcactttgggagacctaggcaggctgatcacgaggtcaggagatcaagaccatcctggctaacatggtgaaaccttgtctctactaaaaatacaaaaatattagccgggtgtggtggcacgtgcctgtagtcccagctactcgggaggctgaggcaggagaatggtgtgaacccgggaggcggagcttacagtgagccgtgatcgcgccactgtactccagcctgggcgacagagcgagactcttgtctcaaaaaaaaaaaaaaaaaaagtgatgaggaggggactaagtttacctcagttttagtctggtttgcaccttttgtgtggtgggggagcagggagtcagggtcaagtaagaacaggataatctcccttggagtctgcttggttgacacagggctggaagtacctttcagaaggaaggcagataaatgaatagctgattatgaaggttaacacacttttactttgctgtttctaagctttagacatatttgtagtttattattttttagatcatttaaacagaggcaacagggtgataaagggagagaatccttaacttggtccccagtgccgtgtgtgatgtatcttagagatattttacagtatacagttgtccctcagtatccatggggattcattctaggatgtccttcagatgttaaaatccttggatgctcaagtccctaatgtaaaatggcatagtgtttgcgtataacctatgtacatacttctatatactttaacacctctagattacttataatgcttaatacaacataaatgctgtgtaaatagttgttctgctgtattgtttagggaacaatgacaaggaaaagaagtgtctatacatgttggtacagacgcaattaaaaaatttttttccatccgaggttggttgaatccatgaaccagaacccatggatatggagggccagttatatttacaatttttatagtattttccatttttttaagctctcatatcttaagattacttttgaaatgtcacttgtgaaattcattagtttattattttaacttgacaatctgaagcaacttttaaaaaatttatattttatttatttattttaaaactttttttttttttttttttttaaagagatggagtctcactatgttgcccaatccagtcttgaactcctgggcccaagccgtctgcctggcttggcctcccaaattataaatttatttttatttgtttattttgtagagacagggtctcactccatcgtctaggctggagtgcagtggcaggaccacaactcactgcagccccaaactcctgggctcaagtgatccctccacctcaccctcccaggcagctaagactacaggcatgtaccaccatgcccagttgatctttaacatttcttttttttagagaccacgtctccacctcctgggctccaacgattctcccatcttggcctcccaaagcgctggatttacaggtatgagccaccttgcctggtggttcctggcctgatccaagataatttttaaaagaagcagtaggctcgagaggctgagacaggaagatcacttgaggtcaggccaagagttcgagaccagcttgagcaacatagtgatacacactgtctgttaaaaaaaaatcactagggtgtaaagtgctaataagcagaaggtgaggagagttgtggcagaagctatgtgataggtaaggagggtccttattttaataatctttgatgtacctcatggtgataggggagtcattactaggaagtaatatgaactaaaatgtaaatctattacctttcattcactccccattgttccagggataaagggagaaaatccttaacttagtctccaatgccctgtgtggtctgttcctacctctctcactagcttcatcttaaactgtgcctccttaccccagattaacatagaaaggtggggagtcagaatataagggttgatttattcatttcactttgcctgctatattattgttttaagtaggaatttcaaaatctcatttttgtgactctagttgagaggagcataaataaaacactctctaactgtactttctggcctggaattccacatttaatctcaactaatagtatggagatatttttctcgttaacaggtttcttcacatataaaaatctattgtaaaaatacggaaaagaatggcagcggaaacgcagacactgaactttgggcctgaatggtgagttttcaaaatctcatcttctttgatattggatgactaatacagtagtaaagtatttgacaggtgctaggtggtttataaatgtgcatgtttttgaaacttttgctttatgtgcctcgctgaaaacaatgtgttagttcaggaataaattatatttggtaaatgagtgtattctatacttaattaaaattttttttctttgtctggttatatatgtaatgatggcgggagtcccacccgccctagaaaattattttctttttatttgagtcgttgtctaggtgcacatacaattttatgtaagtataattataacatttttatgtctgtatgttttctgctacattgttttatcattgctgttcatagattgatttgagaaatagttttcattgaagtattatttgaaagatgggctaggcaggtagttcagtattatactggctgttaacagtagcctatctaggattcagttagcattggacataataacgattaattgacctttgagtctcttacagatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaagttctaagaaccgatggaactcctgtattttgagagtttatttagaacatgttaacctaagtaatgctgtacttgttttagttattcctttatatttttaaaatgattttcttagtatcaaattaatatgtttctaaaaaaattagaaataactagtaagccagaaataatttcaacatccatggtacacactgtaaataccttggtgtatctttccaggtggttttatgtatgcttatttgtgtatatatacacttattttttacaaaaatgggatcatactgtaccttcagttttgtagcctgcttaaagaaataaccaaatcagaaacatctttttttaatcaataaatattttctgttgtattaaatggttgcattgtatggatgtaccatcatttattcaactagtcttctagatgtgacatatagaagctgttcttgatttttcattataaaaatatttttaatgaacattcttatagttacatctttatttctaccttaattccttttatcaggtggatttaaattcatataagttactttcttagccattttttgtgcaactcatccgcctttatctagaatttgtaactgcttctcttttatatttacataccctcatgtctgtttctttataaaaacatggtttaaattgtcagctaatttaaggaagttgtttttttcagcatcctgctgtttataggtaacagaaagggaacaccaggaatttagacacaacaacagagaaaagaaaaactgatgatattttagaatcaatacacatttagcttgatgcctaatattatgggttggcaaactatggcctgtgggactgtaaagtttttgtaagtaaagtttcattgaaagacagagacgtccatttgcttccatattttctgactgctttcatgctacagtggcagggttgacaggccatttggttcacagagcctaaacattaattctctggccctttggagagacagtttgctggcccctgccctacaccatgagttctcaaggtcatctcagtgtagtattgagcatctttcaatagtatcttacacatcctcctttttattgatactctgaagttttgtttgatggtatttcacttgattggctcagtgttttgtataaaatttgaattgaggtagccttaaacagagggcaatcaccatttccatccttaaacagtagcctcacctaattgtacatctgtacaattgcagacattagagcttaggagcattcccttagtcatctgaaatgctgatgcactgaggaatgcaggtgtaagtaggcatagtgccctatttgtatcatctgtcaaaattccttctggcaaagggagtatatgaggcccttaagtaacccaagtaatcctgagctggaaagttgcagtaggagtagagagtactacctaatttttcttcacgtatgacgttctttgtgaaacttgaggtaaagagctgtgcccagggtacttgagaatcaggatttagattgttaacatcgaaccagtgtgcaattaactctaaatgagacagaagcactaagtgatacggtgtttattaaggtcatcatttttgtgaataatgtaaaacatgttcaataagggatacttaaaaatgaagcaatttatttgtatctggggacaattgtgaagatgggagaaaattgaaaattttggtaggaacagaccatgagtggctgtaagctttaactttttttttttttttttttttttgagatggagtcagcctcgctctgtcgcccaggctggagtgcagtggcatgatctcagctcactgcaacctctgcctccagggttcaagtgattcttctccctcaacctcctgagtagctgagattacaggcacccaccaccacgcccagctgatttttataattttagtagagacggggtttcaccatgttggccaggctggtctcgaactcctgacctcaggtgatccgtctaccttgtcctcccaaagtgctgggagtgcaagcatgagccactgcgcccggccaaggcttgaactttttaaggtctgtggaatcattaggtcttagattatttttctacttagaataaaaaagtatatt

SEQ ID NO: 11 - DNA, 5857 bp, Homo sapiens
ccgtcaccttagttcctcaattctaattgtcttactccaatttttgtcttcccaaatatctctaggtcaccatatttagcttgacttctgtgcactatgaagtgaactagcaaatgcttcaaagaaagaaagtagcaaataacatcaggctcacttctgtacattctctgtctctctaagatcttgttccttcaagtcctggctgccctggttgtttagatgccttcaaacagctcctcttaattttttaatccagatttataactgctttcaacagtaagtggttctgatacaagctgctgtatcatagccagaagcaaaagtccaattgtctcatatttaagggcatattaattattgctaaaataggaaattattttgtaagtaaagagataatttttaatgtgaataatttttagtattacctgttttgtgggtatttaaaatttttccttgaagaaaggtatacaatattttatagaagttacttaaaagtattaaatataatcttttaaaaatgctgatcataaatagttgtataaaccatattcaaattaaatactttttcactcatctaaatttaattcaaaattgaatgtaatccaaaaatatgcttattttattttctgattatactgctgcatatttgggtataattttatattgcaaacaagtttctttactactgtattctgtgaatcaagcattagagtaagtgaaaagattgacgatttgaatatcaggtaaaacaagcataacagagatttgagctggaagtacagatttagcatcatgaacctaggtggtcaagatctgaagcaatggcaaattcagtagatattatcagatatgaaaattttgtgggattgagactgcttcccaagcattcacaaatggggaactacctgggtcctccacacttcatagaagccttctacacatccttagtcagctctctttcttattttcgaattttgggtcctctacctgttcatttctcctcttacattcagcatatgtcttcttgtttcataagcaaaacagaagtcaccaggtgtagctcccacaaattcctgtctctacatcaacaactaaacaatataaaaaatcagctttctatcttcatgccccactcatatccgtaaattggccttcatcccctaactgggcaatgactctgtctatactctaggtaccctctttcccatcttcttagcatacttgtttcccccattaggctggcatcctcctgccttttttcaaccctgcttttatgtctttttttctttcactgtataaatatactccccaccactaggctgtttaatcacaaattttcctctggtctggtgttttccaaatttcatgcttctccccatgagtgggttgtgaaattaatgagtctgtttcataaaaatatattaagaaatgaattagtatggaacctacaatatcagaatgcaacacgtatattcctagcaggaggtgtccacattgccacaaatcctgcagacaactgagttgagtgacagctggagaatgagaggtaatgaatatatgcattggctgggaactgccagccagtcactcttctgctcactggtgtctcagctgattttttggaattgatcataattgtatcaggagagttcatgttttatagtttcattttatgtcaatgtaatttatagctaattataaagtgaggtttagaagaactttatctagtcttggcaaaggcaggaagactttccaccaaggtttggctatgagttagaagatttcagtgtgctttttgaattaggcataactgtcaggcatttttcaaccttgtgataattgtacattttaatcaaagttataccaactatccttaacacagtttattttattattagaagaaataaaaacagtcgtgtgaaaaacacagaggcatgttctggcagaactaccagatttggacatgtacatagtgacaacattaagaaaaatgtctttttaaattaataaattctattatttgaactataagccaaagaagtgcaaatcattttaataatgataaagtatagcttgtcgattactcaaaactcactgaaaatgtattatttgtaatgacattcttgtaaataaaagcttaagatcttccaaaaaaatcacttgaaatatagcaagccaaatttgttcataaggccttcaaatattttcaaagaaaaaaagatgtaaatttgtcaacatgatttcacattggttttaatgaaaaagcattactatcataattagtcacatgtatgcagcaaaaggaaaaaaattaaacagctcctaaaaaagttgttctcagcatacatggttatagtgaatatgattcttgataaatcagcagagaaatttaaaattatacttctaagtcatattatagttctaaagaatatacagaatagaatttatacttattaggcacatacaggcagacacaggttgtataattccacttaatgagaacactaatatttcacattacttagactttagtttatgccaaatatgtatgaaaatatgatttttataaaggatttattgtgttgtttccatttaacctaacacaaaactacttgagaaacataagttcaactggaaaattgtaacggaattgtgagtgattcagaagtaaatacgaccaggagacatggaaagataatttaaaatattgttagaagctactctgtacattatttaaaatctgtgttttatacattacaaagattttgcatcctaacaattgcactaaatcttttggacttgaaaacaaaagtaacgatagttgtttaattttattaagggaaccttcaatttttgatatgttttgttcagaaattggatctgtggctaatgattcccctccctatgccataggaagagagctgtgattactcaggtatatctctgcaactctgtcttcaccaatgcaatatatgagatttgtgtaacttctgcctctgaggcatggactcctctactctcttttcctcttcctatgggctagaacacaatgtgcctggtacatatctttgagacacacaaatgagaacaaccccctatgggatgaggaaacagtaacatttaaggtatatggtcacttaatctcctgggacctgctgcaccaacctcaaccactgactcagggtttaattgaagagagaagtaagtgtctatgctttgtaaaccactgtattgttgggtctttgttaaaacaacttagcctttccatcaaataacatgtacatgttgcatcgtactgaagttattgattgttacgaggaaagtactcattaaattatatgaactcaggaacaggattcatattttcctatttgaaaagcaatctcatttggcattttgaagatgatatttcaccagaagaatctgcatataggactaatttttttgacattttaaactaactgaatttggatctacagggaaaaagtaacaatatatttcaagatgtttaatatatccaacactaaccaatacattttaagtaatcactgtggttactatgtgtgcacaattttgtaacacataaagagaaaattaatgaagacattttgaatagaaaaatgatattagttatattacgtctctgttataaactttaataatttcaaaaagagaaatttgaaatattgaggaaaaaattgataaaagatctgttttccaaaatcctgaatccatattaaagttgatactcaaagaagaaagctaatctctaatactttaatacattgaagaatgattataagtttatagccattttagattaagattaaagaagactttccattgctaaacagagttcactgttgttattaatagcattcacagcaacttatttgtgtgagccagaatttttaagcaacaaaactaaaaacattggaaagaaataggcatcacagagcaaaccactgtgattgtcctcatgcccgcaacccagaatgaatttaggaacaggcaagtatgcctgctgcagtgaatgaaatcatgcttagtagtaactattctagttaacagtatgtactgttttatacctaaaactgttgtttcagttttttaacatatctatacatgtatgtaaacactggatgataatgtaaagcatattttctactgtgagttatagaaaaaaagtagaaaggtgtttactttccttcatagccatccactgggttgtttatccgtgtgatttcaccagctcttaatccactgcaaccaggctgcagtcatcatttctcccgggtctggcttccacgggatcctaactctctcacattcattacatcattttctgtgtttatctttgtcctttctctggatgttgaccttgttgcctggatactacttttatttcatttttgtgccacttttttttttagaataacacttctgattataaaagtaaaaatatttaatgaaaaataaactcacctataagcccatcaaagataatcacttaatattttgtatgtacttttgatagatatgtatgtacatatatgcatgtatttttgaacttatatatacatctacatcaaatatttaaataaaattggaatcatgtagtatacaaaagtacatagcattttacaatttgcttacttaagtatatagtataagccacttttctttttttttttctttctctgtctttttttttttttttttttttttttttttttttttgagacagtgtcttgctctgtcgcccaggctggagcgcagtggcgagatctcagctcactgcaacctctgcctcagggttcaagcacttcttgtgcctcagcctcttgagtagctgggattacaggcatgtgccaccacacccggctaatttttgtatttttagtagaggcaggggggttctcaccatgttggccaggctggtctccaactcctgacctcaggcgatccacctgccttggcatctcaaagtgctgggattacaggtgtgagccactgcccccgacaccacttttcatattattcaatatttctctcccacattattctttttaaattaaaaacaatttttttttttagtagagatgaggtcttgccatgttgcccaggctgctctcaaactcctcggctgaaccaatctgcctgcctcagcctccgaaagtgctgggattacaggcatgagccaacatgcctagtcccccacattattctcaaaggctatataatatgatgctttatgaatatatcatgggttatctatccatatccttgttgcatatttagttttctctttttttagaattgaaagacacactgaaatgcttgtagaaagatccttatccatttccataatcactttcttaggatgaattcccagaagtggaattgttaggtcaaagctatacctatgccacatacacatccaggctccctccctccaggaatgtagtaccaagttacactctgaccagcacccaagacatgagaggaccttgttgttcagctccttcaataacatttaaaaaatctctcagtcaatttgattaatagaaaatagcatcttatttaaaagtttgttctctttattaggcacttgaacattttttataagtttatggggtcatatgtattctctcctctgtaaactgactttatatatattggcttttttaaaaaagaaggagcatttgttttttaattctttgttaaagctttttttttttaacaaagctattcaaactttatatgtctgacattaatataaacattttcctagtttgcagcttaaacgaaattgtttttaattgtaaaactagtaaatactttaaaatagattcaa

SEQ ID NO: 12 - DNA, 3212 bp, Homo sapiens
ccgtcaccttagttcctcaattctaattgtcttactccaatttttgtcttcccaaatatctctaggtcaccatatttagcttgacttctgtgcactatgaagtgaactagcaaatgcttcaaagaaagaaagtagcaaataacatcaggctcacttctgtacattctctgtctctctaagatcttgttccttcaagtcctggctgccctggttgtttagatgccttcaaacagctcctcttaattttttaatccagatttataactgctttcaacagtaagtggttctgatacaagctgctgtatcatagccagaagcaaaagtccaattgtctcatatttaagggcatattaattattgctaaaataggaaattattttgtaagtaaagagataatttttaatgtgaataatttttagtattacctgttttgtgggtatttaaaatttttccttgaagaaaggtatacaatattttatagaagttacttaaaagtattaaatataatcttttaaaaatgctgatcataaatagttgtataaaccatattcaaattaaatactttttcactcatctaaatttaattcaaaattgaatgtaatccaaaaatatgcttattttattttctgattatactgctgcatatttgggtataattttatattgcaaacaagtttctttactactgtattctgtgaatcaagcattagagtaagtgaaaagattgacgatttgaatatcaggtaaaacaagcataacagagatttgagctggaagtacagatttagcatcatgaacctaggtggtcaagatctgaagcaatggcaaattcagtagatattatcagatatgaaaattttgtgggattgagactgcttcccaagcattcacaaatggggaactacctgggtcctccacacttcatagaagccttctacacatccttagtcagctctctttcttattttcgaattttgggtcctctacctgttcatttctcctcttacattcagcatatgtcttcttgtttcataagcaaaacagaagtcaccaggtgtagctcccacaaattcctgtctctacatcaacaactaaacaatataaaaaatcagctttctatcttcatgccccactcatatccgtaaattggccttcatcccctaactgggcaatgactctgtctatactctaggtaccctctttcccatcttcttagcatacttgtttcccccattaggctggcatcctcctgccttttttcaaccctgcttttatgtctttttttctttcactgtataaatatactccccaccactaggctgtttaatcacaaattttcctctggtctggtgttttccaaatttcatgcttctccccatgagtgggttgtgaaattaatgagtctgtttcataaaaatatattaagaaatgaattagtatggaacctacaatatcagaatgcaacacgtatattcctagcaggaggtgtccacattgccacaaatcctgcagacaactgagttgagtgacagctggagaatgagaggtaatgaatatatgcattggctgggaactgccagccagtcactcttctgctcactggtgtctcagctgattttttggaattgatcataattgtatcaggagagttcatgttttatagtttcattttatgtcaatgtaatttatagctaattataaagtgaggtttagaagaactttatctagtcttggcaaaggcaggaagactttccaccaaggtttggctatgagttagaagatttcagtgtgctttttgaattaggcataactgtcaggcatttttcaaccttgtgataattgtacattttaatcaaagttataccaactatccttaacacagtttattttattattagaagaaataaaaacagtcgtgtgaaaaacacagaggcatgttctggcagaactaccagatttggacatgtacatagtgacaacattaagaaaaatgtctttttaaattaataaattctattatttgaactataagccaaagaagtgcaaatcattttaataatgataaagtatagcttgtcgattactcaaaactcactgaaaatgtattatttgtaatgacattcttgtaaataaaagcttaagatcttccaaaaaaatcacttgaaatatagcaagccaaatttgttcataaggccttcaaatattttcaaagaaaaaaagatgtaaatttgtcaacatgatttcacattggttttaatgaaaaagcattactatcataattagtcacatgtatgcagcaaaaggaaaaaaattaaacagctcctaaaaaagttgttctcagcatacatggttatagtgaatatgattcttgataaatcagcagagaaatttaaaattatacttctaagtcatattatagttctaaagaatatacagaatagaatttatacttattaggcacatacaggcagacacaggttgtataattccacttaatgagaacactaatatttcacattacttagactttagtttatgccaaatatgtatgaaaatatgatttttataaaggatttattgtgttgtttccatttaacctaacacaaaactacttgagaaacataagttcaactggaaaattgtaacggaattgtgagtgattcagaagtaaatacgaccaggagacatggaaagataatttaaaatattgttagaagctactctgtacattatttaaaatctgtgttttatacattacaaagattttgcatcctaacaattgcactaaatcttttggacttgaaaacaaaagtaacgatagttgtttaattttattaagggaaccttcaatttttgatatgttttgttcagaaattggatctgtggctaatgattcccctccctatgccataggaagagagctgtgattactcaggtatatctctgcaactctgtcttcaccaatgcaatatatgagatttgtgtaacttctgcctctgaggcatggactcctctactctcttttcctcttcctatgggctagaacacaatgtgcctggtacatatctttgagacacacaaatgagaacaaccccctatgggatgaggaaacagtaacatttaaggtatatggtcacttaatctcctgggacctgctgcaccaacctcaaccactgactcagggtttaattgaagagagaagtaagtgtcta

SEQ ID NO: 13 - DNA, 5551 bp, Homo sapiens
caacccaaaattctaccaacaaaggtaacctactggtatttgggtatattttttctctgggccttgtcctccgcctttatctgatgctgcagatgtaattctgtgttccgcttgtttgcttcatgttgtgttatgaacatgtccccctcaaatctccctgggagccttccagcgatcagccccctttgactgtgtggctctggccttggggaagagctgagggtctcctgccctaacggatggtttcagggtgtgaaggtcaaaggcctcatcctcatcagcccccagaaccctctgggtgatgtatactcccctgaagagctacaggagtacctggtatttgccaagaggtgaggcaccccacactggccccgacagagcgtctgggcagcctggggttccaatgcgggtttggtgcaggtttttctactctcttgaccccactgtgggctgctacttgcttgggcccttccttggcagtggagcggggaagcagggatttgtgggatgcccattcctctttatctttcactctttataacaatagctatcaattagcgcacactctaggggccaggcaccatgctaagcactttatgtgcctcatacaatcctcacaacaatgctatcatacaatcctcacaacaaccctttatgtgcctcatacaatcctcacaacaaccctcatacaatccttacaacaatccttacaacaatcctcacaacaaccctactgatgctgttatcacatccagctcactgagccttagagtggtcaagtgaggggtggatccagacttgaacctgggtctctccgactcgagcccttgtgcatgaccttgcccctccatggaggtgcccgggagatccttttctcccctgcagtgcttcaaaagctcctctgtcacctgctctgtatgtgtggctttctgtttgaaaaaaacagaagaaagaatggtgttcttggaaaaacaagtttggtaaccccgggctagaccccggcccctctggatttctgatgtattacctccccaccctgtgggacgcatctgccctacacactaagtctctcctccccacccctgcctcactccaggcacaggctgcatgtgattgtggatgaggtctacatgctgtccgtgtttgagaagtctgttgggtaccgcagtgtcctaagcctggaaaggtgaggctccctgacacagctaactcccccagtccctattatcccacggagccctggccactttctggctcagcccacagggcatggcctgcccagagcaattccatttccacccagctggtcccactggtcctcagatctaatgagaagcagggacggttgggctagattagtgattttcaagttgttctgtggaatttctgagaactccaagaagaggcctcaggatcccttaagttagggctgagtggatggcaaattggcctctttgctgtttcctttacctccagagtcgctccagttttattcattcattcatttactcattcatgctctcattcactcagcacctctggagccccttacacacagagtgtgccaaacacctctggatatttaaatgttgggctttttcattaggtttactgtaagcaaagcatttgtggccaaaatacctttgggaacacttggagcagatcatcctcaaggcacactggcccatgcctgtaatcccagcactttgggaggccaaggtgggaggattgcatgagcccaggagtttgagaccatcctgggcaacatagtgagactctgtttctacgggaaagaaaaagaaagtggggaccagatcatgtgggtagtctgtgaatctcaccttcaggggttctaacagttccggctgtttgttcagaaccttcagcccagccaagccctttccattagccttctcttcttgtcctcacaaagccttgaggagttgatggagcatggattgtgactctcatctattttttggattaggaaactgaggcacagaaaaaagtgattgtccacgatccttggttagtcattaaaaaaaaaattattgagcatcgatttcgtggcaggcactgtgctaagtgctggagatacaacagtgaacaagaaagacatagacccttcttgtgtagaactttaatttctagccagaaaaaccattttagcggctaaatgcacatccagccattggattatggccatcatgaatgctaaaagggagagtccagggagctgtgagaggatctgtttagggtacctgattggcctggtcccagggggagtggttagggaaagtctctttgatgagtgacatttgagctaggctctagatcatggctgtgttctcattaaactttatttacaagaaacaggcagcaggctatgtttggcccgcgggctgtcatttgctaacccctgctctaaaggatgcatgggaatgggtggttcaaagacatgaaaccagggcttgtcctggaaccaaaactagattcaaccacccatctcttcatttgttcaaccaaacacatgtgggtttccatagttctgtgttgcctctgttcccatgctgtgctctctgcaggctccctgacccccagaggacccatgtgatgtgggcaaccagcaaggtgagttcctggctggccttgggggtgtcagaagggtgggagggcagagaggtgggtggaaccagcttcctccatggagggctggccaccgcctagggtgcttcttcctgcaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtggtgactgcctgggcctggtgacctgaaaatgggaggagggttggaggcagcctgggaacagccaggaatcatagatacttctcctatgagaataatttagggtaatgtttgagagtgccagctctgagccccgactgggtccataccctatttggccacttcctggccatgtggcactttgcttcacctctttatctgtatgagcctcagtttcctcatctgtaaaacagggatcataatggtacctgtcctgtaacaggttagtatgatttgtaattcaattagaatagtgcctggcatataataggcacttgattaatgtgaattcattatgactagctgtgtgagcacctaaaaaacagagcagggtcgagcatggaggttcatgcctgtaatttcagcactttgggaggctgaggtgggaggatcacttgaacctgtgaggttgaggctacagtgagccttcatcataccactacactccagctcgggtgacagagtaagaccttgtctttaacaacaacaaaaaacagcagaagcttctaaggaaaattgttttaaaggaagtatctctcttgctgtgaatctattctgttcctagattcaaatagtgagtttaaatagcaaaggttacctttaaatgccgccatttactgagcctagcaaatgcacctgctgtatcatctcattcactccagaatcctaggaagcaagaattcttatattttccttattattttacagatgaggaaaatgaggaccagatactaccccactcactatagtagctaaaagttttaaaaatagtgacaacatcaagtgttgacaaagataaggagcagctggaagtctcatacactgctggtaggagtgtaagtagttcagccactttggaaaagaattcagcagtttcttataaagttaaacatacacttgccaagtgattcaacaatcctactcctagatattgaccttgatggtcacccaaaaacctctgctttattcatcatcacccataactgctgctttattcataatcacccataactggaacaacccaaatgtccttccacagatgtgtggatgcacaaaccatggcccatccactcaatggaacactactctgcaataaaatccgtggcagtatgggataatttcaaaggaatcctgctgagtgaaagcagctagcctcaaaagattacatgctgtataattccaattcgatgacattctggaaaaggcaaaactgtagtgatggagaacagatctgtgcttgcagatctgtttatagtcacatcagagatgtgactatcaacagcatcagggtgttctttaggatggtggaactgttcagcatcctgactatggtggtggttacataaatgtacacatgtattagaattcatagaactgtatgacaacgacaaaaagtcagtacaaacaatgaggatcagagaggtgaagttgcccaaggacccaccccttgtcattggccacactgggatctgaaccttggtctgtgggactacagagcatcactctggaactttagaactagataaacattgggttcgattctttatcctgggggactttgcgctgagggggtgtgggacctggagctgtcagggctgagtgtctgggtttaaggtgctttacattgaacactgcatttccatcccttcttgacctccccttcgtaatccttcccaccacagcagccagctagaggagggactcaacagcatcctggcagcttgtggcctttttctttacagcatttagactagtgggaccaagtagagggttgatgggatattgatcttctggcctctttcacccaaacagactggatcaaccaggtgtacctgccggaaaaccatgcccggctcaaggctgcccacacctatgtctcagaagagcttagggcattggggatccccttcttgagtcgtggggctggcttcttcatctgggttgacttgagaaaggtaatgctggtggaggtgcgggctgagagggagtttcaggtctccctccagcaggtgaggggcagttggtgaggggtctcagctatgtcctgagccccttccaccctctcagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctgggtgagcagcctgcctttccagcccagtcctaactgcagccttcactgtggcctccgcttgtttgtccccacccacgtggccatcagtgccaactggcccctcacttccccttcccagggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccc

SEQ ID NO: 14 - DNA, 1563 bp, Homo sapiens
caacccaaaattctaccaacaaaggtaacctactggtatttgggtatattttttctctgggccttgtcctccgcctttatctgatgctgcagatgtaattctgtgttccgcttgtttgcttcatgttgtgttatgaacatgtccccctcaaatctccctgggagccttccagcgatcagccccctttgactgtgtggctctggccttggggaagagctgagggtctcctgccctaacggatggtttcagggtgtgaaggtcaaaggcctcatcctcatcagcccccagaaccctctgggtgatgtatactcccctgaagagctacaggagtacctggtatttgccaagaggtgaggcaccccacactggccccgacagagcgtctgggcagcctggggttccaatgcgggtttggtgcaggtttttctactctcttgaccccactgtgggctgctacttgcttgggcccttccttggcagtggagcggggaagcagggatttgtgggatgcccattcctctttatctttcactctttataacaatagctatcaattagcgcacactctaggggccaggcaccatgctaagcactttatgtgcctcatacaatcctcacaacaatgctatcatacaatcctcacaacaaccctttatgtgcctcatacaatcctcacaacaaccctcatacaatccttacaacaatccttacaacaatcctcacaacaaccctactgatgctgttatcacatccagctcactgagccttagagtggtcaagtgaggggtggatccagacttgaacctgggtctctccgactcgagcccttgtgcatgaccttgcccctccatggaggtgcccgggagatccttttctcccctgcagtgcttcaaaagctcctctgtcacctgctctgtatgtgtggctttctgtttgaaaaaaacagaagaaagaatggtgttcttggaaaaacaagtttggtaaccccgggctagaccccggcccctctggatttctgatgtattacctccccaccctgtgggacgcatctgccctacacactaagtctctcctccccacccctgcctcactccaggcacaggctgcatgtgattgtggatgaggtctacatgctgtccgtgtttgagaagtctgttgggtaccgcagtgtcctaagcctggaaaggtgaggctccctgacacagctaactcccccagtccctattatcccacggagccctggccactttctggctcagcccacagggcatggcctgcccagagcaattccatttccacccagctggtcccactggtcctcagatctaatgagaagcagggacggttgggctagattagtgattttcaagttgttctgtggaatttctgagaactccaagaagaggcctcaggatcccttaagttagggctgagtggatggcaaattggcctctttgctgtttcctttacctccagagtcgctccagttttattcattcattcatttactcattcatgctctcattcactcagcacctctggagccccttacacacagagtgt

SEQ ID NO: 15 - DNA, 1828 bp, Homo sapiens
tgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttc

SEQ ID NO: 16 - DNA, 11192 bp, Homo sapiens
tgaatgtttatcccatggctgtttagtttgaccaaaatcatccttctgtctaaatcacaatataaacacatttctaccaaccattttaaattattttttaacttgccatattttttctataaatatgcgagcttaagaaataccatgaaatcataggactagatttctttgttagacaatataaaacagatcttgaccttttcatggcaaaatttatatcatataattttacacctcttgtgcctgaataacaatacattattaaagagtttttaatgaatgaatggataaatgaataaatgtttcaacagaaggcctgagattattgaattaattttatcaacatgtatttatttaaagctatcatcttgcccttattactaaataatagtatggagtaaatacagacttacttaatggctaattggaaagaacttattgtatgtagatatatgttcatttgtttcgcattttattattttaaatacccataaattgaaattaggacttcgttttatttttatacagccttcataatgatgaatgaattttaaataatacatcatctatttatttacatatggattgcaaaaatatattaacgaacatatcttagttttttaagaaaaaaattcatgtggggtaaaggtaaattgatacattcacacaaacaggcaattgttgaatatttcacgtatattatgctattagctatgtactaaatatcaaaatgatttaaaaaatgatgtggggttttgtagaaggaatcaacatgtttggatttatttctcatgggaggttttagacagggctgagatgagaaatacagaaaaataacattattttaaggaaatgttttgatgttgctgagtttgaagtattgttgatcatttaagtaaagcatctattctaatgattagacactgtttagttttatatgtctgtttggttaggctgcattctccggttatttgatccaacactaatctaggtgtttctaggaaggtatttggttgaggtgattaaagtcctgattgtccagcacaagctaggtgggagtgattgaatcagttgaaatgccttaagagtaaaactaaagctttttctgaaaatgaagtacaactatggacatcagagtcaacttatgcccaagagttacagcctgtccttcctgatagcctgccctgcagatttcatacttgccaaataaaccccacaattgcataagccaattccttgtaatctcctgtatatccctggatgaactttgattgttaccgggactttagaatcaaaatccctgattgaaattcatacttcaccacacattagctaatttcaaacaaactaattaaactctcaagtcttggttcctcatttgttaaatattaatagtaacagtaacagtatctgtttcttgggttgttgtgaggattaattgagataatccatattgtattagtccgttctcaggctgctatagagaactgcctgagaatgggtaatttacaaagaaaagcgttttaattgactcacagttccacattgctggaaaggcctcaggaaactcacaatcatgatggaaggcaaaggagaagcatgcaccttctttataaggcagcaggatggagaaggagtgagtgcaagcaggggaaatgccagacacttataaaaccatcagatctcgtaagactcattcactatcatgagaacagcatgggggagccacacccatgatgcagttgcctctacctcgtccttcccttgacacgtggggattatggggatgacaattcaaggtgagatttgggtgaagacacagagccgagccatattacatatcaaagcttattgcataagtagtgtttagcacaaagtatgtacttaatgttagctgccattttcttaaaatattattacttagaagaagatctacaaaagaagacaaatgattgaaactcaggagagacatctagatatggctgaacttagggaccttcaacatatagagtggaagatgacccacagtttgtataggttcattcaactatcaattgaagaatgcataggtgttacccaagagtaaacaagattaatgagtaaatctattcactctacatggaagctaaattccattttataatctccactcataaatatttgttagtgtcttagttgaaaccgtagaaaatatgattaccacattgtatgtaatagaaaataatgtagtttgccttgtgtttaacacaacttaaaactgccagcatctgctttattcctcagtgctttgtttctggaaccacagatctctcttccctaccagtgtccctaataaactatttgtcttgaatacacatttcccagggtcagtttctgcagagacaaatactatgagatggcatttgaaatttggttaagagatcaaaggtatttgttgctcttacttttgggtgatttagaaaaaaaataaaaatactttaaaaaggtgaacatagcttctctactatttcatagataaacacaataatactgtcattcactatatataaccaaagtgtaagttaaaatatttgattctggtgttcttatatataatttaggggagtaggttgctatctgccatttatatctttggattgctcttctgtttggtaaactttcacaatcagtagtaagggtattcccactctcatctgagacagaaaggaaaattccacaaaaaagtactgaaagcaatctgagggttgaggaaatacagaaaagttactgagtcaaatatgatgatatgaagaaacaagcacttgttagtatgactgataaactatcaccttagaaattgagtagaaggtaattgtctccattattttccaagatagaaaccaaatttaaaaagtcaaatttaacaaattttgagttacaagtaaaaaaagctaaacaatcttgtgaaatattttcccaggaaaatgcattaggctttaacgactgcacactgtgtaatggaaagcattcaaatttacctaagaaaaacgttttgtaatgactttatttgttttttataaacctgtgaaatgatcatgtaaaaatttcaaagagatactcccgggtatgatgttgagaggcaattttagcacctattatagaacttcacaatgtaatataacctgttgtgccttactacttaatcacataatggcatttataaattgttcacactgctttgcaaaaatgtcttgccataacactgttacggcaacatgtatttttattgttatttttatgacatgagaaaacatatcaaagcactcaggaaacatcctatgtgagtagccataacagaatcaccaagcaaagcaagaactttgtgaacaaagagtatatgtaatcataagtattattttttcataaaacattgctattataaaatgtgcctatttttaagcttttcaaagactcagttacagaaacattattattgaagcaaggacagtgagactacttactgtcacattttgtatattttcaaacagggaaataaattgataataattttctatatctcagacaaatagcaattatttatcatattctgttattgaaatctataaaatattacaaaatatttatactaaattgcttatattttgatgttatgtataccttatatccctggtgactataaaatgaagttatagataaattcctaaaacgcttaagcaataaaatataagtttgttatatggtaatataaaatcttttatgattttatttataggaacagtgacatggatctggaggagcctatatatggaaaaaaatgtattgaattaattgccaaacatttgtgctttagttttaaaagcacattaccatggaaatcataattccaaagaaatttctttcattacagtttcaaaagaacccaactaaattgtaaaaagtgcctttcataaatctaatcttaagtagttatccttcatagacatatctgcgtattcaaagatggtgagagggttttctttttattattattattattattattattattatactttaagttttaggacacatgtgcacaatgtgcaggttagttacatatgtatatgggtgccatgctggtgtgctgcacccattaactcgtcatttagcattaggtatatctcctaatgctatccctcccgcctccccctaccccacaacagtccccagagtgtgatgttccccttcctgtgtccatgtgttctcattgttcaattcccacctatgagtgagaatatgcggtgtttggttgtttttgcaatagtttactgagaatgatgatttccaatttcatccatgtccctacaaaggacatgaactcatcatttttaatggctgcatagtattccatggtgtatatgtgccacattttcttaatccagtctatcattgttggacatttgggttggttccaagtctttgctattgtgaatagtgccacaataaacatacgtgtacatgtgtctttatagcagcatgatttatagtcctttgggtatatacccagtaatgggatggctgggtcaaatggtatttctagttctagatccctgaggaatcaccacactgacttccacattggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttttggctgcataaatgtcttcttttgagaagtgtctgttcatatcctttgcccactttttgatggggttgtttgtttttttcttgtaaatttgttggagttcattgtagattctggatattagccctttgtcagatgagtaggttgcgaaaattttctcccattttgtaggttgcctgtttactctgatggtagtttcttttgctgtgcagaagctctttagtttaattagatcccatttgtcaattttgtcttttgttgccattgcttttggcgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtctcagctttctacatatggctagccagttttcccagcaccgtttattaaatagggaatctgttgtccaatttcattggctaaacctcttagccttatataaaatagcaatagtgatgaaatgccagatagtactccagaaggccgaatcaggagaactaggtagaagagatgagaatgcatgttttcatttaatataaactagtaaaatttaagcactggaactctttaacaaactgttgttggaagtattcatgctaagtcaaatagagccagaaaaaaataaatgataaatccttaaagttggtttctaactgtgatgaactctatttagttaaaactgcagcttttcagttttttattgcttcatctgaaaatctgaaacagttataccttccagttctaacattctaaaatacctcccaatctcaaatatagtacagttccatgttaagaacataaaaatttagactgaagaagtttttatatgccttgcacagtagccattattttgagaaaaggctgatgggggactttggttccttcctggtagtcttgtgatatttctctttaatctcaacaatgacatgctgtcatgcgattttgacatagtgctgtaccattcccatatgatacactaactggacttaggaaaaaaatcatattgataaatataaactatggtctggttatattcataataaatcatttggagaagggtctgtatttggtacactttctaatattgccccaattgaatgtttgtccattaatagcaatccctgtttaaaagcattttgtttcagccttttagtaatattggaccattgtcttctaatgtccattgttgctaatttgaagaatactgctggtttttttccagtgtctctggggtgatttttaaaaatattttcctagaaaatttttagcctttatcttagttcattttgtgttactgtaagaaaataccacatacagggtaacttatgaagaaaagaaatttatttctcacacagttctggaggctgggaagttcaatatcaaggggctggcatctggtgagagcctttttgtggcatcatcccgtggcagaaggcaaaagggcaggtgaggaaggaaatgagagttacagaaagctaaactcactttattatctctttatgctaacaatgtatgagatgatatcagtgttttactgtggagtttctgattgcctttcttttttcttgttaggtgaataaaggcaagcctacttcccaatattctgagtgtttttttcaataactggaaactaatttgttgtcttattgaacatacagattttcattttaatttgaacagttggctttgtatgtactatgttctcttctacaactttttgtttcttctggagatgcctatgttttttcttttttaaaaaatattttccttctttataaaatgtataagttttctcagtctctcccttgtatttgccattccacagaaaagcctttatttcctagaaaacttttcttttggatttttcttactttcttttccaaagtaaaataagtgtaattttttgttccttttacatggctactgtcctgggactttcctttgacattcacctaggttgaatccattaattatctgattacaaatctaaatcaggggtttccccatataaattattaataaaggttaaataggaagtacactttcaagtacttgtgtgcctgaaaattatctttatcttaatgcttgatggaaagtttgcctgaatatgaaattttaggtttaaattatgctccttataaatttcaaagtaataaaggaacagagaaataaaattatgcagctacttttttgtggggaatttggcagttatgataatggtgcaagacacagatcaatcagttaatgaccatgtagagggcaagtacaaagattcagagaaagaagcagacatttgacagccccatagagctcaagagaccaaaatgataaacttcagggattaggattctgatgagaagactgtaacagagaaatgagtacatcaatctgttaattttattcccaaaacattggctaaattcttaaggattatgaatccttattattgattttctcagcagctccataatgccttcaaacaaatgcatttttatctggattgtctacttctattttgatctggatttttttaaaaacttgttttggcagcagcattgattttttgcaaactactctgtcatacttgaaagtggtaccattgagatcatagacttttttatattggttacagatctactagattctcatgttgtttacagagatttttttacattgattcttggtagttatccaaacatataataataactcataatcatgcctctctcttaacaactgtaatgcatctaatcctttctgttgtccaatttcattggctaagccttttagccttatataaaatagcaatagtgatgataatcattcttgtttttttttttctgacaatagcaggaaagcctctagtgtatccctattaagtaaggtgcaaatttataggggatgaggaatacatacatacacatatgtgtacatgatgatatcatgcttaggaaacacttatcaaattctaatttattgactacttacaacatgaatatgttttgagtcctataacataatccttttgcatcaatgaagttaatgacatgacttctctacatagattaattaagatggtgctatagattgaattgtgttccccttgaatttatatattgaagttctaacccctaatatctcaaaatatgacattatttggagatagggcttttacagaggtaatcattagagtgggccctaaaccaatatgactggtgtcattataaaatggggatgtttggtaacaggcacgcatgcaggaaaagtgccacaaaaatatgaagatatccatctataagccgaggagaaagatctgaaacagattctgtcctcacagccctcagaaggaaccaatcctactgacattttgattttaaactcatagacttcagacctgcgagacagtagatttccattgtttaagccactcaattagtagtactttgtcatggcagtttaccaaaccaatacagatggtaaggacattggcaaaaatggaggagtaaagacttctaacaattctcttcaccatagaagcaatgagaaaactaacaaaaattttcaaaattaacttttctaaaaaactttagatattaatagaggattatagcactctattcaagaatattggctgaatctcagtaacaacagtgaaatttgtggcttttaacctggactattcctatccctctgttagctcttaagtagccttgaaaataaacatcttgcaatcacagagaaaactagaagcctggtatccaatggagacagcagaaagggattggagtgccttcgagatctcattcccccaaaatataattatttgacctatcaggtagttccctgaaagactccatttgcagagctgtcttaagccccttttgcccttggggatcttgtcaaaaacaactggagccaattttttcactctgtgactgcctgaagtggcagataagagttggggcaaacaaaaagcaacacaaagagcttaaaatgaaaactgaggaatgagatttttatggaggctttgaaaatgttgacatactcctgggaatctagacagacacagaaaaatgtgagaaaaccctaagtctgtatctctggctgaacttgaggctttcttcatgcagaaagtgaaacctaaaaaagttttcaaccgtgtaacttaacacagtgttaaagatgtactccagaatgcactcagtgctctgcaacaaagactaggagatctatttttgtacataggcttttaaataaatctctgtataaggagtagattattaataagctaaccaagaagagatttcagtggccacataattaaagaacactgacttcacagatttaggttagaaaagtcataaagtaaacagtaacaataacaaagaaaacataaaccaaaaaccctgagggttgtagggaatccgatattcaataattaccaaaatatactattttaaatatctggttttcaacaaaaactataaaacatgtaaaaaaaaaaaaactataagtgtgtttcctacatggggaaaaactgaaaaactgctcctaaagagtctcagccattagaactactaggcaaagattttcaatctgcgactttaaatatatccatataatgaaagcaattcatatataaagaacgaaaggaaagtataagaataatatctcaccaaatagagaatgtcaataaaaacacagaactttttaaaagaagcaaacagaaatttggacattgaaaattacaataatgaaatggaaaaattcattagagggtttcaatggcaaattttagaaagctggagaacttaacaatatgtcagttgagattatccagcctaagaaacagaaagaagaaaatcaagaaatcaagaaaaaaatcaggaaagaatgaagaaaatcaagaagtctctgaaacctgtgggatattatcaagcataccaatatatggatattggtagttcagaaggacagaagataaagaagcagaaagaatatgcaaagaaataatggctgaaaacttcacaattttgataaaacaaaacaaaaaccactagtctacacatcccagaggctcaataaacccaagtactataatttgtagatatctatgccaaggtacattataataaaactctctaaagccaaagacacagatagtcttgaaagcagcaagatagaagtggcttatcacaaacaagggattctgaataatattatcagctgatttctcatcagaaagcatagaagacagaggaaatttttaaaaagacttttaattaaaaaatttaaatccagcaaaactatcctttaaaaatgaaggaggaaacaaagaattcattactactgaacttgtcatacaagaaacactaaagaaagctcttcagactgaaatgaaaggatgctggcaagtaactagaatttaaatgcagaaataaagggcactgaggaaggtaactaaataaatataaaaataaatatatatttttgtttttaattagtttgaaataaaaaatatattttgtgtaatactatgcaggcataaaaaagaatgagatcacgtcttttacaacgacatgggggattaggaataatggaggccattatcctcagcaagctaatgcaagaacagaaaaacaaatactgcgtgttctcacctataagtgagagttatatgatgagaacacatggacacatagaggggaacaacacacactggggcctgtcagagaatgggaggagggagagggtcaggaaaaaaaaaactaatggatactagacttaatgcttaggtgatcaaataatctgtacaacaaaccctcaagatacacatttacctatataacatgactgtacattttgtacatgtatccttgaacttaaaatgttaaatatatacatgtatatgtatatatataggttgtaatataaaaagttttcaattatttttatcctattcgaattaaaagacagttgcataaagcaatagttataaatctgtgtgaataggtacacaatgcattagaatgcaaattgtataatagcaccaagggtgggggatggaaagaatttatacagaaataattctgtataaaatttaatttggtattaatctgaactagattatgttaaattaagatattaattgcaatccgcaaggaaaccactaatttttttactctccacctatagtaaaagaagcaacaagggaattacaacagtattttagaaaatatctaaccatgataataaattttattaatcaattttttaacattgatgcatttctggagtaaat

SEQ ID NO: 17 - DNA, 5980 bp, Homo sapiens
tgaatgtttatcccatggctgtttagtttgaccaaaatcatccttctgtctaaatcacaatataaacacatttctaccaaccattttaaattattttttaacttgccatattttttctataaatatgcgagcttaagaaataccatgaaatcataggactagatttctttgttagacaatataaaacagatcttgaccttttcatggcaaaatttatatcatataattttacacctcttgtgcctgaataacaatacattattaaagagtttttaatgaatgaatggataaatgaataaatgtttcaacagaaggcctgagattattgaattaattttatcaacatgtatttatttaaagctatcatcttgcccttattactaaataatagtatggagtaaatacagacttacttaatggctaattggaaagaacttattgtatgtagatatatgttcatttgtttcgcattttattattttaaatacccataaattgaaattaggacttcgttttatttttatacagccttcataatgatgaatgaattttaaataatacatcatctatttatttacatatggattgcaaaaatatattaacgaacatatcttagttttttaagaaaaaaattcatgtggggtaaaggtaaattgatacattcacacaaacaggcaattgttgaatatttcacgtatattatgctattagctatgtactaaatatcaaaatgatttaaaaaatgatgtggggttttgtagaaggaatcaacatgtttggatttatttctcatgggaggttttagacagggctgagatgagaaatacagaaaaataacattattttaaggaaatgttttgatgttgctgagtttgaagtattgttgatcatttaagtaaagcatctattctaatgattagacactgtttagttttatatgtctgtttggttaggctgcattctccggttatttgatccaacactaatctaggtgtttctaggaaggtatttggttgaggtgattaaagtcctgattgtccagcacaagctaggtgggagtgattgaatcagttgaaatgccttaagagtaaaactaaagctttttctgaaaatgaagtacaactatggacatcagagtcaacttatgcccaagagttacagcctgtccttcctgatagcctgccctgcagatttcatacttgccaaataaaccccacaattgcataagccaattccttgtaatctcctgtatatccctggatgaactttgattgttaccgggactttagaatcaaaatccctgattgaaattcatacttcaccacacattagctaatttcaaacaaactaattaaactctcaagtcttggttcctcatttgttaaatattaatagtaacagtaacagtatctgtttcttgggttgttgtgaggattaattgagataatccatattgtattagtccgttctcaggctgctatagagaactgcctgagaatgggtaatttacaaagaaaagcgttttaattgactcacagttccacattgctggaaaggcctcaggaaactcacaatcatgatggaaggcaaaggagaagcatgcaccttctttataaggcagcaggatggagaaggagtgagtgcaagcaggggaaatgccagacacttataaaaccatcagatctcgtaagactcattcactatcatgagaacagcatgggggagccacacccatgatgcagttgcctctacctcgtccttcccttgacacgtggggattatggggatgacaattcaaggtgagatttgggtgaagacacagagccgagccatattacatatcaaagcttattgcataagtagtgtttagcacaaagtatgtacttaatgttagctgccattttcttaaaatattattacttagaagaagatctacaaaagaagacaaatgattgaaactcaggagagacatctagatatggctgaacttagggaccttcaacatatagagtggaagatgacccacagtttgtataggttcattcaactatcaattgaagaatgcataggtgttacccaagagtaaacaagattaatgagtaaatctattcactctacatggaagctaaattccattttataatctccactcataaatatttgttagtgtcttagttgaaaccgtagaaaatatgattaccacattgtatgtaatagaaaataatgtagtttgccttgtgtttaacacaacttaaaactgccagcatctgctttattcctcagtgctttgtttctggaaccacagatctctcttccctaccagtgtccctaataaactatttgtcttgaatacacatttcccagggtcagtttctgcagagacaaatactatgagatggcatttgaaatttggttaagagatcaaaggtatttgttgctcttacttttgggtgatttagaaaaaaaataaaaatactttaaaaaggtgaacatagcttctctactatttcatagataaacacaataatactgtcattcactatatataaccaaagtgtaagttaaaatatttgattctggtgttcttatatataatttaggggagtaggttgctatctgccatttatatctttggattgctcttctgtttggtaaactttcacaatcagtagtaagggtattcccactctcatctgagacagaaaggaaaattccacaaaaaagtactgaaagcaatctgagggttgaggaaatacagaaaagttactgagtcaaatatgatgatatgaagaaacaagcacttgttagtatgactgataaactatcaccttagaaattgagtagaaggtaattgtctccattattttccaagatagaaaccaaatttaaaaagtcaaatttaacaaattttgagttacaagtaaaaaaagctaaacaatcttgtgaaatattttcccaggaaaatgcattaggctttaacgactgcacactgtgtaatggaaagcattcaaatttacctaagaaaaacgttttgtaatgactttatttgttttttataaacctgtgaaatgatcatgtaaaaatttcaaagagatactcccgggtatgatgttgagaggcaattttagcacctattatagaacttcacaatgtaatataacctgttgtgccttactacttaatcacataatggcatttataaattgttcacactgctttgcaaaaatgtcttgccataacactgttacggcaacatgtatttttattgttatttttatgacatgagaaaacatatcaaagcactcaggaaacatcctatgtgagtagccataacagaatcaccaagcaaagcaagaactttgtgaacaaagagtatatgtaatcataagtattattttttcataaaacattgctattataaaatgtgcctatttttaagcttttcaaagactcagttacagaaacattattattgaagcaaggacagtgagactacttactgtcacattttgtatattttcaaacagggaaataaattgataataattttctatatctcagacaaatagcaattatttatcatattctgttattgaaatctataaaatattacaaaatatttatactaaattgcttatattttgatgttatgtataccttatatccctggtgactataaaatgaagttatagataaattcctaaaacgcttaagcaataaaatataagtttgttatatggtaatataaaatcttttatgattttatttataggaacagtgacatggatctggaggagcctatatatggaaaaaaatgtattgaattaattgccaaacatttgtgctttagttttaaaagcacattaccatggaaatcataattccaaagaaatttctttcattacagtttcaaaagaacccaactaaattgtaaaaagtgcctttcataaatctaatcttaagtagttatccttcatagacatatctgcgtattcaaagatggtgagagggttttctttttattattattattattattattattattatactttaagttttaggacacatgtgcacaatgtgcaggttagttacatatgtatatgggtgccatgctggtgtgctgcacccattaactcgtcatttagcattaggtatatctcctaatgctatccctcccgcctccccctaccccacaacagtccccagagtgtgatgttccccttcctgtgtccatgtgttctcattgttcaattcccacctatgagtgagaatatgcggtgtttggttgtttttgcaatagtttactgagaatgatgatttccaatttcatccatgtccctacaaaggacatgaactcatcatttttaatggctgcatagtattccatggtgtatatgtgccacattttcttaatccagtctatcattgttggacatttgggttggttccaagtctttgctattgtgaatagtgccacaataaacatacgtgtacatgtgtctttatagcagcatgatttatagtcctttgggtatatacccagtaatgggatggctgggtcaaatggtatttctagttctagatccctgaggaatcaccacactgacttccacattggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttttggctgcataaatgtcttcttttgagaagtgtctgttcatatcctttgcccactttttgatggggttgtttgtttttttcttgtaaatttgttggagttcattgtagattctggatattagccctttgtcagatgagtaggttgcgaaaattttctcccattttgtaggttgcctgtttactctgatggtagtttcttttgctgtgcagaagctctttagtttaattagatcccatttgtcaattttgtcttttgttgccattgcttttggcgttttagacatgaagtccttgcccatgcctgtgtcctgaatggtaatgcctaggttttcttctagggtttttatggttttaggtctaacatttaagtctttaatccatcttgaattaatttttgtataaggtgtaaggaagggatccagtctcagctttctacatatggctagccagttttcccagcaccgtttattaaatagggaatctgttgtccaatttcattggctaaacctcttagccttatataaaatagcaatagtgatgaaatgccagatagtactccagaaggccgaatcaggagaactaggtagaagagatgagaatgcatgttttcatttaatataaactagtaaaatttaagcactggaactctttaacaaactgttgttggaagtattcatgctaagtcaaatagagccagaaaaaaataaatgataaatccttaaagttggtttctaactgtgatgaactctatttagttaaaactgcagcttttcagttttttattgcttcatctgaaaatctgaaacagttataccttccagttctaacattctaaaatacctcccaatctcaaatatagtacagttccatgttaagaacataaaaatttagactgaagaagtttttatatgccttgcacagtagccattattttgagaaaaggctgatgggggactttggttccttcctggtagtcttgtgatatttctctttaatctcaacaatgacatgctgtcatgcgattttgacatagtgctgtaccattcccatatgatacactaactggacttaggaaaaaaatcatattgataaatataaactatggtctggttatattcataataaatcatttggagaagggtctgtatttggtacactttctaatattgcc

SEQ ID NO: 18 - DNA, 78604 bp, Homo sapiens
actacaaactgcaaaggagactttgctttcagaatcctgtaatcaatgcttctttattactattttactttttctttccttcttttttttttttttttttttttttaagacagggtctatttctgttgcccaggctggaatgcagtagtacgatctctgatcactgcaacctttgcctctctggctcaagtgatcctcccgcttcagtctctcaagtagctgggactgtagttgcacaccactaggcccagcatttttttttttttttttggtagaagctggtttttatcatgttgcccaagctgctctcaaactcctgggctcaagcggttggcccacctgggccacccaaagtgctgggattgcaagcatgagctaccatgcccggcctcctataatcaatgtttttttttttttttttttgagagggagtcttgctctgtcacccaggctggagtgcagtggtgctagctatgtcggctcactgcaacctctgccacccgggttcaagcgattctcctgcctcagcctcccgagtagctgggattacaggcgcctgccaccattgccggctaatttttttttgtattttagtagagacaggatttcaccatgttggtcaggctggtctcaaactcctgacctcatgatccacccaccttagcctcccaaagtgctgggattacaggtgtgagccactgcacatggccaatcaatgcttcttaatagtaagatttattttaaaatttggattggggttataagactttcagtagtcttggatattaccatctttatcctgaatgaaagtgtagcaagaggctgggcgcagtggctcatgcctataatcctagcactttgggaggctgaggccagaggatccttgagcccaggagactaacctgggcaacaaagcaagaccctgtctgtattaaaattacaaaagcgtggtaaggatcatttcctcattaaccttgaacatccaaacacaaaccatcaaaaagaatcaacttcagaaagacattattgctttattggttaaggtgattaaaagaagggggcccctcaggccacaaagataattaactgattgtcacaaaccatattgaaactcttttttaaaaagggtatagataacttttaatttacaattttaacaatcaaagtagccaagagtagagtttgcaataggactagaaagtattccagtggctcatatataagtgggctaattttatctatttttaggcctattaggcctgtcagtctggattttccattacttggaaatggggactggggaacagatgcttctggccactctgagccctggcttgatccttgggtctcatctctctctctctccccgtttgtgcttcacctctcagcggatacttggctcttatctcaggacctgacctcccactgagctccaagcctgcaaagcatgctgccacccagttatttcccccttaacatcctgccatcacttcaaatttaatacccctatgccaaaaaatcactgactcctaatttcacttttgttggtggcaccagttttattctcttggacacctaagctcaaaaacagtggaacttcttttgactcatcgctctccttccttccctagaagtgagctaccatttaaaagtgatgtgctcattctcagcaaactatcccaaggacaaaaaaataaacaccgcatgttcccactcataggtgggaattgaacaatgagaacacatggacacaggaagggggacatcacacaccggggcctgttgtggggtggggggaggggggagggatagcattagcagatatacctaatgtaaatgacgagttaatgggtgcagcacaccaacatggcacatgtatacatatgtaacaaacctgcacgttgtgcacatgtaccctagaacttaaaagtataatgatacaaaaaaagtgatgtgctatcatcagtcacccgagaaatgcaaattaaaaccacaaggagtgcccttatgcacccactaaaatcgagcagactgaaggtgctaactgttgcctgaggatatggagtctcacacattgctggggaaatataaaatggcctgggcattttggaaaccagttttggttaacagtaaattaaatgtacacttaccacatgactcaataattctactcttaggatttactcaaggaaaataaaaacatatgtccacacaaagactttttcacaaatgtgcatatcagctttattcataataggcataagatagaaacatccaaatgtccatcaatgggtggaagaataaagtgtggtttacccatgtaacagaatactagcaacaaagaggaactgctgttacctgcaagcaatggatgaatctcaaaattatgttaaaccagagaagccagacacaagagaatacatactatatgattcaatttctgtgaaattccatttctacaaaaagcaaaacttactcataggggcagaaagtagaccagtggttctctggggctgggtcagggagagagcagctgactgcacggggcatgagagggtgacggcaaagttctgcaccctgaatgtgatgatggttatgcccgtgtacacattcaccaaaaaccagcaacctgtacacttaaagtgggtgtgttttatatataacttatacttcagtaagtgtcagcacagataggctaagcctcttctgagatgtaacacaggtagacaggagtatcagtgctgactggccaactatctttaaaatattttattaagctataaataatacggagttgaaatagccaggacttacagtgtacttactacatgccaggtactattctaagagtttccacatattggttagacctcacaacaactctccaagatactaacgattaccccattttatagatgaagaaactgaggcatagaaagtttaagtaatttagaaaagccatatatacggtaaaaaaatttttggctccagggagcttcctctgaactactatgccacaatacttctcattaggacaattttgaaatagacacactccttcctccataatttcatctcctctacaaaaaatattttcacgtttgcatattttattcaggctttgccaacatgcatatgcattttaactactccataatcatagtttagacacagagcaagaggaagccattccaagcaacagacgagtctaattttgctctctgaaaaataagcatttttttaacttatgaacatttctcattcattcacattctttcataatgatctattttaatggctttgtttgaaataccatattatattgtattcatttcctttattattggaatagatcattagtagagataatgctgtaatgagcatcttcatggaatgcacagagcttattttttttccatgtggaatcttttatgtaggaatcattcccaggagcgcagctgctgccccatataagaaagggcctctggcctcgataaagcagcagctcttataccagtatgaatgagctactgtccaatttgctagtgcctgagactggtccagactccagcccattcatggtcttgagggccctaggaagaccacagcaattcccgcagctctcctttgggagtcagggggacctgttaccgaaatcagtccttgtgccaattaaaagtaccacaggctgccagaaatttccatctagttttctactatcactcaacattcttcctgtgactataactcctctcttacattccctgtcatcagccttgcccaggctttcctaatctcttccctagatgagtgtgttttccagttggccttttgtgatttgattcccctctcttccaatggatgatctgacacaagggctgtcaagcatgcttgttactgtagggcagtgcttactgttttcacagcatggaacccacagaaaatgttacaatatgagtaactcacagggataaagggttgagattgctccctactgaaggtgcccggcccagtgcttcgggccaccctaggccctacctaccttcctcaggggttaaagcagtggttctcagtgctagctgcacattaggattacctgggagctttcaaaattattttgcctgtgctgcacccaggagtaacaacatacagccaaggttaagaacctttttagctaaatggttatctgtttatcctcagttaccgccacagcttatccttctactacagtgcctcctgagtaatgggcacaccgtacagtattattattgattattattagtattagagacaggctctccctctatcatccaggctggagtgcagtggcaccatcatggctcactgcagcctcgacctcctgggctcaagcggtcctccctcagcctcctgagtagctgggatcacaggtgtgcaccaccacacctggctaattttttttttttaaataattagtgtagacaggatctcattgttgcctacgctactctccaactcttgggctcaagcgatcctcccgccttggcttcccgaagtgctgggattacagacgtgagccgcagcgcccggcagaatacagaagtaataaactaaggtcaaggccatgtactgaggtgttcaaggctctgaactgctggactcaatgtcacaagataaattttaacctcaccaaaccctctcagcttaagagtatctgctaagttctgagaaagcaaacggggcgtgtgaaaagatgggtgttcatgcctgtgtgtatgtggggtcggtgatgcagttaaggacagaacccaggggaggactccgggacgggggaggcggctgagattttaaggcgggccgggtgtgctgcagccagcactgccggagaatcgctgggaaacggctccagcaggagaatggagggtggacggccggccgcaaaggcggtggaggtgttggcccgccccttccctcctgataacaccgacgtgcgtgtggggtccacggaacgccccaccaagcctcgcctggcgcggggtcgaggggctcggcggaggcgcgtgttcaggtggaggcggtgggcccgggctgcggcccttcgctcgattttatttatttatttatttatttatttatttatttttgagacggagtctcgctgtgttccccaggctggagtgcagtggcgagatctcggctcattgcaacccctgcctcccgggttcaagcgattctcctgcctcagcctcccgagtagctgggaccacaggcgtccgccaccacgcccggctaatttttgcatttttagtagagaagggatttcactatattggccacgctggtctcgaactcctgacctcgtgatccgcccgcctcggcctcccaaagtgctgggattacgggcgtgagccaccgcgcccggccccttcgctcgctcttacccggtgaggtcccgtgcccgcgtacctcccgcatgacacttgggcgtgcggccgagccgggagcgcccctgccccgcgagccgcccccgagagacacggcggatcggaacccagccgggcgcgtagctccgggaaggggacgtggcgaggacccggcagccgcggggcctgtggggaaacatggtccccgcaagggaccctgggagctggaggcgtcctggcccggcgtccggagcccacggcccaggactaggatgccgggggtctcgggcgtcctccctaacctcagtcatagggcgctccgtatccagcccgccctgcttgcctctcgcttcccccaaatactgccccgacctgtcccctggccctcaccaagacagggagaaacgaccgagacactgaggactccgctaacagctgcctgagacccaacccctccactccctgaccaggatgagggagtccgcgccatgcgcatgcacacacgcgggcctctcctcctcccaccttttgcgcgtctcgcccgggcatcgaaggaagggaatgacggcgcgacggcgacccctaggggcgggaggaggcgctaggagcggggctgggaagcgccatggtgcaggttgaacggggacattgggtcaccgggatgggtggaattagggtagggcgagtgaggcactggcttctggcacagaatttaaggagacaccccaaaatttagtaatcaggatacacagactgagcgcagtggctcacgcctgtaatcccaacactttgggaggccaaggcgggaggactgcttgaggccaggagttagggatcagcctgggcaacaaagcgagacccccatctctacaaaaaaaaattaaaatttagccggacttggtggtgggcgcctgtggtcccagctactcaggatgcttaagtgggaggatcacttgagcccaggaggttgaaggtgcagtgagctatggtgacacctctgcactccagcctgggcaacagagcaagaccatgtctcttaaaaaaaaaaaaaaaaaaaaaaaaagctagacgcggtggctcacgcctgtaatcccagcactttgggagggcaagggtagtggatcagttgaggtcaggagttcgagaccagcctggccaacatggtgaaactaaaaatacaaaaattattctactaaaaatacaaaaattagccgggtatggtggtgcacacctgtaatcccagctacttaggagactgaggcaggagaatcgcttgaacccaggaggcagaggttgcagtgttgcagaggttgcagatcatgccactgcactccagcctgggtgaaagagtgaaaccctgtctcaaaacaacaacaacaacaacaacaacaacaacaacaacaacaaccaccaccacccaaagtatattatatgcacaccctactgagtttgattcctggttccaccagttaatagctgtgggagtttgggcagtttggtgaatctaatctctgtatctcaatttcttcatctgtaacatggcaataataacagcacctacttacctcataaggttgctgggaagattcaaggagataagccaagtgaagagcttagcacaatgtctggcacatggtgagtgttcagtgaatgttagtcagttggtggctatggcagccatctgctgagatagttcccagtgatcctactcctggtgttcacaccctttttagtcccttcccacaatgcaccagggttggtctatgtgacctgtggaatactataggagtttctttctttctctctttctctcattctctttctttctttcctctctctttctttctttttttgacagagtcttgctctatcacccaggctggagtgcagtggcacgatctcggctcactgcaacctctgcctcctgggttcaagtgattctcgtgcctcagcctcccaagtagctgggattacacacacggccaccacacctggctaaattttgtatttttaatagagatggggttttgccatgttggccaggctggtctcgaactcctgaccttaggtgatccacccacctcagcctcccaaagtgctgggattacatgcatgagccaccgtacctggcaagaattacttataattaggttataaaagtcatgacagtgaaaacctcccaacttattctgaggccagtattaccctactatcaaaatcagacaaagacatcacaagaaaactagagactaatatctcttatgaatatagacataaaaatcctcaagaaaataccggcaaataaaattcagaaatatataaaaaggataaccaggtgggatttatcccaggaatgtacggttagcttaacttatgaaaataaattaatacactacatcaatacaataaaggaaaacattattatttcaattggtgtaaaaacagcatttgacaaaattcagcacccttcatcataaaaatactcagcaaactaggaatagaaggaaactcaattaacgtgataaagggcatctatgaaaaaacccactgccaacatcatactcaatggtgagagaataaaagcttttcctctaagatcagaaacaagaaagggatgcccacttttgccacatctattcagccttgtactggaagctctcaccagttcttgcctggaagctcttgccatgaggcaaggaaaaataaaaagcaagcaaatcagaaaggaagaagtaaaactatctccatttatagatgaggtgattttatagaaaatcctaaagaatctatgaaaaaaactttgttagagctaataaacaaattctgcaaagctgtaacaacaaaatcaatacacagaagtcagttgtgtttctatactcttgatatattctatattctggtgtagtctattttctgctgctataaccatgccacagattgggtaatttataaagaaaggagatttatttggctcacagttctgcagtcttagaggtccaacagcatggcaccagcatcaagggtcatccatggcagaaggtgaaagtgctttgtattagtctgttttcacactgctgtaaggaactacctgagactgggtaatttatttaaaaaaaaaaaaaagaaagaaaaaaaaaaagaggccaggcgcagtggctcacgcctgtagtcccagcactttgggaggcaaggtgggcagatcacttgaggtacggagtttgagaccagcctggccaacggtaaaaccctgtctctacaaaaaatttagctggctatggtggcaggcacctgtaatcccagctattcaggaggctgaggcaggataattgtttgaacctgggaggcagaggttgcagtgagctgagacagcgccactgcactccagcttcggtgacagattgaaactcggtctcaaaaaaaaaaaaaaaaagtttaattgactcacatggctggggaggcctcaggaaacttacaataatggcagaaggtgaaggggaagcaaggcacatcttacatggcagcagaagagaaagggagagcaaagaggaagagccacacacttatcaaacaaccagatctcctgagaattcgatcacgagaatagcaagggggaagtccgcccccatgattcagtcacctcccaccaggccattcccccaacatgtggggattacaatttgagacaagatttgggtggggacacagagccaaaccatatcaggcatgcaatcttgtgagacgtgagacacagagagaaatagcactgaatttatccttgtatcaggagcctacccctgtgataactaactcattcccatgataatggcattaatccactcatgaggacagaactttcatgacttaatcacctcgtaaaggcctcatctcttaatattgttacaatggcaattaaatttcaacatgagttggaggggatgttcaaaccatagcactctcaataaaaaattatacaataggcagggcgaggtagttccctcctataatcccagcactttgggaagccaaggtgggcggattacctgaggcaaggagttcgagaccagcccagccaacatggcagaacactgtctctactaaaaatacaaaaattagctgggcatagtgacacacacctctaatcccagctactcgagaggctgaggcacaagaatcccttgaacctgggaggcagaggttgcagtgggttgcgattgtgtctctgcactccagcctcagtgacagagggagactctgtctcaaaaaaaaaaaaattaaaaattaaaaaaatatatgtatatatacaaggtagatattgaatatctgcatgcaaaagaatgaatttggatccctatatcacaatacatataaaagttaactcaaattgaatcatagaactaaaagttaggactcttagaatctttataactttgaattaagcaatgctttcttagatatgacaccaaaagcacaagcaacaaaagaaaaaaatacagaaactgaacaccatcaaaattgaaacctcttgcgcttcatatgacattattctttaatttttttctttttctttccaaatacccagacgtcagggagattcacaggacattattaagaaaaagagaagataaaaaagaaaaggagaagataacccacagagcaggtaaaaatctttgctaatcatatatctgggaagggatttgtacctagactgtataaagaactattgcaactcaatgataaaaaagacaaataatccaatttaaaaatggaattaggctgggcacggtggctcacgcctgtaatcccagcactttgggaggctgaggtgggcggatcacctgaggtcaggagtttgagaacagtctggacaacatggtgaaaccctgtctctactaaaagtacaaaaattagccaggcatggtggcatgtgcctgtaatcccagctactcgggaggctgagacaggagaatcacttgaacccgggaggcagaggtcacagtgagaagagatcacgccactgcactccagcctaggcgagagagcaagactcagtctcaaaaaacaaaaaaaggaaagaaagaaagaaatcagtcgagtgtggtggcctgcacctctagtcccagctactcggaaggctgagaatcacttgaaccatggaggtggaggctgcagtaagccgaaattgtgccactgcactcctgggcaacagaggagtccttgtctcaagaaaaagaaagaaaaagaaaaaaaattaaatgggcaaatgacttgaatagacagttcaaagaagttatataaatggccaataattacatgaaaagatcctcaacatcattagtcctcagaaaaatgcaaatcaaaactacaacgaggtgccacatcatacatattaggatggtgataataaaaaagacaggtaattacgccagtagtggcggctcatgcctgtaatcccatcactttgagaggctgaggtgggcgaatcacctgggctcaggagttcgagaccagcctggtgaacatggtgaaacctagtctgtactaaaaacacacaaaaaattagccaggcatggtggcgggtgcctgtagtcccagctactcaggaggctgaggcaggagaatcacttgaacctggcaggtgaaggctgaagtgagctgagatcacgccactgcactccagcctgggaaacagatggagactctatctcaaataataataacattattattatttttaaaaataatatttaaaaaacattaaaattttttttttaaataatatttttaaaaatgatattttttaaatgataatatttacaggcagtggctcacacttgtaatcccagcactttgggaggccgaggtgggcggatcacctgagctcaggagtttgagaccagcctggccaacttggtgaaaccctgtctctactaaaaatacaaacatttgctgggcgtggtgacaggcgcctataatcccagtcacttgggaggctgaggcaggagaatcacttgaacctgggaggcgtaggttgcagtgagctgagatcacgccactgcactccagcctggtgacagagtgagattccgactcaaaaaaaaaaaagctgaaaagacagttaattaacaagtttttgtgagaatgtggagagattggaaccctcacacatggctggttggaacgtaaaatcattcattaactttggaaaatggtctggcagttcctcagatgtttaaacatagagttatatgatccagcaatttcccttctagatatgtaaccaaaagaaataaaagcatattccacaaaaaccttgtacgtgagtattcatagcagcattattcataatagcccgagtggaaacaacccaaatgtctgtcaactgatgattgaagaaagtggcatatccatgtcttagtctgttttgtgctgcatcgtagaatgcctaaggctggataatttataaagaatagaaatatctttctttcagttctagaggttgggaagtcgaaggtcaagggccctgcatctggtgagggccttctttctgcctcatcccacagcagaaagcggaagggcaagacagtgcaagagagggggtgggtgggggcagaacccatccatttatctatcagctgtccactcccttgataactaacctactcatgcaataatgccattaatccattcatgagggaagagctcacataacctaatcacttcttaaagttcccacctctcaacagttgaattggaggttaagtttccaacacatgaactttaggggacaggttcaaaccacagcaatccataaagtgaaactgtattattcctaataaaaagaaatgagatactacagtgtggatgaaccttgataacattatgctatatgaaagaagccagacacgaatgaccacacattgtatgattccatttatatgacatgtccagaataggtcatctgtagagataagatgtagattagtggttgcctagggttggggtatagggggtgttatggactgaatgtttgtatcgcccccaaatttatacattgtttaacccccagtgtgactgtatttgaagacagggactggctgggcatggtgcctcacgcctgtaatccctgaactttgggaggtcaaggcaagcagatcacctgaggtcaggagttcaagaccagcctggccaacaaggtgaaacaccgtctctactaaaaattccaaaaaattagccaggtgtggtggcagatgtctgtaatctcagctacttgggaggctgaggcaggcgaatggcttgaacccaggagatggatgttgcagtgagccgagaccacgccattgcactgcagcctgggcaaaagcaacgaaactccctctcaaaaaaaaaaaaaaaaaaaaaagatagggcctgtgaggaggtgaccttaaataaggtaatcaagatgagggacttccaagaggagtgctggcaattaagagagctggggccaggtggggtggctcacacatgtaatccagcactttgagaggccaaggtgggaggatccctcgagcctaggagttcgagaccagcctgggcaacataacaagaccttgcctctatttataaattcaatttattattattttttttaaaaaagggagagaactgcgaggaaataaaaagagaaagggccaaggccaggtgcactggctcacacctgtaatcccagcactttgggaggccgaggcaggcggatcacgaggtcaggagatcgagaccatcctggctaacacggtgaaaccccgtctctactaaaaataccaacaaaacaaaacaaaacaaaacaaaacaaaaaaaaactagcctggtatggtggcatgcgcctgtggtcccagctactcaggagggtaaggcaggagaatcgcttgatcccaggaggtagaagttgcagtgagctgagatcgcgccactgctctccagcctaggcgacagagcgagattccatctcaaaaaaaaaaaaaaaaaaaaaaaagagagagagaaaaggccaaatatttcaattctaaggtttggaatttttttgttgttgttcttttttattttaaggggaaaatgttgaagcaatttaaaagtgtactgcaggagaataaatatagcgatattgttaccaaaaaaatccaaaaaccaaaaacccaaaacccaagaacaaaaccttcccaaggtgctgacaaagccccgaatctccaggctgcaaacattctcctggctgctcatttgtgaggatccagtgacctgtgtccactgctgggaagcgaaggcatctgctggtgtggtgcagccatgctgggggcatggcgaggcctgtggatgcagttctctgcgctctgccctgtgctctctctgacgtcttccacatccccacctcttcaccctctccggggctttcttctctacccatctagggactacagcccagaaaaatgctaccacaccacacattgcatttagttgtcacgactctctagtccccattattccagagcatcacctcaatcatttcttgattctgattaccttaaaactgttacacctgtagtcccagcactttgggagactgaggtgggaggattgcttgagcccaggagttcaggaccatcctgggcaacgtagcaagacccgtccctacaaaaaaaaaaaattaaaaattagctgggtgtggtggcatatgcctgtagtcccagctacttgggaggctgacacaggaggatcacctgagcccaggaagtcgaggctgcagtgggctgtggtcgcaccactgcaccccagcctgggtgagggagagaccctatctcaaaaaaccataaaaagctttttgttattgggatggcactgctccagggctttccagagctagggaatatatggacatttacacacatctgcgtgcacatacacatatacacacccatactaatttctatgtctatctaaacactttctgaaaatcctgagtctactcctatacctccagttccaattcgacaccacaagggtctccccacccacattttctccctttcccgagctgtgtctcggttttctctgacactgagaaacctggctgttatctttcaaatgtgtacttatttgaccaatagctggtggaagcagtttcttatctctctcgccatctccttcccgtggctgatgccttcctaatcctatcaggttctgccatgccaagccaggccaccttctcgtgtggacaccctcccccacctgctggagctctgatacatgctctggcctgctgcgtctcactccccacacccggcagaggcctctttggctctgcctgcccctagaggctgtaagacagcattgttcaggaaagggaggaaagggaatgggtgtaggaaaggaagagcggatctcctttgaagaattatctttaaaaaaaattatttttttagagacagggtctcactctgttgcccaggctggggtgcagtggcacaatcctagctcactgcagtctcaaattcctgggctcaagcggtcctcctgcctcagcctcctgaatagctgggactacagtgaacatcaccacacctggctggttttttaattttttctagagatggggtttgctatgttgcccaggctagtctcgaactcctgggctcaaagcatcctctcacctcagcctctcaaagtgctgggattataggtgtgagccaccgcctttttttttttttctgatttactataatatttctagtaagccattggcttagaaaccagattcactaattaattcatttaccctttcatgatacaaaattttttaactgagtgaggcctttcctgagaattgagcacatgagctttggtgcatggacctggaaatctctgcttcttgaactcctaggggcttcctttacttcattcactcctggtgctcagcaaatttctgaatgggggaggttggccagcctgggagaggtcacccacgccaggaagtctcagtacctctctatttatcctatcacttgggaatcctctaggatctgtttcagggagtctctggttagccctgagacataagtggtgcgggtgagactcctggggcctatctcagaggtcctcacacccctgagattaaatcagtcaggaggcagggtggagagaggagtgtcctatcaggtctgaggaggttgtcaacttcctggacttcttgctaaggactcctcttcccacccttcatgggtagctgaggtcagggaatctgtagggacaagactttcttttaaatgctaatctgctgactaaccctgagtctgggaatgcctccaaaatgtcaagctgatgtgtttttttattttttggttttgttttttttgttttttttttgaaacggagtctcactctttcatccaaactggggtgcagtggcacgatcttggctcactgaaacctccacctcctgggttcaagcaattttcctgcctcaacctcccaagtagctgggattacaggcacgtgccaccatgcctggctaatttttatatttttggtagagacagggtttcaccacgttgggcagcctggtctcgaactcctgacctcaggtgatctgcccacctcggcctcccaaagcgctgggaatacaggcgtgagccaccgtaccaagacatcccacagcaccagcctgtgtgtgtctcgccaggctcagagctgggaacctggaacccaggactgggtgagctcagagacataactgtgactgtactggagtcagtcttatgcccagagctaagcagaagcagggccagcccagaggagacgatgttaccgactcccaccccgtcctgtctagcgcttagagtacctctgtactggcttgcttcctacagttgctctgggaggaatgtgtgccagagaccctgacctctgacccaggcatgcaagggtctgccttgcctagttgagcctgtgcactctgtctctgcctcccttcagatagggaaaggagcttcaaattacggggtgatgtcatagcacggagtggagatggggtggcagggagacagggaggctcagggaaggaggccaggtatttcacagaggagttctgggggagaagaaggaaaacggcagagaagggaacaggaaggggtgaaggaaaggggaaaagtgccttcactgcatggaaaggtccttctcacccacagtggggtgggatggagactgtaacctcaagtacttttctgcaggggacaggcaagtaacacatatgaaacgtgctgagtcagggatgcaagagggagtgtccctgttcctatgtccaggacagccactactcaacgaactgctgccataaaaatccaatgttgcagcatcttctgatataaataataaagcaggccgggtgtggtgactgacgcctgtaatcctaccactttcggaagccgaggtgggtgggggagggaagggccggggcaggggatcttttctttttttttttgaaacggagtcttgctctgtcacccaggctggattgcagtgacaggatctccgcccactgcaagctctgcctcctgggttcatgccattctcttgcctcagcctcttgagtagctggaactataggcgcctgccaccatttccagctaattttttgtatttttagtagagacaggatttcaccttgttagccaggaaggtctcgatctcctgacctcgtgatccgcccacctaggcctcccaaagtgctgggattacaggcgtgagccaccgtgcccggccaggaggggatcatttgagcctaggagttcaagaccagtctgcaacctggcaagatcctgtctcaattaaaaaaaaaaaaaaacaaaaaaaacaacaacaaaccaagccccagaaatcgactgtgatgtgaaatctccttatttaaatgttggctctttaaaaaaataaaaagaccaggttaggtggctcacatctgtaatcccagcattttgggaggctgagaccagaggaacacttgaactcaggagttcaagaccagcctgggcaacacagtgagaccccgtctctacaaaacattttttaaaaatcaaaaaattagccaggtgtggtggtgtatgcctgtagtcccagctccttgggaggttaaggtgggaggatcacttgagcccaggaggttgaggctacagtgagccacaattgcaccactgcactccagcctggatgacagagtgagattctgtctcaaaaataaataaataaataaataaataaataaatgggcatggtagctcacacctgtaattccagcattttgggaggctgaggcagggggattgcttgagcctggaagtttcagagaccagcctgggcaacaaaatggaactcaaaaagtaaaaatcttggcttgtttgaaaacacacacacacacacacacacacacacacacacacacacacagccaaaacaaatgtgtttcccatctcgggcttgggcactgggtcacaagcttggacagtgaagctacttctaaacccagcacagggtacagtggatgcaggacatgggataaactcctgttagattaagcccgtccctctgcttctgaggtctggcctgcctcgctgttctggtcagaacctgttttatgcaattggagaggagaggggtcccaggagtattagccctaatgtgagaaattagattacaggtctctgaaagggattctgcaaaccaatcctccttccaagcctactctacccatacctaatattcttaagcagttatgaattttgcagaggtctacaacacttgacactcactcaaggcaactgtgaggaaactgaggcttaaaggccactagtaagcagtgtaaaaaggacctgatcatgacaattattctttgagtgcctaccatgcatgtgctgggctcaggcccttcactcaaaccctggctcgtactctctgaagggtcctgggtgaggaagatgtcaagaaccccatacctcatcactgactccctgccgggggcatgtgctgctcccagcctgagatgagtgctgttcattacacgtcatctccatgaagcctcccgcatttgctccaggaaaggcccgttcgccaccctggcgtcattcactctgtgttgctgatattgagtctgtttccttcaaggggaaacaggctacccaaggactggggctgctgccttcatttctgtaacctccggggggagctcttgtgtgagccgcatgatggatgcttgctaacagctctaggcaggaggcagagggaaactgaggtctgccgagtcatccctggcccaggtacttcatgcgtgtgcagtgttgctgtggaatctttaccacaacctcccatccctgttttacagatgaagaaacaggctcagaagaggcagacgtgtctaagatcacacaagccttgacaccatgagctagaagctgagggtgaggtcacttcacatcccttccctttaggttctactctatgtgggtagcgtcctcgacacagaaagcctgataaaagatggcaaaattaccgggcgtggtggctcatgcctgtaatcctagcactttggggggctgaggcggatggatcacttgaggtcaggagttcgagaccagcctgaccaactagaggctggtctttagtagagggttggtgaaaccctctactaaaaatacaaacactggctggcatcgtggcgcaagcctgtggtcccagctactcgggaggctgaggcaggagaatcactttaacccaggaggcggaggttgcagtgagctgagatcgtgccactgcactccagcctgggcaacagagtgagactccgtctcaaaaaaaaaaaaaaaaaaaaaaaaaaaagatggtaaaatttgggggcagcagaccagatgcctggactgatggtaggactgtcccacaaggggtggacattaggtccttgaaacagacaactccctcccccagcagggaagggaagggcctcagagcttggtgtctactctgagcacaggcaggtgctttgggaagcctacccctggctctcacatacacaaagttatgccagtagaaatatatgtttgggcaatgcccaggcaaaagggccatgttcagtccccaatgtccaggcacaaaggactcttcgccactcttccctctcttgacagactggcagaaaaggagcctggggaacttggaagggaaggggataaggcaggggaaggggcagatgacaaaccctgggcctcttgcccctgcccagaaatgcaacaaagcaacccctgaactcaacatacaggtctgttctggggcccccaccaccctagcatcatccataatgatagttctcacgtgctgagaggacttttgaagggctcacacacccagggctcacacaatggtcccaagttcaaattctctggcccatctgccagaacacaggatccctcatggttccctctggaggttaggaatgccccgcctgcgcgctgccatggaactcctcacaggggcttgcctgatttctggtcccattcctctgggaagaggtagctgttgttctaggtgtgattaaccccatcactccctaggcctgtgaagggactgtgtcagctactgccagatctgcaggcagctgggtccacgctggatagctcccgccattccaaaactctcccttcagctggtcgacgttctgtctttgtaacttcaaagaacaaacctaagccctctcagctgactgggctctttgaaggcagtgatcacagatctagtgttctgattcttccagactggggctcctttgttaaaaacaatttttaaatttgttatttttttgagacactctctgtcgcccaggctggagtgcagtggcacgatcttcgctcactgcagcctccgcctcccggggttcaagtgagtctcctgcctcagcctcccgagtagctgggattacaggcgagagccaacacgcctagcattttttttttagtagagacagggtttcaatatgttggccaggctggtctcgaactcctggcctccagtgatccgctaaccttggcctcccaaagtgctgggattacaggcatgagccaccatgcccagcccagactggggttccttgacttagcaaagggttgggcaaaaagatgtggagaccccctcgccccaaccgaatcccatcattagctctaaaatcaacagccctaagggagcagaagggggtctgcttagagatcctggttccttccatttccttgaagtccgaaccaaagtcagagctgaagtttcagctaaaattgaagccagggctatttgcagaggctgccgccctagtgcgtccgctggtgctggcccaggttggagctttgcgctagggccctgccacactgcaggcagacgcaggggtgctgctgtgggccgcctagtggatgggcaggtgggagctgtggccgaaggtctggccacactcaccaccaagcatcaggtttccggactttgtgactgtgctggtgccgcagcagattccaactgtgcacaaaactcttactacaaacaaggcacttagaggccttctcacccatgtggagcgcaggtgctgcaacagggtggagccaaggctgagactcttgccgcagtcccctcagcggtaaggcttttagcggtgtgagcgcgctggtgctggatcaggttggagctgacgctgaaagtcttaccacactaggcacaggcatagggccgaagcgatggtcacactcggggcaggagtacggcttttcaccggtgtgtacccagtggtgcttaaccagatcagagccacatcggaagcttctgccataacccggacaacggtaaggcttgtcaccagaggggctgccttggtggtgaatgaagccggggaggcaggctgtggtcagtccacatttccggcactcgcaggttttggggcttgtagacggttgctcttggcaaaggcttcttcctccccagggctagagcctgaccattttccgggcgggcagctgccccgaccacaccaggaagggctgctcaggcggagccacctcgcaatccaggggtgacctgggggctccccgggacgcgaatgtcccgctcccccgccgccccgccccgtccggattctccctcgcctcttctggcgcggccgactgcgctgcgagtgaagaactccccgtttcctagatgccagctcctgagctcacgagcacgtccagagcggaggacactcgggacaccggggtccagctccggaaacggaaaattccacaagcccgtcactctaggaagcggcagcgaacgttctcggtaggtttaaccctcttcttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccctggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttgggtaagtgctccgcccccgtttcctagaaagattaggtttgcaactcccttgctctctagacccgggcagtctggagttctttgtgtcctatcccggaataacgtgctttgtgatggcgcatcgctcctgtttctcaatctgttgtgccccgtgacgtcactgcactctctatagatgagagagagccctcccagaccagataattgtagccattatctaggaattggttgttgaggacttctttcgaagctggactagcggaggccaaagagttatttggtgattttttcagatgattcttaccgtccagttatgatgttcatagcagacattcagtgcccaactatgtgtccggccctgtgcaaggttctgaagccccactgatgagctggaaggtgtagtggttcagaaagggagatctgcaaaagtcacctaacccctccgaggctaggattccttgtaaaatggggcaataatagctacctaaaaaaatcagagtggggagaaaacgaagtacaaatatggcacgaatatgcaaatattctaagcatgatacgtatttcaagttattaaaaactagcataagctgggtgcagtggtacgcgcctgtagttccagctatttgggaggctgaggcgggaggatcccttgagcctaggaggttgaggctgcagtgaacaatgactgcctgtgaatagccactgcattccagcctgggcaacgtaacaagacctcgtatcttagaaaaccaaacaaatcagtagtcgcttaggaagcaggaaaaaataaataaaaataattaaaaccagcacagtaagaacaaatcctagcaaaacataagcttttctgtttaccagctaaattggtgcctcctagtggcaatgtgtgaaagcagtttacatgtcactacctgccttccacgaaattatgctagttttgatgacatcttaacttttcggataaagggaagcattaatatatttaaaatttacataaaatgtatctggaccatatatgtttgacaagagctttggttattaaataacccccatcattcagctactatttttcatcttaaatatcttctgaatttatctgcttctctctcttcctacttccattgtgtgcccagagactggtatctctgtgctgtgtgatgccagtagctgggttggttcaagctattgtcttttcatgcttggactattatgacagccttttgactccccccttcctattctttccccataatgcattctccctatggatgtcagattgtatcgtgtcactccccttcataaaacccttgtgtggcccccagtgccttcacattcaagtcctgaccccttggcctgacatttgaagcctttcacagacactgtatcttacctctgggcctttggaaaggctgcttccaaacctgaaatgccttctcacacccccatccaccgtgcttctggcaaataccttcctgtgtacccctccagacccagcccgagtgttagcctctttctttttatttttttgagatggagtcttgctctgtcatccaggctggagtgcagtgacacgatctcagcttactgcaacctctgcctcctgggttcaagcaattctcctgccacagcctcccgggtagctgggattacaggcgtgtaccaccatgcccagataatttttgtatttttagtagagatggggtttggccccgttggccaggctggtcttgaactcctgacctcaagtgacccacccaccttggtcccccaaagtgctaggattacaggcttgagccacggtgccctgccgaccattagcctcttctgaaagccttccaggccctctcaggccacattctccaggttattgatgtgagagacagtaaggggtagaaccctcacaagcccaaactgtcgttgcagtgaccattcttcagtgcatgaagacagacagcatccagaaccgaacggcccgtgccctggggaacttagccatggaacctgagagctgtggggacatccactgtgctggtaagaggctgtgaggttggggtctgctagggcttggggcagaagaaaggcttgagtgtctgtccttgttcaccctctgtgctcccctttcctgccctcaggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtgagtccctgcctcagggcttgggagggtgagcagtgcagtgatgtggggtttgtgtctgtcttggtcctcttcactacctccacccctattctgtctgaataagacttttataacccagactcctgattcccacacgaccacctgccagttcctatttaacacactccactcccctgagtctacctttttttttttcgagacagagtctcactctgtcacctaggctggaatgcagtggtgccatctccactcactgcaacctctacctccttggttcaagcagttctcctgcctcagcctcccgagtagctgggattacaggtgccggccaccactcccagctaatttttgtatttttaatagagacaaggtttcaccatgttggccagcctggtctcgaactcctgacctcaggtgatccacccgcctcagcctcctaaagtcctgggattacaggcatgagccactgcactggctggatctaccttttaaccttggttccacgccagcacctttgaactttgggccccagacaagttcactgggaggtgggatatacgctggttaagatggtgggctctggagtccaagttcttactctcttaccatcactcatgagctgaagcatcacaggaaagctgaggaactctttatttttttttaaacattagcgttggggatctcgctttgttgcccaggctggtcttgaactcttggcttccagtgaccctcctggctcagcctcccaaagtgtagggattacagatgtgagccaccatgcccagcccccagcgcttcctatttcctttttattttctccatgacccctgtactctacactagccccacactaacataactcatggtactcttacttcttgtctgcttcttctcactggaacataaactccagggggacaggcactttgttcagtgcttctacccagcacctaaagaacggcttggcacgtgacaggcatcagtaattactgaatgaggttttagtcgtatccccctctcacttccgtttctcccctttctccgccctccttctctcccctggctttacctccctccaagacagcttttagctcatgcagtggctcacgcctgtaatcctagcaccttgggaggccaaggcaggaggatcgcttgagcacaggagtccgagaccagcctgggcaacatagcgagacccatctctacaaaacatttaaaaaattagctgagtgtggtgcacacagctgtagtgccagctacttgggaggctgaggtgggaggatcacttgagctcaggagttcaaggctgcagtgagctaggatcccacaactgcattccagcctgggctatagagggataccacatttctttaaaaaaaaaaaaaaaaaaaaaaaagacgcctcacgcctcttggactctgccccttaaccttggctctgggttcagtctccttccctttctgccctccgcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggtgagttcccatacccacccgtctccttgcccccatgtgagtccccatcctcccccatggcttccatgggcccagaacctcaccttcccactcacctgtcctccccagcccgtcctccagacaacctgtcaccagagtggggtggggagcagggcgttccagtccctccatgggcccacaggcagagttctgctgtgtcctctgccctagccctgggacccagataccctaactctagatgcagccccgcgcccaggatctgggctggtctgtgcttctttcctggctctgccattggttcagcactgtcctgactgctccccaccagcacgctgacctgtgaaccccagcctcaccatcacccccagcactgccagggactgccctgtctgctgtgccctgaccacaggctgcttcatggcgttactgctagaccaaggagcccttctgctggccctgtccgggcataacagaaggctcgcactcttgtcttctggtcacacctcactatgtcccctcagctcctatctctgtatggcctggtttttcccaggttatgattatagagcgaggattattacaatattgggataaagagtaattactacaaactaatgattaatgatattcatatatctctaagatctatatctggtataactattcttgttttatattgtattatactggaacagctcgtgtcctccgtctcttgcctcggcgcctgggtggcttgccgcccacacttcaggggcccagacttacaccctgactgtcccaccttctgtccttgtcctggacctcaggttcccagcgtcccgagcccagcactgtctcttcagtgccctgatttctcacccagaggtttcaccctccttcatctcacgggcccagagccctgtctcactcaccccacctgtcttagaccccagttcccagcctgacaagctttccactcacaggggagaggctactgcagaacctgacggttcaggctgagtcgccctttggggttggggccctgacgcacctgctgctctctgggagccctgaggaccgagtggcctgcgcgctgaccctgcccttcatctgccggtgagtgggaagtgggtgccttgcggggttgggggaggagtgctgtgtttcccaggcccgttgcccaccttttgaaaggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggatacctgtgttgtgtggtgtgtctgcttctgtttcttcgcccaccaagcagggtcttgttcaggtctttgtgtctggacacagaccacccttgcatgtgacagtttaataagtactgggacaaggttgagttcccaggctgctgcttaggatgtggttttgggcctcaggggaagcctgcttcctgctgtcagggcctcactcctctgacatagcaacccaactggacacacagatcttgcttggggctgaaagggttgtgctgagggaatgctgttagtctgatgatgtgttgaaggcctttgcattactgactgttgcccatcttgggcccccattctttggctcccttttcatctcctgggccacgtgtcctactgctgtctgtctgagggaagacctgctgtggagggaatctctgagccctgtcttagtcatgcccagagacagacaaagacctgtgctggcgttgaggggagggaagggctcacattgctttggtctccaaggcagggtctccatcatctggcttccagatctttttttttttttttttttttgactattattttgctttagattcagggggcacgtgcatgtttgttacacgggtgtattgtgtactggggaggattgggtttctagtgaacccattacccaaagagtgaacactatacccactaggcaattttccagcctttgccccgcacctacccgccccccttttggagtccccagtgtctgtttctatcttcatgcccctgtgtacccattgcttagttcccacttataacggagaacatgcagtatttggttttctgtgtctgagttagtttacttaggataatggcctccagctccattcatgttcctgcaaaggacgttatttcattttttaaggctgtgtactattccatggtgtatatgtaccacattttccttttttttttttaagagacagggtcttgctatgttgcccaggctggtctcaaaatcctaagttcaagcagttctcctgcctcagactcctaaaatgctgggatttataggcacgagccactgtgccagccaacattttctttattcagtcacccattgatggatacttaggttgggtccatgactttgctattgtgaatagtactgcaataaacacaatgagtccagctgtcttttacatgatttcttttcctgtgggtagatgctcgttagtgggatttctgagtcaaatgatagttctagttgtaggtctttgagaaatctctatgctgttttccagagaggttgagctaatttacattcccaccaacagtgtataagtattcctctttctccacattcatgccaacatctgttgctcttttactgtttaataattggcttgcagatttttgactcctcagtggcagcctgattttggggagagctgcactgggcctgccaaggtttgcttctgggcagctgaggttggcacttgctgtctctgagcctctgtgagtgttggtccaggtctctggttttcaggctatgcattagaaccaagcagtgagctttgaaaaactattgatgcctggggtctttttgctcacattggactgggcatcggtattttattttattttattttattttttggaatcttgttctgtcacccaggctggagtgtggtggtacaatattgactcattgcagcctccgcctctctggttcaagcaattctcatgcctcagcctcccaagtagctgggattacaggtgccaccatgcccggctaactttttttgtatttttagtagaaatggggtttcaccatgttggccagcctggtctcgaactcctgacctcaggtgatctgtctgccttggcctcccaaagtgctgggattacaggcgtgagccaccgcgcccagtcaggccctatcttcaaatatagtcacactgagggttgaactgtgatgtataaatgtgggggagacacaaacattcagtccataacactccctttcccccaaccctaggcaatcactaatctacatcgtatctctacagatgacctattctggacatgtcatataaatggaatcatacaatgtgtgatctttcatatctggcctctttcatatagcttaatgttatcaaggttcatccacactgtagcatctcatttctttttattaggaataatacagtttcactttatggattgctgtggtttgaacatgtaccccagagttcatgtgttggaaacttaacccccaattcaactgttgagaggtgggaactttaagaagtgattaggttatgtgggctcttccctcatgaatggattaatggcattattgcatgagtaggttagttatcaagggagtggacagctgatagataaatggatgggttctgcccccaccccaccccctctcttgcactgtcttgcccttctgctttctgctgtgggatgaggcagaaagaaggccctcaccagatgcagggcccttgaccttcgacttcccaacctctagaactgaaagaaagatatttctattctttataaattatccagccttaggcattctacgatgcagcacaaaacagactaagacatggatatgccactttcatttcttcaatcatcagttgacggacatttgggttgtttccactcgggctattatgaataatgctgctatgaatactcatgtacaagtttttttgtggaatatgcttttatttctcttggttacatatctagaagggaaattgctggatcatataactctatgtttaaacatgtgaggaactgccagaccattttccaaagttagtgaacgattttacattccaaccagccatgtgtgagggttccaatctctccatatcctcacaaaaacttgctaattacctctttcttttcagctttttttttttttttttttgagtcggaatctcactctgtcaccaggctggagtgcagtggcacaatctctgctcactgcaacctctgcctcccgagttcaagtgattctcctgcctcagcctcccgagtagctgggattacaggtgcctgccaccacacccagctaatttttgtatttttagtagagacggggttttgccaagttaaccaggctggtctccaactccagacctcaggtgatccgcccgcctcggcctcccagagtgttgggattacaggcgtgaaccactgagcctggcctttaaaatattatcattattatttgagatggagtctcgctctgttgctcaggctggagtgcagtggcacgatctcagctcactgcagcctccacctgccaggttcaagggattcttccgcctcagcctcccaagtagctgggactacaggtgcccaccaccatgtctggctaatttttttgtgtgtttttagtagagactgttttcaccatgttagccaggctggtctcgaactcctgacctcaggggatccacccacctcggccttccaaagtgttaggattacaggtgtgagccactgctccttgcctaattacctgtcttttttgttattgccatcctaataggtatgatgtggcatctcattgtagttttgatttgcatttctctggggactaatgatgttgaggatcttttcatgtaatcattggctatttatataacttctttgaactgtctattcaggtcgtttgcccattttttcttctttttcttttttattcttgacacagggtctcctctgttgctcaggagttcagtggcacaatctcagctcactgcagcctctgcctccaggtttcaagcaattctcctgtctcagcctcccaagtagctggaattacaggctcccaccaccacgcacagctaattttgtgtttttagtagagatggggttttgtcatgttggccaggctggtctcgaactcctgacctcaagtgacctgcccgccttgacctcccaaagtgctaggattataggtgtgagccaccatgcctgtctcgcatttttaaaaagctccccaggttgttccgatttgctgctgggttgatactcacattccagtgctcagatctgtccagaagagtggctgcagcacagttgtctgtccataactacctctatggcctctcgtttccacctcgtttctcagggtctcagtccagggaaggccttgccactttgtggctggagactgtgtcttgctttctgctctgagttcatcagtaacttgggaaagggctgtttcagagcaggcctgggccacctcagtgctgaggaagggctttgtcttgcaggctggctgggggttggttgcctgggagtgttttccccgaatttgcaaggggcttgcgcccgggttcgagtttacgtgtgtccatgaccaagtcttggagggaaggtcctagtgtagagtctgtgggtgggttcactgtgtctgtccccgtccctcagatttctttgtgtctggtatgtatgcctcttggggcctctatttatctgtcagggtctccgatgggagggtctccgaacctgaggtctaattgagccttagaatatcactcctgctaccaatccaaaaattccgtctgggacaagtctcccaggaatggcatgggtgggagggaggctcttgtctaggactcaggcgctagctttgagcggtgtctgtttgggggcctcagtccgtgtctgtaagtctccctagggagcggctctggggcttggtctggagaagccacttctctctggctctggcctcctggggctccctgcagctgaggccaaggctggggtgtggccgcctccgcggcaggccggcgggctgggctcgggtgggccggggcgctccctcctttccacgcccccacctcgggttcccccgttcatcgcccccccatccccatctcagcgggtcccggcttccttacatggtcacggccgggcttccagctcccggacgtcccccgccccccgcccccaccggacacggcccccgccctgttcgccccgcgccaccggcccgcgccccgccatggaggacctgggtgagtggggccggatccccgggtccgtggcccctcaccgctgcccagagctgcctccccgccgtcgctctcccgcatctccccatccctgtcttcttacttctgcttttcgcctctgcccgcgcctcctttccaactccacgtcccccttcctgcctctcccttcctgcctttcctgggccggccgctccctcccttcttccctcgctgtgctcctccatcccaggctgcggcagatggaacgggaggtgcggcgcccgcgggcgcccgggcgcggggctctggggagggaggggttaaaggggcctcggcccggggaccgggaaagtagagggcacgggaaagtctggcatcaagttttggagaaaaaaagcgggcctgcctgcaccagagttttgggagaggaggagttaagggctcctgagcacagtgagggtcaggtccttgaggcaaggaagagaatagtaactcaggagtgcctaggcgcccgcgaaggcttcagggtttcacgcgggtgctcagagacgaagactgagggcaggacttctgggttctggaagtgaaagggctcaaaagacccggatctggggatgcagggatggagagaggtgtcttgtccggaagggggacccaggtatctcgtcctccctgcgaagcctggggctggaaggctgtgcgctccacgggagagaggggcttccggcccctggcggtagagggcgctgctcggtaggggtaactgacgctgtaccgcagataaacagccaatcagaaggcaggtcccagcgaagcgccagtgaggagcccagggcgggactcaggggcctgggagtggccaggctgggcggggcctgtgtaggtagagggaggagttaaccagcatggaagagagagcgtccaatcagaaagctgagggccaggcactgggccaatggagcaatttggaggggagccaaatttggcttgggtgaagagcccattttgactgcatcagagaagatggggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctccctggtgctgtctctgaatgcgcgcaggagcttggccctgactccccacccccgcgctggctctgtccccggccgtctctaggtcactgccctgtggccgcagcgggacctgcagcctcagcccttgcaggtagccactcctgcacttcctacttcaagtatcagatgagcctgaggctggaaagtgtggcgactcgcgcaggactgtacagatagtggcagagccaggacaagagctccaactggggccccaccgaatattcccgccctcattactctttcttcagttctatattttgttttgttttgttttgtcctaagagatgaggtctcactttgtcgcccaggctggagtacagtggtgccatagctcactgcaacctcgaactcctggtcttgagcgatcctcccgccttggcctcccaaagtactgggattgcaggtgtgagccactgtgcccgcccttccctttattcttgaaataagcgcttacagtggttcatgcctgtaatcctggcactgtgggaggccagggcgggtgaatcacttgaggccaggagtttgagaccagcctggccaacatggggaaaccccgtctctactacaaatacaaaaattagctgggtatggtggcacacgcttgtaatcccagcttctctggaggctgaggcaggagaatcaattgaacttgggaggcagaggttgcagtgagccgagatcacgccactgcactccagcctgggcaacagagcgagactccgtctcaaaaaaaaaaaaaaaaaaaaaaaaaagaaagaaaagaaaggaagaaagaaagagaaaggaagaaggaaggaaggaaggagagagaaagaacttaatctgctcccctcctgcactgcctttggttcccagattttttctcctattaaagggccttgagggatggagctctattcagagtgccagctgtgctcaccttttggttctgggcactaaggtacagcttccctcttactattgacccacaacatcttggatcacctgaatgtttcatgtagttacggcctcagcttaaccctttctcactcccacccccaggtgtcccagtcaaggcagaacaatcagcgcactcagagccattacttactgtccctgctggcctgtctgccaccacctgaggcttctcccggcctagccctgtgctgggtggtgctgggtccagagatgagtcaggctcactgccctggagagccccaggctgaggaggcagatacctggacagaggatgacacttggtgtggccaggttgtgactgagggaagcactgggggctgtagaagccagaaggtggcttcttaacccagactgggagtcaagggatgcatcctggagtaactgacacccaagacctgagccaagtcctagcagagaaggatggggccaggggttttcaggtgtggaagatggagccaagggtttcaggtgtgaagaagttcaggttccatctgagtccctaagtcccagggtggtcccctgggtctagactctagggacctctggtgctggaaatgataggtcctcagagccctttccagctcatcaggaagagctagaagccgcagggagcatgtatgggcacaaggaaaaggtgaggcgtccatggccccagcctctcccaggcccccagatctcttcctctctaaggctcctctcccatggtcttcccaggtctcctgctcttccccttccacatattctccccaaagaatgtacccccaaccccagcctgtaatcacctccctatcttgaggatgcccaaattggcattcattcattcaccaaatatttattgagcactcctgtgccaggctctggggagacaatggggaaccaagcagctatgacccttgctttcagggagctgaagtctagtagcggagacagatgacagccaagtacaaaggtgacatgcgtgatgaaggagcggtaccttcccgaccgcctagctaaagccaatgcttccctggtttccgtgccacggcccctccctagttccttcctagcatgcagtgctcttgcaagtaggagtttttgtttttgtttttttgagacagagtttcgctctgttgcccaggctggggtgcagtggtgccatctgggctcactgcaacttctgcctcctgaggttgaacctctgggttcaagcgattctcttgcctcagcctcctgagtagctgggattacaggcttgtgccaccactcctggctactttttttctgagatggagtttcgctcttgttgcccaggctggagtgcaatggcgtgatctcagctcactgcaacctctgcctcccgggttcaagagattctcctgcttcagcctcccgagtatctgggattagaggcatgcaccaccacacccggctaattttgtatttttagtagagacggggtttctccatgttggtcgggctgatctcgaactcctgacctcaggtgattcacccgccttggcctcccaaagtgctgggattacaggcgtgagccactgcacccagccctaatttttatatctttagtaaagacggggtttcactttgttggccaggctggtctcgaactcctgacctcaggtgattcccctgcctcagcctccaaaaatgctgggattacaggcatgagccaccacacctggaccttattgtttctggcttctgtctgattctgcaaccggaacagaagctcccgagagcaggcagtgcatttgttttgctgaccattttctccctggtgtctagaacaggtccagtacatagccagtctccatacgtgtttgttaatgaaggaaggaaccaggaaggaaggaaagagagagagtacaatggatgaaatagagaactaagttaggggaggtggggaagagattactttcaccaggtagtaaaatgtaaggtctcagctgagagccgaacatggagaaggagccagctgtgcaaggcgccaaggagagcattcccggcagacaggaagcaggtgcaaaggccagggaggaggagagagtctgatgccttggaagaaagaaggccactgtggctggactggagccagcaatggggaggccaaagaggaaggagatgtcacatcatgaaggcctttgacggccgtggtgaagggaccttatctgaaatgtctgtaacacacacgtgtcctctgacacttggcactggatttctctcaggcactttaaactcatcaccctctgaagcagacactgtgggtgccccacccatatacctgcatggcccaccttggaagtcatatactgtgacagtttccagataccctgacttgcagctccttctggagtttcttgtctgaggctgttcttgggaggagggagtgtgctccgtgttctcagcaggcctgaagtgtgtggacatttctgcagcttttagccagtgacagacacaaatcagggaatagataccccaaccacctggcccctcaaggaacattgctatggggtgttcttcacagtgtctcagagtgtcctttttgggatgaggctccaactgctctttgtggtaacctgacaaatgacacacccttacgccaggcgtggtggctcacacctgtaatcccagcacttcgggaggctgaggcagtttggctcaggattttgagaccagcctgggcaacacagtgaaaccccatctgtataaaaaatacaaaaattagccaagtgttgtggcgtgcccgtagttccagctatttgggaagctgaggtgggaggatcccttgagcccaggaggtcgaggctgcagtgagctgtgatcacaccactgtactccagctttggtgacacagcaagaccctgtctcaaaacaaagaaacacatgctttgttggtttttctccttgtttcatttctcttccctacaccatcacagtccatactggaatcacctcctcaggaaagtcgttgcacacaaattctcatctcagggtctccttttagaggaatacaagctaaggaactccttcatccaaactctgtcatattacactcaaagcatttttctctgttccccatctccgggatgaccatcgctgccataatcaggcaggactttccttcgactgtctcctgacatccaagtctggtcaattcttctagaaaggtagacatacagatattaaccagcctctcccttcttgaatccagtcctgtgctgagaaatgagactccagggatgaatcagatcagtcctgctctttttaatttttatttatttattttttaagagatgaggtctcactccgctgcccaggctggtttcaaactcctgagctcaagtgagcctcctgctgcagcctcccaaagtgctaggattacaggcatgagcccccacacccagccagtcctactcttgaggagacactagtttgttgggaagacagacctggacccaggcaagggccacacagtgtgctcagaactacatcagaaatgtcagagaagtctttcttgaagaggcgacacaggctgggtactgaaagctgagtaggagttggccatttgggagacagggaagtgctctaaacagaagacacagtttgtgcaaggatttggtggggataaaatatctggtcaaaaaaagcaaaaagcaaaaatctgggctgggtaggttaaaggagtgggaaaggatttctgatttcctctagatttggtttggagaagcagggggaaggatgagcgggaattggggcatgaccaggattggaaatcaggctgaagagcttgtactaagagctatggagggttcctgaggagggcgagtgaccctgtcagacttggatttgaaaatgattcctctggattagttaaatccaggggtgctagcttagctaaggaagcgatgcatttttagggagtaaaagagtgattttgagcctggagcacaggggagagggcggatgctaaggcccaggaaagagtgctcttgaacttggaagggcccagctccccaagaccagccttcagccttgatatgacctgattcagctaaacaaagctggggagcgggaatgagacctgggggacttgtcggctcagtgcccctgaggtaaccattaatccttcccctgggggaatccaggggctggttcctggatggggcagatcctggggagaatggaggagcacacagaggcaggctcggcaccagagatgggggcccagaaggccctgattgacaatcctgctgacatcctagtcattgctgcatatttcctgctggtcattggcgttggcttgtgggtgagaagttggggggtgtgctgctggtggctgctggctttgggggcctgggggaaaagtctcagggggaccctaggtgggagaatgatgcttggatctttgaaggagaaacctaggcctgggggcaagcaggtctttggaagttctcagggagacccagccaacattcctcccttgtcttcccactttgggactgtgctagctgaaggggtccgcggattttcatcagggtcgacattctaaatggggtctcattcccctggccacattgtggctgaccagcagaaaatattcaaggtccccaggaaggtcaagccaaatccacaaatgataaatcctggggagttgggatggaactagtggctcacacctgtaatcccagcactttgggaggccaaggcagggggatcactgaggccaggagtttgagaccagactggcccacatggtgaaaccgtatctcttttttatttaaaaaatttattttaaaaattatttacttttaaagagagaggggtctcaccatgttgcccaggctagtcttgaactcttaggctcaagcaatccttctgcctctgcctcccaaagtgctgggattacagatgtgagccactgtgcctggatgagaccttgtttcttaaaaagaaaaaagaaaaaaaaagaaagaaaggaaaaattagtcaggcatggtggtgtgtgtgcctgtagtcacaactactcggaggccaaggtgggaagattgcttgagcccaggagttcaaggctgcagtgagctatgatcatgtcactgcactccagcctaggagacagagcgagaccttgtctctaaaaagaaagacagatgtggggctgggtgcggtggttcatgcctcagtactttgggaggctgaggcaggtgaattgcttgaagccaggagttcaaggccagcctggccaacatggtgaaaccctgtctctactaaaatacacacacacacacacacacacacacacacgcacacacacacaaaaagctgggtatagtggcgtgtgcctataatcccagctactttggaggctgaggcatgagaattgcttgaacctgggaggtggaggttgtagtgagccaaaatcacaccactgcactccagcctgggcaacaagagcaagactctgtctcaaaaaatgagaaaaaaaaaaaaagaaagaaaaagaaaaaatatgtgaaaaaaactgggggaataggacactgggattagagcctgggttgccctgagtgtctgggaggagttgggggtgggagtgcaaacgatcagggaaacttggctcgttaatcttcagccagaaacaaggctgaggaatgtgttgaggtggctgatgaggtccaaggctgtgccctaaacccaggtctcccccgcctctgtctcccagtccatgtgcagaaccaacagaggcactgtgggcggctacttcctggcaggacgcagcatggtgtggtggccggtgagacgggctgggccgggaacgggaggggcctggagaagcagccctgctcactccctcctctggccacccaggttggggcctctctcttcgccagcaacatcggcagtggccactttgtgggcctggcagggactggcgctgcaagtggcttggctgttgctggattcgagtggaatgtgaggccctcttttttccaataaccccaccctcagtgagaacacctggaagggtcacaccttggggaaactccaggaaagggggaatgagactggcagtgggacttcccaactgcggggtgtgactgggctgggagtggaggtcatacatctagccaggaagcagaggggtgcaggggtgaccactgttggtcctgcttctgacttgccatgtgagccagcctgcaccagccactgcctctgggagcttccatttattcctctctgagtggggtgagcagcctcaaagccagggaagcacctgctcagatgcgctccgaagctgtggtctgtgaggaatttggggccaagttaaagccctttgcagaagagaggagcagagacaaagctctgggactgaggctcctgttggaggggagattgggctttgagctcagggcttcctggaggaggagactgctgagctgatccttgagggacacaaggtttgggtggctttggctcaggtcagtctgaggggtctatgctggggttcatatctagatgatcatagggacaacattgggaaaaacgggccagaagtgatagcctggggagacaaggagggctccagttaagagcccaggagggtgtcagctctgttccttggtgcccagggccccggggccatcacctgcagttgtcctctgggccccagatgtggcccttcccagggccacttgcttggagtagcaccttcacgaagaggtcagatcctcagggatgagggcaaagccaccctcagcggcagtactgccccccgtaggcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtgagtgcctgtggcagatgcgattgggccctagaagggtggggctcaagtggggtctctagagaaccctagagggcgtgagacctaggagaaaccactgcgagggttatgatgatggaggcagagcctgcaatgaatgtctccggggcaccagctacagtgctgggacctggaaaaatggagggaagctttgaggctagtagggcatggcctgggcaggaggtgggctggggacactgccctgggtcctgacctggcacttgcttctcccccaaggtggacatgttctccggagctgtattcatccagcaggctctgggctggaacatctatgcctccgtcatcgcgcttctgggcatcaccatgatttacacggtgacaggtgccagcaggggcttaggaaagggagtgggcctgggacactgctgccagctgtggccagggtttagggagctgccagaggaaagcaagctggagaggtctggaagggtggtgtggtccaagcaggagaaggaactaaatctttggagagcaaaggcttcctctctttccactgtctcttggattttgactggaagttcagagagaaagccatgctgggcttgagtgaggactttgagaaaaggaagatttagcagctcttgcctgccttgaacacctgggagagcacacctgacgagtctccaagatctctggcaaaacccagtatggttcatagggacctggggtggggcctgaggtcagatgcggaccagagtaggcagggcttggtgccaaggcccgcttgagggacccacctccagaaggaacggaactgagtataggaccttagacaatcatcctctcctacgatgacgcagaaaaaactggggccggctgggagcggctcacgcctgtaatcccagcactttgggaggccaaggcgggcggatcacgcggtcaggagtttgagaccagcctggccaacatggtgaaaccccgtctctactaaagatacaaaaaattagctggacgtggtggcccgcccctgtaatcccagctactcgggaggctgaggcaggagaattgcttgaaccgggcaggcggaagttgcagtgagctgagatccaccattgcactccagcctgggcgacagggcaagactccatctcaaaaacaaaaacaaaaacaaacaaaactggggcctagagggggctgctagtgggggtcctgcaagtaggcgcctggccctaaaactcagccacactctgcccgccaagccctgcttgttggtgcctgcgtgcatgagccccgagaacaggctatcgttttgaaatttattctccaggaaggggaactctttcaaattcccacaaagacgccttattgctaaggccagcctgtaacataaacagctgggctgtcccctgaccccggcctgttgcaggagggctggccgcgctgatgtacacggacacggtacagaccttcgtcattctggggggcgcctgcatcctcatgggttacggtaggggctcgcctaccagggaggggcgcggagggcatggtcgcggagctctcggcctgcgcgcggggccgttgcgcgtctccggtctgagggtcctaaggagggtcccctgacggccttgcccggcagccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtgcgggtatagggctgcgcctgcagtgaggccggggcggagccgagacgggcggagcctgagtccctccccgccttccccacaacggtctaaggcgcagtctgaggggcgggaacccctcgggttggtgctaaaccagacagaaggctccatctactccaagcgtgcagctgaacttggggcactcacgagccagaggcggggcacagagcggaacggggcgcggggcggggccgaggggaggcccgcaagcgggcagctgaacgcccctcccgtaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccaggtaacatccctgccccgcccctttcctgtgccagcaaccgggcgcccgtcgcccagttccgtcaccctcctaagactcggcagtttgggcccggagtcccgcctccctccgggggtcgcacgcctcctctgctaggattcccagtccccacctcctgggattcccagaccaggccccgtcctaacggcgcggtggcctctctctggcagacgaggtggcgtgcgtggtgcctgaggtgtgcaggcgcgtgtgcggcacggaggtgggctgctccaacatcgcctacccgcggctcgtcgtgaagctcatgcccaacggtaagggcagccccgggccacaggcgcaagctcgctgcggagcccgctgctgggaggggtcgtccctcgcgcagctgcagccgccctggacccccagtggccccagcctcacggctgccgtcggcccgcaggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggtgcggcctgggctcccctcctccccaacggatcagcccggggcgggggcttgcgcacctgcaggggagcccagggtccgggttcgatccgacggcctccgccgcaggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcaggtgagcggcacgcgcgtggtgacggcagggctgggcttgcacatcctcagcaggctgacctgtttccttcgcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacgtgagtggccaggtgccccaggcaagcactgtgggacacagcacctaccctctgcttcctggagtgcccagctgggaggacctgaatttctcgactgagggttgggaatgggctgggggtccagctgcagttgcaattgccgagcaagaatttttatttaaatacatttatttgaaccggcctgggggaggcttgatgttgatgggttggtgattaaagcctcccaaagccaatccttggcatggcctttgggactcaaaacacaggatctgactggtgggcacaataccatcttgaacgcccacaaaaaggtttggttttgttgccaaagggcaggtggctccaggcagggctgatggtggcagggtggggtgaggacaggacaagagatctgggtgtggaaggatggccgggtttctgcagcagcaggaggaaagggtgggagcacacaggcacagaacactgtgagcaggactgccaggccagtgtcacaagcgctaccatctgggtgtagacagacctgagctgacaaagctgggggagcaaggccaacggctttaaacacaagctcaggggcttggggtttatcccgagggcacagggcagccatgtagggtggagttggcatgagttaagcctgggctgggtgtgtagactggacagaggtgggtagggcaggcagtgacgagctggtgtgcaagagactttagggccaggcatggggggacagaactcccacctcgttcgtgctcccaccctccccagctccaccgcctggtcttcagtctccggcatagcaaggaggaacgggaggacctggatgctgatgagcagcaaggctcctcactccctgtacagaatgggtgcccagagagtgccatggagatgaatggtagggcaccatgctgggaggtggggctggaggagctgagttcccgcaaactaactgcagggcctcaatttccctcagagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgtcctgctgtggccaaagtgtccttgctccaggttcctgccctgggcttgggcctccgtctgggctgctcacaagaccttcttttcgggagacagaagccatgtggccctccactcatccacctctagctggtgcttctcggtcttccagccggcatcctgcagtcctggggagagatcatggggtgctgccgggaatgctggggacaagggtaaggagaggcacaggctgggtgcaggctttgtgcactactggggctcccactgcctctgctgggtgagtatggcataaaatgaggctgaaaccacacctggctgcagcaagaattcgttgaaatggcacacagaagagcgctgggatggaacaggcgccagacaaaacgtcctcatcagccaatgtgagggcctccctgctccatcctcccatttcctacatgccaactgggattacacagactgtctacactgataccacttcaaagaccattctaagctctccgtcctataaacagggaaactgagtaactgagtcccaaacttaggattgcagagagaatccatcttttttttttttttgagatggggtctctgtcacccaggctggggtacagtgacacaatctggactcactgcaacctctgcctcctaggctcaagtgatcctcccatctcagcctcctgacagtcccacaggcgtgcatcaccatgcacagctaatttttttatatttttggtagagacagggtttcaccatgttgcccaggctggccttgaactcctgagctcaagtatctgcccgccttggcctcccaaagtgctgggattacaggtgtgagccactgtgcccgacagtcttttttttttttttttttttgagagagggtcttgctctgtcacccaggctggtacaatcatggctcactgtagcctcgacctcccccagttcaggtgatcctcccacctcagcctcctgagtagctgcaaccacaagagcagaaccacacctggctaatttttgtgttttttttgtacagacaaggatttgccatgttgcccaggcagggtctcaagcaatctgcccacttaggcctcccaaggcactagaatcataggtgtgagcctctgcaccaggcccaagaacccaagtcttttacctttcaggtgaaagggtgggagtgggggaaggcggggcccccagggacaaggcttcaggggccaagcagccatgggctgagggatgttacctttcaagaactttgggaacagcatgtccaacacttcgtgtgtctccttgacgacgacccagctctctttcttaggacctgggtacgggggtgcagaaccagaagctctgtgtcctccagcaggacagagtttgtcctctctcctccccaccctgaggcatcagcagtctaaatcttgaggcacttacctgcccgcacccggttcctcagctcctccagctctgctggaaggggtccatctccctgcagggccccaagcatcagcccatgtgtggcggcccttaggatggtcttggggcctgccttctggttcagaactacctgtacctggtctggagggacccagagacagactggtatcagggaagggccacctcccaaaccccttctatcccatcaccctgcttcccctgtctgccccaagaccttggcctggcacggaaggctagcacctcaccctttcctttccaattcatctcctgttgctccccaatgttcgggccaaactgaccaatttccaaatacaatttcccagccgctcactgggctgggtctattttgcatttctttaatggctagtgagaataagcaccttttcacactcaaccagcggaccagcacactcaaggacttgtttacccaagaggcaacccaggatggagagaagggtggtttcccacggacagcaaaggtcatagccttcctaagagtgctgcaatgtagctttgcagtcacattatttgatcctcataaaaacaccgcaaggaataaggcaggtactgttagctctgttttacaaagcggtgacatgaatttcactggggcattgcagctgtaatttgaacggtctagagcaacccccagaacaggcagcctccaaactgcccagagctcggggccctaggttggaggaatgagaggctgacctgggagggtgcgtcttaggctgggagaatgaggcacactcactttgtgactggtcccagcagaggaggtaggattcttggtgcccctcaaccagctgctgcagctcaaagacactgtgggggagaggacagtgcagtgggggtggaggacagcaaaggcaggcatgcccaaccagccactgaacagccacccagtgaactgaaatgatccaggcttcactcaggtcccctcgcttcctctctccctcagccattacccatacacaccaaatccatcctttcttcctgtatccagtcatccaacttccccatctacccatccttccttcacccatcaagcacatctcttacatctgcttcatgttatacaccctttccttcctcacacacccacaccaaccccatgtctgttcagcagcaatgaagaacccaggacagagaggtggggccttgccagggaggccagtgtgtaatcggagtgaggggagtgtgggtggcggtggtgacgagcgggagacgctaggccactcacctggagaccaagcggtgtaaggggacccccagggatagagacggagctggccagaaacctgtgggaagctggggtcaggatgcctaggcagtgggagaggttgagacacaggacccgagaccaggggcagggtcacctgtccacagcggctccatgcgattggctgcagttgggtcgagtacctctcccctctgaaggtagtgcttcaggaccagccggagccggccttcgttcaaggtctccatgaccagggctcggaccgcgcggtagttggcgtagatgtggagggcagtgaggaagaagaaacatccaaggctgaagctggggtgagagagtgaggtagctgaagtgggcagaggcccagctggggttctcctgcccaccctgcttccggcttacccagggcaacctgacaccagagggagcatcaggaggctgaccaagagccccgccaggttcaccagcgtctcctggaaaatggcagagggagaaggagttggaaggtgcccctccaggccagactgagtgcccgagtgcctttcacctcatcctccctgctccacaacctcccagggctccttactgcaatgtgggtaaatttttagtttttggtgggtgaaatgtcatttaaaagatgccagctcgaggtggctcacacctgtagtaccagcactttgggaggctgaggtgggcagatcacttgagtccaggagcttgagaccagcttgggcaacatagtgggaccctatttctacaaaaaaattaaaaatttggtggggcatagtggctcgcgcctgtaatcctagcaatctgggaggccgaggtgggcagattccctgagctcaggagttcaagaccagcttcggcaacacggtgagacccattgcatttttgtaaaaatacaaaaaactagccaggtatggtggcgcgtgcctctactcccagctactcaggaggctgaactgcttgagcctgggaggtggaggttgcagtgagctgagatcacgccacttcactccagcctgggcaacagagcaagactgtctccaaaaaagaaaaaaaaaaaaattaagccatgattgcaccactgtactccagcctgggagacacagtgataccctgtctaaatacatatgtgtatcagttgcttttttgcccaggtaggtgccctcggaatacccttgaacacatcttgtcttgcaagtcaccagaacagacccacactcaggcactcactaatgtgtacttttttttttttttaaagagcgagggtctcgctctgtcacccaggctggagtgcagtggtgcaatcataactcacagccacctcaaactcctgagctcaagtgatcctaccaccacgcctctgctaattattactgcattttttggtaaagatgggtcttgctatattgcccaggctgatcttgaactcctgggctcaagcaatccccacctcagcttcccaaagtgctgggataacaggcatgagctggaataacttttatttactgattttaaaaagttgactgctcccctcccaccaagctcctttggtatgcagtaactggcagatagatttgcaaaggggtcaaggaaccacccgggaagaaaaggaacaagacccacacctcttcccttgtgtatcaatgttaggagaacactctgatggctggattgagatcactctaggggaagggaccccaggctacctgcccccaactcatcatgagggaggagtctggattggtgcccctgactactgggctcccagggagagctggtcctggcatagagaggacccgagactggagagctcttctcaaccagccctcctgggaagggcatatgctgtgggaataaacgctgtgggtgtggcaggaaactggggatcagggacctggggagttcaggagctcctctctcccaggtgggaagagtcatttccagtggccacatccagtgacagcaaagctgcactggcagaaagctggagtctgctgcgggactgacacattcccaggttagtcccggatatgtccctggctctgtggaccgaggaagccctggggtcttgggaaaaatggcttggggttagggggaggtctggggaccagcgagagaacaggagagggacaccaggcatggagctgggagtcctgcggtgagggacctgtgctgtgcttcctgcttgctccttaacagcctgtggacttaggttcagaagagacaatgggtggaataagcccgagcatcctgagagaagggacttccccaggggcccccagggagatgggacctctccatgctttatttcttcatctgtactaaggcaaccatgagcatttactgcacatgcccactgtgagaatttaaagagttcccagaaccaaaatacttggcacatggttagtgcttaataaatattagcttgggttaagattattgagccaaacaatggaagagaaggccagaaagtaggaatgcacagaacagcagtttctaaattgcttcagtgtcaaagaaaaccatctcacacttctgggacttccctgggccttaatttcctcatctgtaaactagggataaagtagtacctacctcaaagggttggtgtgagagtttgtttgtttttgagacagggtcttgctctgtcacctgggctggagtgcagtggggtgatcttagctcaccacagcctccacctcctgagctcgaggctgggactacaggtgtgcaccaccacacctagctgaagtttcttttatatattatgtagagatggggtctcgccgggttgcccaggctggtttcaaactcctggcctcaagtgatcctcccacctcagcctcccaaagtgctaggatgacaggcgtgagagttaagtgatgcagtacacgtaagcactcagcacggggtttgtagaggtctaatccatgcggagttcagccttaggggtgtccctaccccaactccaggctccctagggtgggcaagggggctgggccagcaggcctgctaaactgctgagtggaggccccagccagtgacccagcaaccccacatgctgggtaactctgacttgccaattgccttgacatgtggggcctcatgtgatcagaacatccagcttgcacggtggggtctgaagagggcaaggctgagggcttgctctcagccacacaggtggcgggcagggcctgagatcagctcggacttgccgccaccagagcccaaacccctactcctgcctgggtgtcttgagtcagcagggagcacccatacttcttcctgtgtgttcctgggccctccagggcactcaagtggcttctctccccttcccctccccactccacgccctccctccagctctggcactcacctggctgctgtccttggctgacacgtcagccatgttgttcctccgagcctggtgcacggtcagggcagcccgagtggccccaccagcaacactcacgatgcactgggtgggaggggaagagagaaggttggcagagacacgtgtcctggtaacacaggcactcagaccagctggagaaaacctggccccggccaaactctgaatgctgtccttggcatctagttctcaccttgatgccccctaggctcaacttccctgtcctgttctaggaaactggagtcccacctgccactatcaccttggggactggcctcacagaagctcaatttcattccccaaggtggaggcccaaagatcattctcagcccagaactcccagccctccagctcctgcttgggctataccctccccattactggcgggaggctcaggctggtttccagcttcatgcttacatctgcctcctgtaattcctctactctcctcctgccccagttaaagctgtcgaaacctacactgatggccctgacctcccagggtacccagatctctccctctgagatcgcaggataaagctaatcaaggagggtcactggtcactcacaatcatcccgagttcatcaaagctcttttacttattactatttttatttatccttagtttttgaatacagacagagtctccctgtgttgcccaggcgggcctggaactcctgggctcaagagatcttcccacgccaacctcccaaagtgctgggattacaggcgtgagccaccgcccctggctgagggctcttttagatgccagacatagacttaggtgctgtgatacaagtcagacccaggccctgccctcatggagcatacagatcaacagataataaacaaataaacaagttaatacgcaggcagaggaaacagtctgttcaaaggccagaggaacgagggacaaagtgagggcgaagtggctggcagggacctgaccacacggagcctggcaagcctggtgaaggtctttccctaagagcaatggagcagcagagtgacctgattgctttcctctttgaaaggatcactgggctgctctgagagaggagcggcacggaggctacctgggaagcaacggtgctctctcagcagtgagaggtggtgacaggaagatggaggagagaatggactggagattttgaggagggaaaaataacagaactgaaggttcagccgaaggtgacagataaggggaagggggaagaggaggaggtggtggcagtggtggtggcggcagcatagatgacagccaggctggcttctcttggtgcagctggagatggaggttgtggagaggggaactctagagaggggtcttaagagggaagctcatggccctgttccattcccttgttggacagatgaagagactgaagtctcaaaggcagagtttgaagcaaaagccagatggcacaaccctcggtccatagctacagccatgcttttctctggggtttcctaccctgtttaggggtgctcgtagcatttaggcttgcaaccaaggaagctaaatgtcctctaccacaaggaaccgttgcaccccaaatgctagtacttatggagaaacacggccctaacgtgattttaagttgacacatgggccttggaatgggttttccattttcttgagtttctcctctgggccagggacttaactctgacaggatatgctctttactgaaccatgccaggcctcagtgtcctcatttgggtgagatcaacctgcaagggttgtgcaggcaacagcttggcgtggaggaagagtgtgcttgagccccgcgtgtcccccagctcactgtgcggtctgtgctccatctccacctcgcctccagaccttaagctgtgctgtttcttttgcccggaacacccgccctgcaccttaaactccatcttcaggacccaggctcaggggagctcttcctacactccctgaccaggctggaatccccgcctcagcctcttgcaggccccaacatttctcatttagaatacctgtacctataattccacaaacactggtgcaattatgtgtggtttcctttcaaagacgggggcccacattctgtgccaaatatgcagtaggcactcaataaatactgtactgaaagaaccaaagggaagtcaaggaagctggtcccaaaatgtcaacattggacaaccccttctagttctcagctcggagctccctccccagtcctgtggctctagacattgccttacactttctggggcactagatgctgtctggctggaggagggtcagaaaggatggttgggttcgagtagaaacatctgaactttcttattcttcttgaagtggcaggtaaactcacagagcccaggtaaactcacacactaccaaggcaggtgttttaggcagatgggtgcccccacaggcagctaccttggctaggttgctggtggagacggtcatggtgaaacagattgggtatacaggagccataatctcaaggaacatggctacgtcattgaggatgtccgcaaaaagcctggggagggatcagaggttagaggtcagaggtaggagactttcataatggaagactcccctcccccgtccccgcccctcctcacctccactgcttggcattgcagtccagtttgctcctgttggggaggagaggttgttgtaatttggacttaaggagaaacacatcctatgggcagtgtggggagtcttggaccacagtaaagtctgaagagctcaggaaaacccacacccccagacagacatctgtccccacagccggtcactgctacctaaaatgccaccattagctgggagaaccttcagtgactgactgatcacctagtgtctcccgcttatgaactcatgatttaccaaggaaaaaccctgattgtcttgtggctgctccccagcctctgtctgtccttggagggaggctcttcctgagttcctctgcctctctccgttcttcttcttgctttagagtgagggtacccagtgagcatgttttggactagtaaacatcacattgagtgtgtaaccctgcatgttacagacaactagccctcacaggggatatgatttccctggatcacacgcagagttggggaaaaggctaagagagccgggctccgacatccaggcctagggtacttctgttacacaacaccgtggacggctacctcacctgcccttttcgtcagacagtgactccctgccctgtgcacaaacacttggaaacaacttctctagggtcccagtggcaggagatactgcagccccagcccagctcaggatttgcagcattaggcccgagtctcagtatgagatctcctggagggaatgggaatattcttgggagaggtatcagacacacataacgagatcctgaacacatggcctggttgagggttctgcccagtgaactgcccaataccatggaaagcacaggcttcaggttcaaatcccatctcgctagttataagctgtgtggtttgggcaggtaacttccctcatgcaggtatatttcacatttatgaaatgtacacatccaatcccatcctacagagttgctgtaaggattagagacaacatacagaggctcagggggcacagttacagctgttaatggtagctagtgtttactgagccattatgtacgatgccacgggcattaagcactttgcatagatcatctcatggaacccttacagccacaattaatggcaatactattactatcattactaccactactgggaagagttgccagagttgctggccgggaagacaaactcaccctttccaccaggcaaagacgatgcggcccagcatgccagttgaatctgggggaaagaaggcacaggtaaggagcaaggaagaggtgtgggagctgtggggcctggcagaccctggcactgaactggccaattcactgagtcactgcctttgggaactcggtctggtactagaagttgtggatagtcatagctacataatggggtcagaagtgcctacaaatagcagttcctcaatatgtcccctaggagacatggacaagaaatgttctttgcagaattgttcataacagcaaaaaacctgggaataatgcaaatgttgactgacagaatacataaattctagtatattcacccagaggcattcattcatagatgaatactattaaactcttgcatgaaaataactcatgaagaccacatacagcacagtttgcaaagctctaaaattaaaactaaacaatatagcacttaggaatatttacctatttggtaaaactattcaaaaaagcaggaaatcttaagtggaaattcaaaggttattgctaacctgttctagctcttaggctgggcagttggctcacagatggctattatgggataaataaataaaaggatttaggctgggtatggtggctcaggcctataatcccagcactttgggattacagggggtttgggcccagggactgcttgaggccaggagttcaagaccagcctgggcaacacagcaagaccccatctctacaaaaagtaggaaagaaattagccaggcatggtggcatgcctgtagtcccagctacttgggaggctgaggcggaaggatggcttgaactcaggatcaatgctgcagtgagctatgatcatgtcactgcactccagcctggatgacagagcaagacccagtctcaggaaaaaaaaaaaaaaaaagatttgaactgcagctggggttgcacggcagagggacaggcctccttaggctgggcagagtaagagaagtctctggaatcagtgggaccttcgtttgcacaacaaatgctttctggctacctaactctctctgccaggtacttcatgaccacagtgaccaagatgatcccagggtcaaaatccagccaaagagcagataacaatcagtatagaaaacactgatttagaccaggaatcactaaactgtttctactccctggttttggaaataaagtattactggaatgcagccatgcctatttgtttacagattgtctatagctgtttttgcaagacaatgacagaactgagttgctgcaactaagattataaagcctgcaaagcattaagatctggccctttacagaaaaagtttgtcaatctggaccatccattatacagagagcagcacccattaagcctggcagaaatattttagaacgagacacctgggagggactcatacagtggacatgggagaggacagataccatggggagaggatttggacttgtctgagcttgagggcactgaccctgaggtggggatgtaggagaaaggacactacgttatgggaatgagggctgggagcttcccacgaaacataaatgcaatgacacgggccagccctcccattctccactgagagcagatgcattctcccctttccagagccttcttgggcactgagtcatgcttgcccaccctggacttgagggaaatcagtaagcgctccagtgcacacctgaaatacctgtgctttttcatcttcacaatgatcctgagactttgggagggatcattccccttcactaaggctcccattaaatcggtgaataaaattgaggtattttacaagaaaatatggatttccagcttctctggaagaacctgaagatatggccacactggggctgccctctctcacggccagcatcagctggggctacctcactgaaggaaagcatgggtccaagctactgccatctggcctgctttgtttctccatttctgtcctgactctggaagtaacacccaacaaggtggatttacaggcctcccatccctcactttaacctcttcccttcaagtacattatattctcggcaaaatcatcattgtgccagccaccacacctggctaacttttgtatttttagtagagatggggtttcaccatgttggccaggccagtatcaaactcctgacctcaggtgatccacccgcctcggccttccgaagtgttgggattataggcgtgagccactgtgcccagctcagactctatttttcttccctttagctacacacttgtatccactcaggtgtatgtcctccttgggccacctgacagaaagggagcctattctacctttccatggatcatcagaggcatttacaggacaaatgatatatatactccctagcatctgagtcactactgtccactagaatagaaaactcccacttgcttttttttcctcttcatttacaactggccaagctgtaagatctagaaacatctgagtcctaataaggaatcagctgaccacaaattgtacttggctccacttgacattcttagctggcaaaagagtgtggtagttaagagtagaacacaggaataagtctgcctaggtcaaaatcatggccctaagtgaccttggacaagttacttaaacacacttttgtctctgtttttccatctaaaaaatgaataatggcagctaactaatatggctgctgcagagatcaagacacatattacatgtaaccatacaaaatgtgtggcttaaggtaggttgccaaaatattagcaacaagttttattactattgctactcatgacaactggcatcacgttccactgagacaggtaactgaaaatgatcacatcaaaaaatcccaagtaagtttctcagatgaagctctgcacagaaatttcccatgtttgatgaaaatgagcttgtaaaatcctaattgagagcttcttttactatcaataacaagcctttatttatttatttttttagatggagtttcactcgttgcccaggctggagtgcaatggcgcaatctcggctcaccacaacctccgcctactaggttcaagtgattctcctacctcagcctcctgtgtagctgggattacaggtgcacacaaccatgcctggctaattttgtattattagtagagagggggtttctccatgttggtcaggctggtctcgaactcctgacctcaggttatccgcctgcctcagcctcccaaagtgctgggatcataggcgtgagccaccgcacctggccaataacaagccttttaagtagatttttcatcctttttctttgagacagggtctcagtctgtcatccaggctggactacaggtgcctgccaccacgcctggccaatttttgagttttttgttagagacggggttaaaccatattggccagggtggtgtccaactcctgaccccaagtgatccacctgcctctgcctcccaatgtgctgggattataggcgtgagccacggcacctggcctttctttttttttttcatatcttaaagtgatcttgatttttcttaataacttgtctgagctaaaggtttagcgttccttttttgtttcagacaggatactgctctgctgcccaggctggagtgcagtggcactatctcggttcagtgcaacctccacttcctgggttcaagtgattttcctgccgctgcttcctgagtagctgggattccaggcacgtgccaccatgcctggctaatctttgtatttttagtacagatggcgttttaccatgttggctaggctggtcttgagcatctgacctcaactgatctgccgaccttggccccccatcccaaagtgctgggattacagggatgagccaccatgcccggccaaggttaagcattcctaatccaaaaacctaaaatctgaaatgctccaaaacctgcagcttttgggagtgcagacacgatgccaccagtagaaacagccgatggtgaaatagcacaaactgttcttgtagggaaaagaaagagatcagactgttactgtgtctatgtagaagaggaggacataagaaactccattttgatctgtactaagaaaattgttttgccttgagatgctgttaatctgtaactttagcgccaaccctatgctcacagaaatgtgctgtatggaatcaaggtttaagagatctagggcggtgcaggatgtgtcttgttaacaatatgtttacaggcagtatgcttcataaaagtcattgccattctccattctcgattaaccaggggcacaatgcactgtggaaagccacagggacctctgcccaagaaagcctggatactgtccaaggcttccccctactgagacagcctgagatgtggcctcgtgggaaggaaaagacctgactgttccccagcccgacacctgtaaagggtctgtgctgaggaggattaggagagatatgctggcggcaatgctgctctgctactctgctacactgagatgtctgggtggagagaagcataagtctggcctacgtgcacatccgggcacagtaccttcccttgaacttatttgtgacagattcctttgctcgcatgttttcctgctgaccttctccccactatcaccctgttctcctgccgcattccccttgccgagatagtgaaaatagtaatcaatactgagggaattcagagaccagtgctggtgctggtcctccgcatgctgagtgccggtcccctgggcccactgttctttctctatactctgtctctgtgtcttatttcttttctcagtctctcgtcccacctgatgagaaatacccacagtgtggaagggctggcctccttcagttctgaatcaaggcaatcatggtaacagtgacaatgaagaggatactgttaccactacagaaaaagtgcctatagacagcacggtgaggatgtgggaggggattactgtggcactagagcagcatacattcataacggaacaagaaatcaggcagtttatagaatccaagagagacttctaagatagaaaccacagttaatgaggcaaatgactctggaggaaacattttaaaaagccatccagcagaacacttcctcatccctagaggacccgcttcctgtccttcaactgcttctaatgtttcttctcaccttaaaaaaataaaatatggtgtccagtaaccttttcaccaaaacagctgaagactgacagcctgccgtttttgttgctgctgctatggttcagaagctgatacaggtgttctggtgatctgctgtgctgcttagttaccctgaacacacaatttctcactgtattagtggtatatcatgttttatactgttaagtacttctgtgtgaataggtataagaaaatgactgcttcttggtagcatatacattcagagtcaggaacgatggggacgctaaccaaccagattgtccacgtgtggctgagacagtgacatctttgctttctgatggatcaatgaacacaaactttgtttcatgcacaccattgaaaatactgtataaaactgcctttaaggtatgtgtataaagtatatatgaaacataaacgaatttcatgtttagacttgagtctgatccccaacaaatctcattatatacatgaagatattccaaaatccaaaaaaaattccaaaatccaaaacacttctggttgcaagcattttggataagggatattcaatctgtataggcaacatgttggtgacatcacatgaaaacaaaaactactgacccaagctccaaatgcattccaaaaatacggccaacaagccgggcgcagtggctcacgcctataatcccagcactttgggaagctgaggcgaatggatcacccgaagtcaggagttcgagaccagcctggccaacatggtgaaactctgtctctactaaaaatacaaaaaattagcggggcagggtggcacatgcctgtaatcccagctacttgggaagctgaggcaggagaatcgcttgaacccgggaggaggaggctgcagtgagctgagattgtgccactgcactcctgcatcccagcctgggtgacagtgagactacgagtctggaaaaaaaaaaatagagatgggggtctccctatgttgcccaggatgcctcagcctcccaaagtacgaggattaaaggcgtgagccaccgtgcccggcccagttttctcagtcttaatggtaaaggtgtaaacaggaagctcctgttttctcaaaaaaatccagagaggctcacaagggatgtggccagactgatgctacgaatggaaagcgcttttccttagatctattaggttggctcaaatgtaattgcgggttttccattacctttaatggcaataacgacaaagaaaccccgcaattacttttgcaccagcctaataaatatcccctgcgagcagtagtgaaagacaaaggacagtggcaaaagccatggggcctcctcgtgtagaacatgtaacaatttcccttttctgttctatttccctctctgggtggcatggtaccaaactgtattttttttccttaaacaattttttaaaagctgtacatattcagcagatagtcactctattatttacagcatcatctggtatcccagagcatacacaataccttccattctttccaggctctcctctctccttctcaggaccaactatatcttttttttctggagctcaccaatttcccctatcctgggcagctggcagttttattccatcaattgcattcttatgcaatcttccacaaagagaatagggataaaggggaggggacgggatttgggatccagatgattgagactcagaagtctgtgtggggaatggagtgcggctgctaggctggtgagtgggatgagggtcttccagatgtgggaagtaagactgggttacaaagcaccactctaatcactggggagacctgcctgaattctacctaatggggcacgagtccatacatatatacacataagagcccagcgaaagcagggctgaaagcagcaatacgtgaggctccaggggtgcagctcacctttcacgagccaggtggccgtggcagctgaaacagtggcttttgcgttccccacccctatgcccagcaagactgcctgggtggctagggagccggagaggctggaagcaaacgcctggagaagaaaacaagtagggtgagaagcgggcgtaggagcgtggcggtctaagtgccttcatctgttcttgttcttggtgtatgaggcatgtcagaccccccgccccccgggctccgagtctcagtcacccgtccattattggggagggaggagtggcctgcactgtcctctgccccagacgaccgagctgacctgcacggaatcccacagctggtagggcaagtagtccgggctgacgctatcagggaagccctgaggcaggaacacggcctggagcccggagaggggcggtgagggggccccggaagcccccacttcgcccgcatctcgtccttcaggtttgaccgtgaaggccctggagagcccccaccagcgccagcccccgacctcccactgcaggctcccgtccgcggcggcgcggcagccccgtgcctccccggagccgaactgctcggaacacagcggggtctccaaacccgcgtcgtcagccatgccgagcttttggatcccagccccgcccctgccgcacggtggacgtggcaggcggcacttccggctgggctaccgcggctgcagagggacatctttcaagaacaggcgccggcctcggcgtccgccgcgcagttaggaaactgactgtcgctctctccggcctcggcgctgcttcggacgccccggcaccggcccccgttgctttgtagcattctgcagctgggctgcaggcgccgtgggcctccgccagttgtgttcgagacgcggttcggccacagaagttttagcttgtgacttttggcaagtcagtggccctctctgggcctcaggtgccttttttgctgtgagaccagcgactgtatttttaaccctgattttatccctagatctacccaacacatagtaggtgctcaaaagatatttatgagtgaatgaatgcatcatgagaagaaattggaccagatgaggccctgtgaagctgcttgggtctttttttgttcttttttttttctctcttctgagtgtccctggcctggactagaaattctccatccttcggccttctgcgagactgcaggaacattacttttgaaggatgctaaggaatccgagggatgaaaaaaatcaagagattgcaatgatgtcacaaaacaaggaaacaaggcaggaagttcttgtgtgtttttttgcgggagagagtccatgaaattggggggagtccaaagagggagtgtttctgtccttggaactcaccttttcttctttccatttctcctcttctccttcccatctagtgcagcatcttcactccgaagcagaaatttgccaaaaaagcatcctctttttatcagaaaataaaatatcctggtttcttagcctggcattcttggatccccacagtttgatcccaaccgacaactccttatttgaaacttcagattctcccaaaccgtcaccttcctcgtggacttaatcctggaaggcccttctaccccacttcgccttatctcacacaaacacagtctctctctgactgagataaacttgaacacttcttttcttttctttttttttttctttaaatttcgggtttcaaaatacaaatggcctaatcacaacatttctgtaatgttgtctaaattcaggtactggtttgaatagaggacaaaaataaaacaaggtttgaagactaagtactttaaaaacatatttatttaaatagaggcagggcctccctatgttgcccaggctgctctcaaactcctggcctcaaaagtgatccttgggctgggcgtggtggctcacgcctgtaattccagcactttgggaagtcgagccaggtggatcacttgaggtcaggagtttaagaccagcctggccaacatgttgaaaccccatctctactaaaaatacaaaaattagctgggcgtgggggtggtgtggccataatcccagctatccgggaggcggaggcaagaaaatcgcttgaaccgtgcagttgtcattaactccgtgtttgttatctcttttttaccaatggtttgccagtttcttctacaaatacctgttgctacctatgtgctcattgggatagtgagcaaaaacaaacaagggtcttggtcttttggaacttatattagggaaggatattgatcaaatcatacaaataaatgcaaagttggaactatttcaattgctgtagaggggtacatgttatttaatatgaggacttttagaaggagaattgagctaatcagtggaatcaagggaaacttttttttttgagatggagtctccctctgtcacccaggctggagtgcagtggcacagtcttggcttactgcaacctccacctcctgggttcaagtgattcacctgcctcaccctccggagtagctggggttacaagcattcaccaccacacccagctaatttttgtatttttagtagagacggggttttgccatgttggccaggctggtcttgaactcctggcctcaactcatctgcttgcctcgcctcccaaagtgctgggattacaggcatgagccactgtgcccggccaagggaaattttttaacaaaaatttaagttggggtctctctgtgttgcccaggcctcccgcctcggtcttccaaaatgctaggattataggcatgagccgttgaggccagctgggaaactttttttttgaggaagtgtgtatttagctgagatctagagtaagagttaacttgattatgatgggaaaataattttctggaaagaaggagcagcatgtcctgagtggggagggagcatggtacctaacatccaacaaaggccggtgcagcagaagtctagagcacgaggggcatggggaaagggctgctagggagttaggggccaaactgcaggacattgtaggccaagctcttcttcatccttagggttaagatttattttttattctatcagtcaatcaatcaatcgatcgatgagacagggtcttgctctgtcacccaggctggagtgcagtggtgcaatcatagctcactgcagcctcaaactcctgggctcaagtgatcctcttgcctcagcctcccaagtagctgggactacaggcatgcaccaccatgcctggccaacttttaaaattttctgtagagatgggatctcactatgttgcccaggctggtctccaactcctggcctcaagtgatcctcccacctcggcctcccaaagctcttgagattaaagaatatattggtatatgttggagtggcactttagagaagtagttgaataaatttaattttttttaaaagacaggttctctgtcacccagagagtgcagtggtgtgatcacactacagtctcactacagcctcaacttccagggttcaagtgatctgcctcagcctcccgagtagctgagaccacaggcgtgtgccaccatggctagctaatttttgtattttatttttgtagagacagggttttgccatgctgcctaggctggtctcaaactcctgggctcaagtgatctgcccacctcagcttcccaaagtgctgggcttataggcatgaactgtgcctggcagaaatttaatgtttaattcttattttccatttagcttataacactgtcaataaattatcctttcaaaataattttgagtttcctggcacagtgaaagatcaagcattgtgttatatttgaaaggttagcttctgtgagtggataggactctggggcatcagagggccttactgtgaatgtaggttctgtccaggaagctgtccaggaagctgtgagatcttgggcaagttacatatctctctgtctttcagtttcttcttctgaaagacgaaatggtaatggtaaaatggaaataatactagtacctaccacacagagttggaacgagaattaagagtcatgtcttggccgggcgcggtggctcacgcctgtaatcccagcactttgggaggccgaggcggacggatcacgaggtcaagagatcaagaccatcctggccaacatggtgaaaccccatgtctactaaaaatacaaaaatgagccaggtgtggtgatatgtgcctatagtcccagctacttgggaggctgaggcaggagaattgcttgaacctgggaggtgggggttgcagtgagccgagattgcgccactgcactccagcctgggcgacagagcaagactctgtctaaaaaaaaaacaaaaaacaaaaaagtcatgtcgtatgtgcaaaactcttaaagtatttagcacatagtacatactgtttaagtgttggttcttattcagagataatgtcaagtgttcaaatgtgaggcccttggctccaagtgaggcaggtggccctcatgactagtgtcactgtataatttattgtgcaaaccaggacttttgagagggtcattaaaggaagcactggtaataattgtgttgggaaaacaggtctgcgggaaaacaggtctgcagtgaagctgtctcaggcaaatgggaatatatggtcacattatttatgaacccactgcagctctactgcttaccattgtccaccttgacatctccttactcagagactatgacagtccctgttcgttgtagcatttacttaactcttagcctatgctgtctggagccagtttgtatttgcttttgttaggtacagatgtcctgtcttcccaagtggactgtaagtgcctgagggcaaggacccatcatacacttccctgtgacctgagtgtgcagataggtggcttgacaaagagatgagtgatagttcccctttctctatggctgactgccaccgtcactacttgaaaccctcattatgatagttactactgttactgtttgagaccttcactacgacagttactactgactacttgagaccttcactatgacagttactactgttagtacttgagaccgtcattatgacagttgctgttactacttgagaccatcagtacaacagttactattgttactacttgagaccatcattatgacagttactactgttactacttgagaccgtcattataacagttactgccattactctttaacaccctcattacaagactgaatgaagggatgaacatagacaatgaaaacttaaagcaaaaaggaagggtccaggggaagaagaagagagctccctgcttctagtgagcaaaggcagcccttgagcttccacagcccttcgtatttgttgggtagcaagagcagggaggaggaggtaatgatgggttggctgcttaactgataacaggttcataatattattaacaggcttcagatgtacctaatcgcaagaaacactgtgcttggggcatgactgccctcagcattccttctgggtggcagacgcagtttgtcagtctgccaacattctgcatttatgagaaacagtttgtggtttactcatacagcctccagtggtatactgagttgatcatgaccctcattctttcggcctgtaacatttctctctcatgaggtctcttgaaagcctgcgcctaaatcctgtcatttgatagtgcaactgtctcttgttatagttggggaattggttccaggaccctggagtatacgcaaacctgcacacactcgtcttgcagttggctctgcatatatgtggcttttgcaaccctctgttactgtatttgcttttttttttttttttagatggagtttcgctcttgttgcccaggctggagtgcagtggcacaatctcagctcactgcaacctccgcctcctgagttcaagtgattctcctacctcagcctcccaagtagctgggattacgggcatgtgccaccatgtctggctaatttttgtatttttagtagagacggagtttcaccatgttggccaggctggtctcgaagtcctgaccccacatgatccactcgcctcggcctcccaaagtgctgggattataggcatgagccactgcgcccggcctgctgtattttctttccttttccttttattatttaactgaataagaaaaaatgttggtatcctttcttttcttcttgctctgttctcccctctctccctcccttccttcttttcctttcctgcctccctcccttccttcctttcctccttcccttctttttcccttccttcctccctcccttcctcccttcctcccttcttcctttcctctttttggagatagtttcactctgtcaccaggctgggtgcaggggtgtgaccatggctcactgcagccttgacctcctgggctcaagtgatcctaccatctcactgcctgagtagctagaattacaggtgcatgctaccacttccagccattactatatttttgatctatatttggttgaaagaaatctacattataagtggacctgcccagttcaaacccgtgttgttcaaagatcaccggtatatcaagcatggggcagaatactccaagctctcagccccttgactttcccctagttgatttcgccccttccaatcctgcctcctgtagtcactctccacacagcttccaactctctggtttacagcctctcagtgggctgggcacagtggctcatgcctgtaatcccagcactttgggaggctgaggtgagtggatcacttgaggtcaggagtttgagaccagcctggccaacatggtaaaaccccatctctattgaaaatataaaaattagccaggcgtggtggcactagcctgtaatcccagctacttggaagactgaggcaggagaatcacttgaacctggggggcagaggttgcagtgagccgaaattgtcccactgcactccagcctgggtgacagaacgagactctgtctcaaaaacaacaacaacaaaaacacctcacagtggcttatcattacttttatggaaggagattgcaacattctcctccaaacccttcaatggcttttcttcatacttgaaaataaaacccgaactttttgtcagagcaaacaaaactctgcagatccggccctgcctgatctcttgaacctcacccctgccactcatcctgtctcttcccctaacgatcataagatccaggaacactaatctatttccagggctttgtgtcagtgcctggcacaaggtagggtccaaatacccatttgtggaaagaataaatttttattttttaaaaaatagagatggggaggccgggtatggtggctcatgtctgtaatccctgcacttcgggtgatcgaggcaggtggatcaccacctgaggtcaggagtttgagaccagcctggccaacatggtgaaactccgtctctaataaaaatacagaaattggctggatgtggtggtacgcatgcctgtgggcccagctacttgggaggctgaggcaggagaatcacgtgacctgggaggcagaggctgcagtgagccgagatcatgccactgcactccagcctgggtgacacagccagactccatctcaaaaaaaaaaaattatttcaatgtcagaattgttagatatattaaaacacaagtctattatgtaaaaggaaaactcaaggtacggaaaattattcactgaattaagtgttactaagatgagtattgagccgaagaatggctttaggacgtttttcaaggcagagtaaatattatcaaataatttacttaagaaaactactgaagtccatgatttttgttctaatatgaaaacctaaggtcatcaagataccttgaccgctcatcccctgacttcatggtcttttcatcattctcagagaccagatgtttcctgtcaccacacatcacagtctccattaggtactttgtatgtccagagcaggttaaagctttatatttaatacttttgaaaaagaataagataatttaatcagctatatcttatacattatcacaggcatgaaggaattgtagaaatgcttccact

SEQ ID NO: 19 - DNA, 5033 bp, Homo sapiens
tatgtgatcagggaacacacactggcctttcaagggcatgggaaaatcccactgttgaagctgggcaggaggtacctaggagtttgctttgttatcaccctctacacgagaacagcaaactatgacccacaggccaatgtggccccacttgtttttgtacaacctgtgagctaaaaatggttttacatcgtatatggttaaagaaactaaaacaatgtttcacggcatgtgaaaattatagaaaattcagatttcagtgtctaaagttttactagacacagccagctcattcctttacatacagcccatggatgctgtagcactgtacagcagagctgagtacttgtgagaggtcacaggtggcctgcaaagcctagaatgtttactgtctagcccttcacgaagaaagtctgctagcccctgacctagggcataactagggacttaaccaaggctgacttgggtgtccttcctccaggttctcagagctcagagcattcttgaagaaggtagagattatctctaccttatattttacacatattcttttgtatttcttcagtttaatcattttttgaaaaagattagcatatttctttcataaatattgctctattaaagctccacgcttcaccaactcaataaaaaaaaaaaaaaaaaaatgactcagttaaaaacagacatgtactgctatcaggaacattaaaccaatacagcaaagcatagcaagctacagtttattttgattcaagtacagttttaagaaaagaaccttccaactaaaggctccaagtctgtggagagtccccaccgccttgcttagctcactggatcattaagatacacattggatcattaagatagatacacactgcatcattaagatagatacgggggctgggtgcggaggctcccgcctgtaatcccaacactttgggaggctgaggcgggcagatcacaaggtcaggagttcgagaccagcctgaccaacatggtgaaaccccatctctactaaaaatacagaaattagccagacatggtggcgggtgcctgtaatcccagctactcaggagactgaggcaggagaatcgcttgaacccgggaggcggaggttgcagtgagccgagatagcaccactgtactccagcctgggcaactgagcaagactcaatctccaaaaaaaaagaaagaaagaaagacacaggacagtcagctgcatcacccactcacagaagaaccttagaaaagcagcagagctatattcaattccttccctatcttttttaaagaaatgcatcatgaattatgtcacattttagcaggagttgtccaatgttagcgtacgttttcagaagcaagttacttcacaacttttaagtatgaaccagtacctttaaagagttaacaatacttattaaataataaccatggctgaaagtggtaatgaataaacagggaattcattacaacattgtttctgtatatgtttgaaaacttctacaaggttttcacattgaagctttgtatttttagttattaaatacgcatttaacagaaaagtcacagaattctcacttgaaagaattctatctttcaaaatccttagtacaaaatatagttttccatcatccttactagtggcaactaaaaaaagaaacaaacagatgcttattttaaaatctaggccgggtgtggtggctcacacctgcaatcccagcactttgggaggccaaggcaggcggatcttctgaggtcaggagtttgagaccagcctggccaacagagcaaaaccctgtctctactaaaaatgcaaaaattagccacacatggtgacaggtgcctgtaatcccagctactcggaaggctgaggcaggagaattgcttgaacccaggaggtgaaggttgcagtgagccaagatcatgcacttcagcctgggcaacagagtaagactccatctcaaaaaaaaaaaaaaaaaaaaaatctttgttaaggctttcatcaatgatctgagaaactgaaacgatattcacctaaaggaatactatgtagttgtattatcttaaagttttccaagtccttgttgaagccccaatacaaacacctacttctttaatgtgtaagaaaagcattataactggtaaacttgtccatgtgcctgccagtctttatgaagacggatggtgtattcctccagtacaagaaggctggttcatcactgtcctagagagagggaagtgaaggaaggaaggaaggaagaaggaaggaaggaaaggaggaaggagggaaggagggagggagagaagaagggagggagggagggaggtgcaattttacaaactgagcaaagatgcagggaagactcagcactttgaaaactggcaaacttttaatgtaaacatttacttttaataactgttacctttcataaagcgtttaataagaccaagcactgccgggcacggtggctcaggcctgtaatcccaacactttgggaggccaaggtgggtggatcacctgaagtcaggagttcaagaccagcctggccaagacggtaaaaccccgtctctactaaaaatacaaatatcagccgggtgtggtggcatgtgcctgtaatcccagctattcgggaggctgaggcagggcaattgcttgaacctgggaggcagaggttgcagtcagccgagatcatgccactccactccagcctggcagcctgggtgacacagcaagactctgtctcaaaaaaaaacaaaaaaaaaagactaagcattacataatcatgtagtacaatcacatgccacacaaggaaatagagattagaaaacttaacaaacaagcccaagatcatagagccaggattctgaccccaactccatgcccttaactaccgcaatcaacagtggttattcaactttcaaactaagactcagtgccaccttgcaacccacactttgaaaaccaatgcctagctactccaagtatggtccacagaccaccagccctggcatcacctgggaacttaggaaaaatgcaagtctgagcccttcccagacagactgaattggaacttaaaatataacgagatccctgggtggcatgtatgcacttaaacgctgagaagccttcatatagtgcctgcacacactctattttgaggtagtttctccaattcaaatacatatcctagaacggttaaagggagctttcatctcttctgcttgctgtgatcccaaaccaaaggtaaacatgtgctggcaagctaccccaggtggcgatgaaaagtggccctaacctttcctccacacccatcctcagtcccactccttcatctttaccgcccctcttgtacagagcctaaaccacagctcaacttactgacttatctgaacccttcctcctcctagagtaatagacaataagggaatgactccactcaacatcccccgagttccttgaaatgtgcccaggaactaccaagcatgaatctagtgcacggttaaattggcagaaagggacagctgggactacttcaggcatgtcctctgaccctaacaactgtggacacataatcaaaagattggtactctgtgagctagaatgagagatcccaacacaactgtaataacattatattaccagttaataggaaatactgtgcaaatggacagaatatcctgacatagcttttcatcttctttttttatttttttatttttgtgagatgcgggtttcagtctgtcactcaggctagagtgcagtggcatgatcataactcactgcagcctcaaccttccgggctcaagcaatactcccacctcagcctcctgagtacctgggactacaggtatgcaccaccatgcccaactaattttgttaaatttttgtagggacaaggtctcactatgatccccaggctggtctcaaactcctagactcaagtgatcctcccgcccaggcctcccaaagtgctcgaattacaggcattgagtcactgtgcctggcctcatgacatttttaaaaatctatggtttcagctacctctcttgatactagaaatcaaatttaagatgcttcaaaccaatctccacacggttctcatcaacatccaggcttttgcccatgtttttcttctccctagaaccttttcccccatccttcccctctccacttggctaattcctctccccacctggctaattcccattgttccctcaagagtgggtgctgtgacacccccgccagaaccccacagtgccctgcaactttgcacagcactatgactgcctaagggcagggatggcagggcaagtgcaatgggagacactgggtctaagacacagatcaacatataataaatgctttcacaaaatttctcagttaaaactgacatatttgtaagttaaaatatcaatacttaatagttatctactcagtgtgccacagattcacatttcaccacctaaatcagtctaagaatctacactgtaccttagggatagatttcacagtaagtctattaaaggaactcaatcatctgtctagctatatagattccaaaaaattcaaactttaaacagcaaggatacccatattagtggttttcaaatgcagatccacgtaccagtgcaagtccctgatgaggttttgatagtcaagccatatctatccactagaactttctgcaatgatgaaaatgttctataccagcgctgcccaatgtagtagccactagccacatgtggctaatgagcacttgaaatgggactagtgtaactgaggaatgggcctttcaacttcgcttaactgtaattaatttcaatttaattggccacatgtggctagcagttaccatatcaaacatcaggttcaggtctagactctggagtgaaataaaaaagaacgcgttttggcttcttaatttcaagcaatgttatttggtccaaccctccttctgaaaaagactaaaagaaaatatggacagaatatttttataatcttaaaagcaaccacaacctgacaagacaagaaataa

SEQ ID NO: 20 - DNA, 455375 bp, Homo sapiens
tctcagatggttgtcttccttggcagcaacaaaaataaaatgctactaaactagtttgagacagttgccatatatgtttacatacttacagacatatatccacacatagacatatatccacacaggtgtgtgtatacttgtatatatacacaagcctgttaaaatttaattccatatgtatcacagttataatgctatctcccactatagatgcttttttaaaaaatcatgttcttgaatttctaatacttttgtgtatttaaccactatagtttttggttcaaagtattaccgaatcaaacctgggcctgcctatgcagcactgcaaagccaaactctgacatcagggctgcagtgagagaaagtgaggcatttggccaggcacagtagctcacgcctgtaatcccagcactttgggaggctgaggcaggcagatcacctgaagtcacgagtttgagacaagtgtgtccaacatggcgaaaccccatctctactaaaactacaaaaattagccaggcatggtggtgcacacctatgatcccagttacttgggaggctgaggcagaagaattgcttgaaccctggaggcaaagtttgcattgagccgagatcgcgccacagcactccagcctgggcgacagagagagactccgtctcaaaaaaaaaagaaagaaagaaagtgaggcatttatttgcagggcaccaagcaaagagaattaggtagctcatgctaagacctgaattccccaacggcttacaagtaagggtttttaaaggtagagagacagaggtgatgggcaaagtcataaatccatatgtggaggttatacattggtttgacctaaagaggctgaatatcttaaaatggggtcttacagatcttaggtaaattcaaagattttctgatttgtaaatggttaagaaagagaagctttgtttaaaaatttcaggtcagcagaaaagaattagcactgcctcatgggtgtgacttcctccaagcccctcaagaagaattttagaacaaggaagggtagtcagagttcagtcctctgtttcccccttatctgaggtctatgtatgtgccagtgcatccatttggcaggggtacaggtttctgaaaagtaattcagggacacatgttaagattttatctttagtttctatatggaacaaaatatcttatgactctaactaccttgatatcatttttaagctactataaccttgcttttgaagttgctcatttactgctcagagttcactaggtatctggaatttcccttgaaggaactcaagattttcctttattttcatgctttcaaggtaggggagttataagccactaagaggggtccctgctctgtctcaaagggatttataagatctttttaatcagttgtgacttctatcattatgtaacatccttttttatgcttgttattccttttaactttaaattcctccttacttggtaatgaggagtctggttccaggccaaattcctgtgtgtgacacttcaagtccaaccacaagttttgcttaggaggcctcatgggggaaaactgccctacccacatcagatttgatgcacagtcaatgcactgtagtctctggacagctgcagacaagtactcagctcccaacccctgcctagggccatcattgcttatacattcagcaggcttaatccaggtgcctccactcagagacctccttaaaaggtgggtgcctccacggagatgtccttgtaaggggcccctgactaagacacttttcccctttgacccagtacttttccactgctagcccttcccttttcctccctgtagacctagcgtaggtccataaatggcagaagccttttgttcagtgcttttcagcagtgaggcattctctacccacccacctgccttgcctgtcatcggactggccctcacccaatgccattgcatggagtgaaatgaaacactgaggagctggcactttttctttgtctgttgcctgaactatcgtagcaagtgaataaagttttgaaggctactttcagtttggatcactgtcctcattaaccaccttgacatcagacagcttgacagataatcattcttccacttcctctttattaattttcactggcctagtattttaagtaatttcttttataaagcattaatatccacattccaggaaaaaaatcctcataaagggggaagaacaaaagaggcctattcaccatgcaaatgaaaacaaacaaacaacaacaagaaaacattcctagaaccttcacacagtaactgtgacacatgtgctttgcccagaacttagtgtcaaggctacctgtatctgcaaagtaagctcaaaaatttagtttctcaccttgtatgttacttttcctcaaaaaattgggattctgttaaaaaggaaggaatgatgtatatggaatggaatcaaactgacaataattaggacatacaggaaaaccactattcaaagaacacccagaaaatgcattgcaaaaagatcattatctaggcacatagtcatcaagttgtctaaagtcaagatgaaggaaagaatcttaagatccgtgggaaaatagcatcaggtaacttataaaggaaaacttatcagattaacagcagattaatcagcagaaacccaaaagctagaagggactggggttcctatcttttagcctccttatacaaaacaattagcagccaataattttgtatccagcaaaactaggcttcataagtgaaggaaaaataaagtattttccagacaaataaatgctgagagaatttgccactaccaaaccagccctacaagaactgctaaaaagagctctaaattttgacacaaatccccaaaatataccaaaatagaatctctttaaagcataaatctcacagaacctacaaaacaacaacacaatgaaaaaaaaaaagatatataggcaacaactagcacaatgaatacaatagtacctcacatctcaacactaacattgaatgtaaatggcctaaatgctctacttaatagatacaaaattgcagaatgggtaagaattcaccaaccaagtatctgctcccttcaagagattcacctaatacataaggactcacataaactttagttaaaggagtggaaaaagatattctatgcaaatggacatcacaagtgagcaggaatagctactcttatattagacaaaacaaactttaaagcaacagcagttaaaaaagacaaagagggacattatataatgataaaaggactagtccaacaggaaaatatcacaatcctaaatatatatgcacctaacactggaactaccaaatttataaaacaattactactagacccaagaaatgagatagatggcaacacagtaatagtgggggactctaatactccactgactggactagacaggtcatcaagacagaaagtaaacaaagaaacaatgaacttaaactataccctcaaacaaatgtacttaacgatatttacaaaacattctacctaacaactgcagaatatgcattctattcaacagtacgtggaacattctccaagataggccatatgataggccacaaaacaagtctcaacaaatttaatttaaattatagcaagtactctgtcagatcacagtagaataaaattggaaatcatctccaaaaggaacccgcaaaaccattcaaatacatggaaattaaataacctcttatgaatgactgttgggtcaacaataaaattaagacagaaattgaaaaattatttgaattgaacaataacagtgacataacctatcaaaaccactgggatacagtaaaggtggtgctaagaggaaagttcatagcattgcatgcctacatcagaaagtctgaaagagcacaaatagacactctaaggtcacacttcaggagccagagaaacaagaacaaaccaaacccaaacccagcagaagaaaagaaacaaccaagatcagaccaaaactaaatgaacttgaaacccctcccccgcaaaatacaaaagatacatgaaacaaaaagctggttctttaaaagataaataaaatcgataggccattagcaagattaaccaagaaaagagagaagatgcaaataagatcaattagaaacaaaatgggagatactacaaccaatatcacaaaaatacaaaagatcattcaaggctactatgaacatctttatgcacataaactagaaaacctcgaggagatggataaattcctggaaatgtacaaccctcctagattaaaccaggaagaaacagaaactctgaacagaccaataatctcactgttattgaagtgagattgaaatgctaattaaaaacttgccaacaaaaaaagtccatgaccagatggattcacagctgaattctatcagatattccaaggagaactggtatcaatcctaatgacactattccaaaagacagaggaagagggaattctccctaaaccattctatgaacccagtatcaccctaataccaagaccaggaaaagacatgacaaaaaaaaaaaactacagaccaatatccctgatgaacacagatgcaaaaatcctcaacaaaataaacgctaacagagtccaatggcatatcaaacagataatccactacgatcaagtgggtttcataccaggaatgcagggatgatttaatatccacaattcaataaatgtgatacaccacataaacagaattaaaaacgaaagtcaggaggagccaagacggccaaataggaacagctccagtctacagctcccagcgtgagcgacgcagaagacgggtgatttctgcatttccaactgagctttgaagagagtagtggttctcccagcacgcagcttgagatctgagaacacgcagactgcctcctcaagtgggtccctgacccctgacccccgagtagcctaactgggaggcactccccagtaggggcagacggacacctcacacggccgggtacttctctgagacaaaacttccagaggaacgatcagacagcagcattcgcggttcatgaaaatccgctgttctgcagacactgctgctgataaccaggcaaacagggtctggagtggacctccagcaaactctaacagacctgcagctgagggtcctgtctgttagaaggaaaactaacaaacagaaaggacatccacaccaaaaacccatctgtacatcaccatcatcaaagaccaaaagtagataaagccacaatgatggagaaaaaacagagcagaaaaactggaaactctaaaaagcagagcgcctctcctcctccaaaggaacacagttcctctccagcaacggaacaaagctggacagagaatgactttgacgagttgagagaagaaggcttcagacgatcaaactactccgagctacaggaggaaattcaaaccaaaggcaaagaaattgaaaactttgaaaaaaatttagatgaatgtataactagaataaccaatacagagaagtgcttaaaggagctgttggagctcaaagccaaggctcgagaactacgtgaagaatgcagaagcctcaggagccaatgcgatcaactggaagaaagggtatcagtgatggaagatgaaatgaatgaaatgaagcaagaagggaagtttagagaaaaaagaataaaaggaaacgaacaaagcctccaagaaatatgggactatgtgaacagaccaaatctacgtctgattggtgtacctgaaagtgatggagagaatggaaccaagctggaaaacactctgcaggatattatccaggagaacttccccaatctagcaaggcaggtcaacattcaggtaatacagagaatgccacaaagatactcctcgagaagagcaactccaagacacataattgtcagattcaccaaagtggaaatgaaggaaaaaatgttaagggcagccagagagaaaggtcgggttactcacaaagggaagcccatcagactaacggtggatctctcggcagaaactctacaagccaggagagggtgggggccaatattcaacattcttaaagaaaagaattttcaacccagaatttcatatccagccaaactaagcttcacaagtgaaggaggaataaaatactttacagacaagcaaatgctgagagattttgtcaccaccaggcctgccctaaaagagctcccgaaggaagcactaaacatggaaaggaacaaccggtaccagccgctgcaaaatcatgccaaaatgtaaagaccatcgagactaggaagaaactgcatcaactaatgagcaaaataactacctaacatcataatgacaggatcaaattcacacataacaatattaactttaaatgtaaatggactaaatgctccaattaaaagacacagactggcaaattggataaagagtcaagacacatcagtgtgctgtattcaggaaacccatctcacgtgcagagacacacataggctcaaaataaaaggatggaggaagatctaccaagcaaatggaaaacaaaaaaaaggcaggggttgcaatcctagtctctgataaaacagactttaaaccaacaaagatcaaaagagacaaagaaggccattacataatggtaaagcgattaattcaacaagaagagctaactatcctaaatatatatgcacccaatacaggagcacccagattcataaaacaagtccttagtgacctacaaagagacttagactccaacacaataataatgggagactttaacaccccactgtcaacattagacacatcaacaagacagaaagttaacaaggatacccaggaattgaactcagctctgcaccaagcggacctaacagacatctacagaactctccaccccagatcaacagaatatacattttttttagcaccacaccacacctattccaaaattgaccacatacttggaagtaaagctctcctcagcaaatgtaaaaggacagaaattataacaaactgtctctcagaccacagtgcaatcaaactacaactcaggattaagaaactcactcaaaactgctcaactacatggaaactgaacaacctgctactgaatgactactgggtacagaacaaaatgaaggcagaaataaagatgttctttgaaaccaacgagaacaaagacacaacataccagaatctctgggacacattcaaagcagtgtgtagagagaaatttatagcactaaatgcccacaagagaaagcaggaaagatccaaaattgacaccctaacatcacaactaaaagaactagaaaagcaagagcaaacacattcaaaagctagcagaaggcaagaaataactaaaatcagagcagaactgaaggaaatagagacacaaaaaaaacccttcaaaaaattaatgaatccaggagctgattttttgaaaggatcaacaaaattgatagaccgctagcaagactattaaagaagaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattcctcgacacatacatcctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaataaatgtaatccagcatataaacagaaccaaagacaaaaaccacatgattatctccatagatgcagaaaaggcccttaataaaattcagcagcccttcatgctaaaaactctcaataaattaggtatcgatgggatgtatctcaaaataataagagttatctatgacaaacccacagccaatatcatactgaatggacaaaaactggaagcattccctttgaaaactggcacaagacagggatgccctctctcaccactcctattcaacatagtgttggaagatctggccagggcaattaggcaggagaaggaaataaagggtattcaattaggaaaagaggaagtcaaattgtccctgtttgcagatgacatgattgtatatctagaaaactccattgtctcagcccaaaatctccttaagctgatcagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttgcaagggatgtgaaggacctcttcaaggagaactacaatccactgctcaatgaaataaaagaggatacaaacaaatggaagaacattccatgctcatgggtagaaagaatcaatatcgtgaaaatggccatactgcccaaggtaatttatagattcaatgccatctccatcaagctaccaatgactttcttcacagaattggaaaaaactactttaaagttcatatggaaccaaaaaagagcccgcattgccaaggcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaatgacgccgcatatctacaactatctgatctttgacaaacctgacaaaaacaagaaatggggaaaggattccctatttaataaatggtgctgggaaaactggctagccatatgtagaaagctgaaactggatcccttccttacaccttacacaaaaattaattcaagatggattaaagacttaaacgttacacctaaaaccataaaaaccctagaagaaaacctaggcattaccatccaggacataggcatgggcaaggacttcatgtctaaaacaccaaaagcaatggcaacaaaagacaaaattgacaaatgggatctaattaaactaaagagcttctgcacagcaaaagaaactactatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagatacttctcaaaagaagacatttatgcagccaaaaaaaacatgaaaaaatgctcaccatcactggccatcagagaaatgcaaatcaaaaccacaatgagataccatctcagcagttagaatggcaatcattaaaaagtcaggaaacaacaggtgctggagaagatgtggagaaataggaacacttttacactgttggtgggactgtaaactagttccaccattgtggaagtcagtgtggcgattcctcagggatctagaactagaaataccatttgacccagccgtcccattactgggtatatacccaaaggactataaatcatgctgctataaagacacatgcacacgtatgtttattgcggcactattcacgatagcaaagacttggaaccaatccaaatgtccaacaatgatagactggattaagaaaatgtggcacatatacaccatggaatactatgcagccataaaaaatgatgagttcatgttctttgtagggacatggatgaaattggaaatcatcattctcagcaaactatcgcaaggacaaaaaaccaaacaccgcatgttctcactcataggtgggaattgaacaatgagaacacatggacagaggaaggggaacatcacactctggggactgttgtggggtggggggaggggggaggggggagggatagcattaggagatatacctaacgctaaatgatgagttaatgggtgcagcacaccagcatggcacacatatacatatgtaactaacctgcacattgtgcacatgtagcctaaaacttaaagtataataataattttaaaataaataaataaataataataataataaatgatgagttcatgtcctttgtagggacatggatgaaactggaaaccatcgttctcagcaaactatcgcaaggacaaaaaaccaaacaccacatgttctcactcataggtgggaattgaacaatgagaacacatggacacaggaaggggaacatcacacacagggaactgttgtggggtgggggaagagggagggatagcattaggagatatacctaatgctaaatgacgagttaatgggtgcagcacaccaacatggcacatgtatacatatgtaaaaaacctgcacattgtgcacatgtaccctaaaacttaaagtataataataataaaattttaaaaagagtcatatgatcatctcaatagatgcagaaaaagcatctgataaaatccagcattgctttatgattaaaaccctcagcaaaatcagcataaaagggacatactgaaaggtaataaaagccatctatgacaaaccatagccaacaatgtactgaacggggaaaagttaaagcattccccctgaaaactggaacaagacaaggatgcccactttcactacctctattcaacatagtactggaagtcctagtcagagcaatcaagagaaagaaacaaagggcatccaaatcagtaaagaagaagtcaaacagtcactgttcaccaatgatatgatcatatacctagaaaaccctaaagactcatccaaaaagctcctggaactggtaaataaattcagcaaaagttcaagatacaaagttaatgtacacaaatcaatagtccttctatacactaacaatgaccaagctgagaatcaaatcaagaactccaccccttttacaatagctgcaaaaataaaatagaatacttaggaatatactgaaccaaggacgtgaaagacctctacaaggaaaactacaaaacactgctgaaagaaatcacagatgacacaaacaaatggaaacatatcccatgctcatgatgggtagaatcaatattatgaaaatgaccatactgccaaaagcaatctacaaattcagtgcaattcccatcaaaataccataaccattcttcacagaactgaaaaaagaaatcctaaaattcatatatggaaccaaaaaagagcctgcatatcctaagcacgactaagcaaaaagaacaaatctagaggcaccacattacattacctgagttcaaacaataccataaggccatggtcaccacaacagcatggtactggtataaaaaacaggcatataggccaggcgcagtggctcatgcctgtaataccagcactttgggaaactgaggcaggcggcgttcgagaccagcctgggcaacgtggtgaaaccccatctgtactaaaaatacaaaaaattagccaggggcagtggcaggtgcctgtaatcccagctattcaggaggctgaggcaggagaattgcttgaacctggaaggcagaggttgcagtgagccaagatcatgccactgcactccagcctgggcaacagaagtgaaactctgtctcaaaaaaacaaaacaaaacaaaaaaacaggcatatagaccaagggaacaaaatagagaacccagaaataaacccaaagacttacagccaactgatcttcaacaaagcaaagaaaaccattcaacaaatggtgctgggataattggcaagccacatgtagaagaatgaaactggatcctcatctctccccttatacaaaaatcaactcaagatggatcaaagatttaaatctaagacctaaaaccataaaaattctagaagataacactggaaaaacccttctagacactggcttaggcaaagacttcatgaccaagaacccaaaagcaaatgccacaaaaacaaagataaatagatgggacttacttaaactaaaaagcttctgcacagcaaaagaaatagtcagtaaatagacaactcacagagtgggtgaaaatctttgcgatctatacatctgagaatggactattataatatccagaatctataaggaattcaaacaaatcagcaagaaaaaaacaattccatcaaaaagtgggctaaggacatgaatagacaattgtcaaaagatatacaaatgaccaagaaacataagaaaaaatgctcaacatcactcattatcagagaaatgcaaatcataaccatgatgggatactaccttactcctgcaagcatggccataataaaaaaaaaattttttttaaaagatgttggcatggatgtggtgaaaagaaaacacttttacactgctggtgggaatgtaaactagtacaaccattatggaaaacagtgtgaagattccttaaagaactaaaagtagaactaccatttgatccagcaatcccacccctgggtatctacccagagaaaaagaagtcattatacgaaaaagatacttgcacatgcatgtttatagcagcacaaatcaactacaaaaatatggaaccagcccaaatgcccatcaatcaacaagcagataaagaaaatgtgagatatacatatatatatgttctatcaacaaaatctattttatctgtaaaccataataaagctgttgtctctgtgtgtgtgcgtgtgtgcgtgtgtctctgtgtgtgtcttctatcaacaaaatctactttatctgtaaaccataataaaactgttgcaagtatagcactttcttgagggctgtgagtcaatctaggaaattacatacataccatggaatgaatactactcagccataaaaagtaacaaaataatggcatttgcaacaacctggatggaattggagaccattattctaagtgaagtaactcaggaaaggaaaactaaacatcatatgttctcactcttaagtgggagctaagctatgaggattcaaaggcattaaaatgatagaatggacttatggactttggggactcaggggaaagggtggggagtggcgagggataaaaacataaatttatttcaggttgtgggctcgccgtgatggaaagacacatcatgtgattaaagagttgggctttttgaaaggtgaaatcagcccaaccttcagggaggagtagggggctagaaattgagttcaatcgtgtgaccagtgatttaatcaattttgtccgtgtaatgaaaccccagtaaaaacaacactaaagctcagtcttctcattggtgacaaaaattaatgtgccaggagggtgatgcatcttgatgacacagaagcttcatgtttgggaccctgccaggcctcaccctatgcatatcaaaataaataaataaattactaatttatgatcaccaagcagtgttattcaagaaatggaggaataatcaggaaatcaacaaaatctattttatctgtaaacttgtcacaaactttgaagagtcttggattttgccctacttgcaaggtaactcagcctgacacagtctcactgatgctggtaaagttggcaaatacccaacttttggtagtatacataaaactccaggaccaagggtgaagaacaatttattttttaaaaaatagcagtagcctggctatcagcaattttgtgcctattccctgaggcctaattcttaccaggcagcacaaatagaatgatgacacctgcacatacagtgggttgcattttaggagaagagtctggcttacgagaccgattttttttcctttgcagaaaaacaaacaaaaaaacaccacagaggccagtgcagtggtgtgtgctggggatggttgaggtgagaagattgctggacaaaatagagagaccccctctctaaaagatacataaatatatatttttaaaaacacataaatctaccctcttaacaatttctaagtgtacatacagtacagtattactaattaaatgcacactgcaattcaatacatctgtagaactttttcatctttcatgattcaaagttgagctaaaagttgaacaacagctacctgtttcccctcccccttccatggtagaaggggccaaataccattctactcactgtttctatgagttggatttctttgaatccttcatataagcagaatcatgcagcatttgtctttttgtgattgctaatttcacttagtataatgtcttcaaggttaatccaagttatccaaatgaaaagatttccttcttttttaaggccaaataatattttattgcgtatataaaccacatttttatttatttttattttttcgatgagaaaaaaagtgaagtatttattttcattaatatctgactgaagattaggattccataaatataaacaacaaatcactgtagtagctatataagtcactatagtaattttgcaactaccaaaaattgcaaacattttcacattgcattacagatgtaggtataataaaatattacttgcagtcattgctactttaaaactataggagttattaaatcagctgctagatttttataaatatacacattgcattacatcacaaagtataaaatattttgataattttatttcataataatttcctgcaatcctatgtattttatgcatttaaaaacattgctctgagaaaggtccataggcttcatcagactgtcaaatcactatcttgtgcaaaatcaagaacccttgtactacaggaagatacacacaggtcaaataaggatccctggagttagaagaacaagtaatagcccaaggcagcctcctcctctttattccatgtcctagcattaatcctgcctaccctctctgttccaggcctctgaggtattcctccttgtaagacttgtacccacccattcttgttctgcctctcaacctctgctccaacttccatatatttagattaattcattcattcatcaaatatttttctggggacttattatacactaagtactattctagatagtgaaggtacagcagcaaaagaacaaataataaaacttgtcttcacagaggacattctagtgggggaacagaccatgagcagaataaagaagtatgatgttaaagcgtgtaagggaaaataaagcagagaggccaggctgcctgagattcttcttctgaaaataaagcagggaagggaaatagggttttccaggaaaagggagggacttgaagtttttaaatagaatgagcagggaaggctgtgctgaaaagttaacatcagatacagacttgaaagaggagagggtgagtcacttagccctccaggctgagagaagagcaagtgccaaagctggagtatgcttggtgtattgggagaagtcagaaggccagtgtggctggagtgaagtggatgtagggaaaacagcaggagtgaggtcaagcagatacgtgatgggaaagaagaccacgtggaggagcatggtaagctactgaaaggacttcagcttttactctgagtgagatggggaccactgcagagattgagcagagggccaacatgatctaaaatgttttaacagaatttcactggcttccatgcagtgaatagacaaagtggggcaggagcaaaagcaggaagaatgaataatggatgccagcacttgacgtgtggtgctttggagtgggctttggagccaggctgcctcagattcttaatctgtaaaatagtatctgttcttcaccaataaaatggaaaaagaataaacctaatgtgaggattagatcagctaatgtgggcaaacttcttagaatagtgcctggcacattgtaaatattcattaaatgttgactttccttacttttctcagagcctaggatacatgctatgagggtaccacaccgctatttgacacatagtgggcaagacggtaggacttgaataagttttgggggggatcttgttcctatgtcttgattttaggagagtagttaagcaaagcaagtatcagatgctgccttgaaatctagaaccttattcttttcatgtgatgatagtgacaaagcaactgacaccaactctgattacagaaagtagggaattggtgaattgaatgtgtactgctacttaaaaaaatagagacatggctgggcgtggtggctcacacctgtaatcccagcactttgggaggctgaggcgggcagatcatgaggtcaggagatcaaaccatcctggtgaacatggtgaaaccccgtctctactaaaaatacaaaaatgagctgagtgtggtggtgcacgcctgtaatcccagctactccggaggctgaggcaggagaatcgcttgaacccgggaggtgggggttgcagtgagattgcaccactgcactccaacctgggtgacagagcgagactccatctcaaaaaaaaaaaaagaaagaaaagaagaaaaagaaatagagatgtagctatgattatgattaaatagatgaagaaccaaagcatcctataaggaagtatctttaaaattgcacagatgtcagccgggtgcagtggctcacgcctgtaatcccagcactctgggaggccaaggtgggtggatcacctgagataaggagttcaagaccgcctggccaacatggtgaaaccctgtctctactaaaaaaacaaaaattagccgggcatggtggttggcacctgtaatcccagctactcaggaggctgaggcaggagaatcacttgaatgtgggaggcagaggttgcggtgagctcagatcgtgccactgcactccagcctgggcaacagacaagactttttctaaataataataataataataaataaaattgtatagatgtcagctggtgcagcggctcacgcctgtaatcccagcactttgggaggatgagataggcaggtcacctgaggtcaggagttcgagaccagcctggccaacatggcaaaaccccgtctctactaaaaacacaaaaattggccagtggtggtggtatgcgcctgtaatcccaactgcttgggaggctgaggcaggagaagcccttgaacccaggaggcagaggtggcagtgagccgtgatcaggccattgcactccagcctgggcgacagagcgagactctgtctcaaaataaataaacaaataaataatcttataattattaaatgaattggagaggacagtgatgttagcaagatggcagagtattgttatggataataatagttatccataaatgataataactttgggagggatcaagggcccatttaagaacttgtggtaacacagtggaggagaaaaatggagaataaccaatgtggaacagtcaaaggacagcagtatacctgagacatctagagacaggaacaaaagacaagggtaggagctattagtatcagccgcacagcatgggctactgtggtccccactcacctgctctatagaggacaccagcaactgaggtaaccaacagccatccccactgcagacccctccactaccaccagagagggaaacatggctatgccccctccaaaggcgccactgttgggcttttcaggactggagccatcatccctcacaatcccgtgctaatccctgacatctgaactatggtcatttctctgtcatgcttcctgttacgcctgaagaactgtgggtcaattaaacttcttttctgcataaattacccagtctcaggtagttctttatagcagtgtgaaaacagactaatacaccatactacacaaagcaatccacagattcagggaagtccctatcaaaattgtaatggcatttttcacagaaatagaaaaagcaatcctaaaatttacctggaattacaaaagaccttgagtagccaaagcaatcttgagcaaaaagaagaaagctggaggcattatactacctgatttcaaaataatttataaagctatagtaattaaaacaacatggtactgacataaaaacagacatatagacaaatggaacagaatagagagccccaaaataaatccatacatttaggcaattgatcttcaacaaaagtgccaagaacacacaatatggaaaggacagcctcttcaataaagggtgttgtcaaaactagacctccacatgcagcagaatgagagtgaacccttatgtcagctgatatacaaaaatcaacacagaatggatcaaagatttaaacacaagacctgaaactgtaagactattagaagaaaatataaaggataagctccatgatatttgtctaggcgatgatttttttaaaatatgaccccaaaagcacaggcaacaaaagcaaaaattggcaactgagattgtgtcaaaccaaaatgcttctgcacaggcaaggaaacaatcaactgagtgaagagactacccatgacttgggagaaaatatttgcaaaccatacatctgataaagggttaatatcaaaataaagaactcaacttgatagcaagaaagaagtaattttattaaaaaatgggccaatgacctgaaaaatcacttctcaaaataagatacacagccaagcgcacctctagtcccagctacttcggaggctgaggcaggaggttcacttgagcctaggagtttgaaatgaaactgggcaacatagtaagaccctgtctcatatttttttaaaagggaagaagatatacaactggccaaataaaatattttaattttcacattatttactgatgtgtattttaaagaaataaagaaacaaaataatagttctttatatttatctacatagttcccatttctttctttctttttttttcttttttgagacagggtttcactctgtcacccaggctggagtgtggtggtgcgatctcagctcactgcaacctccacctcctgggttcaagcgattctcgtgtctcagcctcccaagtaactgggattacaggcacactccaccacacccagctaattttttatttctggtagagacaggatttcaccatggtggccaggctggtctcgaactcctggcccaagtgatccgcctgcctcggcctcccaaagtgattggattacagacatgagccaccatgcccagcccataattcccatttctgatgttcttgattactttctgacaatatgagtttctatttcttatcaaatccacacagtgtgaaaaaattcctttggcatttcttgtagtgcaggtcagtggatgatgaattatcttgttttcatttatctaaattactgtttttgttagataatagaattctgaattgacaggggctttcttcatcagcacttaaagatgtcaattcactgtctttttccttccattatttcttgtgagaagtcaacatcatttatgttacttttttgtgtgtgtaatatattgatttttgtctggttgttttcaagatttttctcattatctttgataatcatttgactttgatggtcaaattatgactgtcacttgattattatgtaccttggtgtggttttcattgaatttatcttgcttaggattgactgagcctcttgaatatgtatatttatgtttttcattggctattctttcttaaatattttttgcccccatctttttctcttttttcttgtgggggtccaataacgtatattggtcttttaaaaatatcgttctacagatcactgaagctgtattcattattttttttgaggcggtggctcataagattttttaagtactatttatctatcatcaagttgcctgattccttcatctgtcatccccactctactattaagcccattcagcaaagtcttcatttgcccttttttcaggtctatgatttccatttggttctttttctagttcctatttctgtgttgaaattcctacttgctcattcattactagcataaattcctttgcattctggagcataatagttataatagctacttttaaatccttaagtactaattctttcatcttggtcaactttgtggttggtctctattgattctgttttgtctcttttaatttcatgtcacattttcttattttgttaatatctactaattttagattttagcctgggcattttgaaaacttcatgttagatacaatagattttattatatttgtcttaaaaagtaccattatgttgtttttatagacatctaaatgagctaaactcaaattccaaactatcttccttggagtgggcagcagctaaaaaaaatctgtgcaattaacattaaaatctgcacagcacatgtgtaattcagggcacagccaaatatttgggcagagcttttgcatagaatttatggtttccctctctcaccctgtatgcttttctactcacttttagctgctgtggtcagcccaaattctggtctgattcctcagttggttaagactgcacagacatggcaccacctggaacttctcactcaaagagtcataaaaaagttaaactcaccctatgacacatttctaaaaattattgaactttgaaattcattattgcactgttctctctacctatcattttgcctgaaaattttttataataaaaaattccatgctcaatataaatattttaaaaattaaggctatgggaggtagaaaatgaaagttccctgcaatcccttcatctatacatagcccctatatatagccaatagactatcttagtaaagaataatctcttgactcagactatctcagaggaaaacattatttcaagtaaagatatgagatgagatagtcttaacacagcttcctcagaattacacatcactattccttaaagtgctgttgagagcactagctttgttctgcattttcttaaaccgtagaagtaactaaaagttatacaaagaggggaaaggattttgtgtatctcagctgtaatatttacttaattgtaataacattgtaaactctgaatattgagaaacaaaagttacgaggtagccaggcatggtgactcatgcctgcaatcccagcactttgggaggctgaggcaggtggatcacttgaagtctggagtttaagaccagcctggccaacatggcaaaaccctgtctctatgaaaaatacaaaaattagcagagcatggtggcacatatctataataccagctacttgggaggctggggcacaagaattgcttgaacccaggaggcagaggttgcagtaagccaagattgtgccactgcactccagcctaggcgacagagggggactctgtctcaaaaaaaaaaaaagttaggccggacgcggtggctcatatctgtaatcccagcactttgggaggcggaggcaggcagatcacctgaggtcaggagttcgagaccagcctgaccaacatggagaaaccccgtctctattaaaaatacacaaaaattagccaggcttggtggtacatgcctgtaatcccagctactcaggaggctgaggcaggagaatcgcttgaacctggaaggcagaggttgcagtgagctgagatcgcaccattgcaccccagcctgggcaaagggcgaaactcagtctcaaagaaaaaacaaaaacttatgaggtaattacatttagagaatgaggtcacaagaactgaggacacaaagggatgaaagtggccgggcatggtgcctcgcacctgtaatcccagcactttgggaggctgaggcagatggatcacctgaggtcaggagttcgagaccagcctggccaacatggtgaaatcccgtctctactaaaaatacaaaaattagctaggtgtggtggcgtgtgcctgtaatcccagctactcaggaggctgaggcaggagaatcacttgaacctgggagacagaggttgcagtgagctgagatcgtgccattgcactccagcctgggtgacagagcaagtcgctgtgtcaaaaaaagaaaaagaaaaggggtgaaagtaaaagcaactaaagaaatagttcctcatcttccacaatagaaagttaatagagctaaatctataactgaaaaaaatcaaaaaagaaaataagcatgttatttagaaatacggtagaatatataaaaatgaacagttaaatgaattgaagagggttgcatctgggaagcagaaatgcagagtttgtatgcttgttattaatatttgttataaaacaatttgatttttaaaattatgtatatatggtaacagtgattaaatagaaatttaaggtagtaggaacaactatgtgaaattagattagaattggtgatatcagcttgaactcatgattactaatatttttttctttagtttcatctgctgaaaaggcatagatgcaatgacacctaagtcgcaataagcttgctaagctcccagatattgttttttaagcaccattttctactgtaaggtgtcaggacactttgcagaaatggctcctttcagtgctgggtgagagaaagcccaaaataaaattagaacatcttgttgtaccagaaagtaaagaactgcttttatatatatatgtcctatcaaaacagctaggttgaaaggagctctcactaaacaaatctcagacactttgaacaccaaaataagatggtaatggattataatcctttgaggaaatggattataactgattcaataatctgggaatccctaaattcatactgaaaacacagatgttccttgaattatgagggggctacatcccaataaattcatcatgagtcaaaaatatcctaagtcaaaaaatgcatttaatagccttataaatacattgtaaagacaaaatatcataaattgtaccatcataataataagttggggaccatctgtatatcattaaacagggcaaaatgtagggctcttctggttgttttttgtttgtttgtttgtttggagacagggtatcgctctgtcgcccaggctgtggtgcagtggcatgaacctggcacactgcagcctttgccacccaggctcaagtgatctttccacctcagcttcctgagtggctgggaccacaggtgcaagtcacctcccctggctaatttttgtattttttgtagagactgtgtttccactattttgcccaggctgatctggaactcctgggctcaagcgatctgcttgcctcaacttcccaaagtgctgggatcacagacttgagccaccacaccaggcggggctcatctttttggcaaaattgtttctaatacatatggaaagagaacaattatcattttgtaactatcatagtaaagactagtttaggaaaaatcaataatactgctaaattgtgagagaggggtttgctgaggagcagaatatttgcaggaaattcaagtgtctcccccatagattgcttattagttgcaagtagaaaaccagcaatttatacagtggagaaactgggatcaaattaacatcactaatgagagacaaacaatatcacgtgcctccaaatgtggtctcttggaaagaatataacctcatgtatgtaatattacaatcaggaatacataacctgaatctaatcatgaggaaacacgagacaaacccaaagtagggaagattctgtaaaataactggcccttaacacacacacacacacacacacacactcctaagagtggtgacaatgtgttaatttgattgttgtaatcatttcacaatgtatatgaaatcatcatgctgtacaacttgaataaatacaatttttgtcaactatacctcagtaatactggaatgaacaaatgaacgaatgataaataattggcctgcactcttcaaaaatctcaatgtcacaaaaatacaaatgctgaggaactcttccatattaaaggaaattaaaaagatatggtaactaaatacggtatgtgatcctgtactagatctatactggaaggaaaaaatgttaaataaagacattactggaacaattgacaaatcggaatatgaactgtagattagattaaatataaatattgtatcaatgctaaatatccttaatttgataaacatacaagaggataccctggttcttaagaaattcacactttagaaataaggggtataagagcatagtgtatgtaacctattttagaatgattcataaaatacaaataataggcttatttatatatttatacatgtatattacacatgaagaatagtaaaaacaagtgtggcaaaatgttaagaattggttaatctgagtaaaggacaacaggagttctctattatttttacaacttttctgtaagcttaaaattatttgaaactaaaaagtttaaaaaaaaaaatgggccgggcatggaggctcacgcctgtattcctagcactttgggaagccgacgcaggcggatcacctgaggtcaggagttcgagaccagcctggccaacatggtgaaaccccgtctctactaaaaatacaaaaattagccagtcgtggtggcgcgtacctgtaaatcccagctacccgggagactgaggaaggagaatcgctggaacccaggagatggaggctgcagtgagccgagatcgagtcactgcactccagcctgggcgacagagcgagactccatctcaaaagaaaaaagaaaaagaaaaagaaatacacactaacatcaaggaaaagagctttcacttaataacagaagatctaagtttgtgcgctacttctgtttgttaaatatccttccttaagcatcacacttttctcacctgcaaaacaccatcccaaacttacagaggtctcttttgatccatacaaattatgtgtatgagagatctaactgtaaattattatacaaatgacattataatattaaatacttaggagtttgccaaaataaagaatggagttcgttttcttaaggtaccgtacacattaactacagttataacaaactacggaataagcggtagtggtgtaaacggtgttccttaaaggaaggtaatgttttttgccctgttccgtcaagtcttaaacgcttgacattttaaaatagttttaaaccctttccggaattagaagtggtatttcggaccgtgaagtaaccgatcagccataagtgtcccatctttaaggcctgctcttttacccgtcttgcagaagttcttccgagagtgggcccgagacagcctcccgcccgaactaaactctccgcagcgcttccggcccttggccccgaagtctagaaccctgggccggccgcaaaggaaggtctgccgcgcatgcgcgccccggcgcagcctatccggagcgatccatctcgttacgtcaccaccagcctagctcggacggcaagcggcgggagattttcaaaatgggagcccagaggcaccgcccaggcctcggaaggtgtcagggagaactttccgtggtttcagcgtcgtcgcctggagcggcggtttagagagccgagcctgatgggcgccaaggccggctggctgcttggagcgctgcctcgaagggactgcgtgaaggaagctaatccggagaacccaggccagagcctggaaatatggcgacctgcatcggggagaagatcgaggtgaaaagactcggcagtctgcagcggggcgggtgggagtaattgtgggaggacacgagaccgctgtgggaaggggagcgaacgaagctaacggctgcggggcgggcaccgaggtgcttagggagggtcccaacggcccagacccctgctgtttaggggcggagcggcccgcccctcaagagacaagagtagggaaggcgggacaggtgagtccctccccgcccggcagtgtcccgaggcactgcggctttctttcagcaatcccgcccgagctaccgcgttagagcagggcagggctacctcccacttctccaaggggatggcggttatctccggcgggagctgcggcgggattctgaccgagccctccgctcccggggattggctggagatgggaggagggcgcttaggctgcactgaggttgaggaaccagatcactagggtgcaccatcaccctgagcttccagtccagcctggaagcgcaggtatccccgcacggagtcaacatgccttccaccctagacacctgctgcatcgaggtgtaatacccgcttgaattttgtcaaattccccactcgatccattttatcttctttttccagccccttcccatcttcctttctactgtgagtcatcacacataatctttaattttaacttttaaggattttaaagttggaaatctgcttggtaaaggatcatttgctggtgtctacagagctgagtccattcacactggtttggaagttgcaatcaaaatggtaagaataaactaatcaacttctctcctgtactttgcaagtaactagagaggtatcagagatgtcagaaactccttgtctactagcctttcctttgattatagtgtaaggaacactttacataggcagaagacaatagtgccaagtccagccgttgaacttaaaaatattttaggaaagccttgaccttgcttaagtaagttttatcttcattaatgttcagtagacctcgtatgtggtgtaattatccatacttggagtaatgagtagaaatcaactaacaaataatttgtttatagttcactgtgtataattttgtatttccctgtaacatacaaaatattattcttgattgttagaagtcagcctaataggagtaacataaacataagcaaattaagaattatttgtcagccgggtgggtggctcacacctgtaatctcaacgctttgggaggctgaggcaggtggatcacctgagctcaggagtttgaaaacaactgtgcaacatggtgaaacctcctctctaccaaaaatacaaaaattagctgctgctgggcacggtggctcacgcctgtaatcccagcactttgggaggccgaggcgggtggatcacctgaggtcggtagttcaagaccagcctgaccaacatggagaaaccccatctctactaaaaataccaaattagccgggtgtggtgctgcacacctgtaatcccagctactctgaaggctgagcaggagaatcgcttgaacccgggaggcagaggttgtggtgagctgagatcgcgccattgcactccagcccaggcaacaagagctaaattcccatctcaaaaaaaaaaattagccaagcgtggtggcatgtgcctgtggtcccagctactcaggaggctgaggtgggaggatagattgtgcctgggaggttgaggctgcagtgaactgtgatcatgccactgcactccagcctaggtgacagtgagaccctgcctttaaaaaaaaaaaatcatttatctaaaccacttagaaaaagaactggaggttttgctctaaaatttgcctgaattgggatttttttttcttaatagttaggctagttgtgctattagattatttaaattgagataggatattagaattaattggtcaaacttttaccaagcaccctctctgccgagcactctgctaggtgcatggggaaaacagataacagtaggttgaccacaaagacgtataaaaggacttcagtctattttaaagtatactttattttcaaagttcacttttaagcagtttatatttgaaagtctgtcaacatttaaacctgttatttttagatagataagaaagccatgtacaaagcaggaatggtacagagagtccaaaatgaggtgaaaatacattgccaattgaaacatccttctatcttggaggtaagatataaattttgtagaagtgaccaaggacactgaatttttgtatattttaatttattatgccctttcacatttcagctttataactattttgaagatagcaattatgtgtatctggtattagaaatgtgccataatggagaaatgaacaggtatctaaagaatagagtgaaacccttctcagaaaatgaaggtaggtgtgtggttttttttgtttgttttgtttgggtggataaaagttttgcattttaaagtgtagttttgaggaatatgctattttataatatatagtaaaactgtttgaattattactttaagctagaaaaggagatttcctacatcccaagctgctaattcttaaaacaattcaattattacggtagtaaagtaagaaatttgttatccttctgtccttaaaaccacattttaaattaaattattggtagcagtttactgtgtatcttttcaaatgtagtaacctttttaggatgtcattggtgactataaagtagttctaaatcaagcataaatagccattgaaactgtttattatagaaaacatgaaacatacaggtagtgtgctataatgagtcccctgaacttaacactcagcttccaaaactagtgactcatggtcatattatttcatctttactgtttttactaccttgattttccaaagtattttgaagcaaattatagacatatttttaactagaaatatttcaaagtatagacttctttaaaaacgtagccacaaagtcattatcacacctaataattatttactatcaaatatatagcttcagacttcctcaatttctcataattttttgcagttcaaagcagaaccaaataaggtctatacattgacacaaatgattgttttcaagttatcttgctctgctaactgagattacagacaagctaacagaagtagttgctgataggcttcttgtacatctgaatctatataagccatttggaaaacaattcggacatatgtatttagagttacggaaatatttatattctttgactcagattccattgttggaagtttattccaaagaaataatacaaattgaaaaaaaattgatactcatcttgataatgactactgcagttttttataatacttcattaaaaaaggccttattaggctgggctcagtggctcacgcctgtaatcccagcaccttggggggctgaggcacgtagatcacctgaggtcaggagttcgagaccagcctggccaatatggtaaaaccccatctctactaaaaatgcaaaaattagccgggcacggtggctcatgcctgtcatcctagctacttgggaggctgaggtggatggatcacaaggtcaggagatcaagaccatcctggctgacatggtgaaaccccgtctctactaaaaatacaaaaaaaattagctcggtgtggtggtgctctcctgtaatcccagctactcaggaagctgaggcaggagaattgcttgaacccgggaggcagagattgcagtgaactgagattgtgccactgcactccagcctggtgacagatcaagactccatctaaaaaaaaaagcttacaaattgattacttgggaaagtttgggagacatcgttggaactttagctttttcttttttttaacaattagaaaatatgtatgaatcgtttgtgcaattgtttttcttaattgctatggttaccctaatgactctcagttgctaaaaaaaaagtaggcttctcttaactgcatgtaaaacgctcatcagttggaaataacgaagattaaaaggaatgcctagttttcttaaaggttaatatgataggccaggcgcggtggctcaagcctgaaatcccagccctttaggaggccgaggtgggtggatcacgaggtcaggagattgagaccatcctggctaacacagtgaaaccctgtctctactaaaaacacaaaaaattagccaggcacggtggcgggcgcctgtagtcccagctactcgggaggctgaggcaggagaatggcatgaacccgggaggcggagcttgctgtgagccgagatcgcgccactgcactccagcctgagggacacagcaagactccgtctcaaaaaaaaaaaaaaaaaaaaaggttaatatgatctctttagaggggtgtgttggtaccactctgataattgctggtaattgaagtggctggtaaatctaagctccaagccactgttctactacagtgctctagaatatttacctgggtttcataatgtatactaaatactagatactgaatcttccagagtttctaaattgtaaattctcttttttaaaatcctaacagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactgtaagaataattctatcagaggcattttgttttttggtaacattatactagtataaatatgaagctgcatgtaagcggggggataccagggaaatgaatgtctaaaaaaaaaaaccactgtcatgattttgacctgtggttaacagtcttaacaggagtgtgtgtgttcatgaatgtgtttataaaattgtttaatatttggaaatttttagcctcattttttaattttatatggagtgagtctccagtgcaaagtatcatatatattagtcatgccttaccccctaaagtacttaataataactgtatacatagatagaaaagctgagattgagtggtcataattctgactgcttccaatatgaaaactaattttcagtgactgtattgtgtgttttttttctttttctgttcattttgtgatttttatgcttaaattataagagggcagtagccatacagaaatgctgtcaaagtgccctgggcattttggcatgggagtttagctttttaaagatagcatagttatgccaatattgttttctatagttattctaaaatgttcaggtattcaaatcagaagaaatccttctctaatatttttaccttaaaaagttacctgataattttttattagtttatgggatttttttgtttgtttgtttagctccaatcatctttgtccaggaaaaactccttttccatttgcagacccgacacctcagactgaaaccgtacaacagtggtttgggaatctgcaaataaatggtgagtttttaatggagtatttaatcaagaattaattacttggaaacttaccaagcattgcagtgttctatttgagatttttaaagaaaatcattttcttgcttggtgcagtagctcatgcctgtaatcccaacacttgtgaggccaggactggtggattgcttgagggcaggagttcaagaccagtttgggcacatagcaagaccctgtatctacaaaaaataaaaaattagttgagtgtggtggcatgtacctgtagtcccagctacttgagaagctgaggcaggaggattgcctgagctcaggagttcaaggccgcagtgagctatgatcacactgcactccagcctgtgtgacagagagagagaccctgtcaaaaaaaaaaaaaaaaaaaaagcattggccaggcgtggtggctcatgcctgtaatcctagtactttgggaggccaagccaggcaggtaacttgaggtcaggcattcgagaccaccctggccaacatggtgaaaccccgtctctactaaaaatacaaaaattagctgggtttgctggcacacacctgtaatcccacctactcggatggctgaggcacaagaatcgcttgaaccagggagacagaggttgcagtgagctgagatcacgccactgcactccagtctaggtgatagagctagactgtctcaaaaaaaaaaaaaaaaaaaaaaaaaaaaaaaaaaagcattttcagtacgtctcaataaagctctgttacaatatttgaatatttgctgtaagtcagccactgtccttaatgtttaacatatattaagttctcacaaaaaaacatgaggaagatactgttattatctccgtcttacagatgaggaaactgggtacacagagcttaatttgcccaagctatgtgaccattcagcagaggagccagggttcgaacataagtagtctggctcagagactttattcttaacccctgctcttgcagcctctctataatcagcaccttctatcagtgcccataaaataatgaaaagatgattgaccttatttttaagtggaagctgataaggacagtatagggtaccaatgggacctcacactaaagtacagagctactaaaacctaaatatttttaaacagctatcatccaagtcatgttgtttataatacagagtttgaaggttaaacattcctcattaatgaacatgacagattcacagaaggtgaattgggaaataatgatggaaaaaagaataaaagagacatatggagaggaggagatcattttttactaagtatcgtattacctcatagacaaaaagcaaataacacagctgtaatttaatcagagagttgtatgttatcttgagtctattctctttttttaatgtatattattctcagaagcccaaaaggaaattaatctttttatttatagtaattagagatgataattcaggtttgttttttaaactataaaactgccacatacttaattttgcacatctgttgtgtttacagatacttatatttagtaacacagacttgtctgagatggagaaataaccttgtttataataatccagtagtgttcctgcaatttttcagtatattatttgatacaaaatactttctgtcataaggagagtggggggaaagcactaaaaagtcatttaagaaaaaaaatataattcaaatttttagtttagcattgaaaaattgccttaccaagttttatataatctgatcatttaaagcctgtaaaagatactgttctgtatgtgaactttaaaaccatacaaaataaaaattggtaaacttaattacttttttaaaaaatgctggtgcaagtacatgtgtaatattaaatattaatgttaaagctgttcatatagtgtttttgcttttagttgcatattttcattaattgcaggtatttctaagtaaagatgggctagacagttcttagcttaaagagagtaagtttatatatttttctcatgtagaatgattacttgggaactcaaatctgcttttgttggcacattggcagttgcatgctttaggattaataggtgaccatatagtgactagtttttgccttaattgaaaaattaattttatgttaatatcttttgtgtcttagtcttaggaatactaaaggtatttcttcacgatctggtttaaaatgttctttcaaagtcatgtcttaaactgcttatttgttagaaaattatgagctcttattgttttgttttttgtaactagaattcttttgttcaaaaaatgctattacaatcagagtgacgttattttgtgtcgacttgtgtttttagttatttactaaattgcttcattctatgtatattgtagctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtatgtctgttatcttcttaagttactaaataacattttacttgagaatacaattcttgagaacatattttttagtcctctgtaatgtccttttactttggggtgtatacatgatcaactttattaaagagaaaagagactgggtgtttatggaaaaacagctcttatttccctctatcttcttaattatagtgacatgatactggtaagttttgaattttaaattattaatttaaagtagatttgaatgaaaaacattttaaaataatactggctatatgctggttaaagattattttgttcacaattccaatcagtgagctaatattatcctttgcttctatttttattgtttgtaaatttaatcccatctcaaattttaaaaaactggaaaatataacttttatttttttagcttctggaactaaagaaaaggcatatacacatttaagtttagagtttaaaaattattgtatgtgaattgagaatggtgtgtgtttttttaattctatctttatcctgttgtttgttcccattttacttcccatttcatccttgcctttgtttggcttgctattatcttttcaaagtccttattctccactctaccttctgtttgctttctgctcattgattatcacttcacacttcattatacattcttaactttgcaccatatggttcacagttgtgctcaaatatacctctgatctggactgttgtagtgaagcagctttgattttgacttcaatatttgtttctgccatggttaagtactcctaagtattatgtatgtcagagctgttctagtaaacaaaagaattattactgattttgggttttttttttttttaggtgagcatacttgattcagaggaggtgtgtgtggagcttgtaaaggagtatgcatctcaagaatatgtgaaagaagttcttcagatatctagtgatggaaatacggtaatgtgtagttactttattaccttgcaacttcaaattatcgtttaagcacgtttagcattctaattcattttacaatgatgtaagtttttttaaaatcagtttgccagtatgatagtgtctctggaattcaaaaattgaaatagcatattaaacatatttaaataaattggtgcagtgttaaaaataattatatctagtaagaaaatctaaacttttggtttaagttaaaaagcaaaaaaattacttttacagaatatttaacatttttctataaaataatatttaatgttacatttaaacactttgtatacgttttagcaagatatagtactggaacttaatggcatgtaattagaattttaaaaaaatcttttggcagatcactatttattatccaaatggtggtagaggttttcctcttgctgatagaccaccctcacctactgacaacatcagtaggtacagctttgacaatttaccaggtatgtgaatttaccagggaataaattttgatagtagatttatatgtatatacgtataaactctatatatagatataataaattataaatagcttcagtcaaactttaggtcatatcatattcttgtactttgtttctggtgagagttgtatgcctttaatgcaatgtttattattaatattctgtgttataatggtactatattctatttaaaaactaactctagaacattagtcatatgtctcacaaatgtaatttgtatacttgtttagaatgtggctatagttatgttaaaaaaaattcaacattgtgcttgcttcagagcacatatactaaagttggaatgttacagagaacatggcccctgtgactcacaaatttgtgaagcattctgcatttaaaaaataattcaccatgtatgtggcttttgagctttgaaatcagtgctgctacataaatgattatttataattatagttaaccaaatttgactcccagtttggtttctggatattatggactatggacataagtactgaatagtaagccttcattgaggtaactcttagaaaagaataagaaaacctgtctaatgtaaccctattagaaatcacaataaatagataaaactgtatgtcaggtcaacactttcttccctaatgttaagtattttttttccttagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggtaagtaccatttggaaatggtaatttgttcctttagtttgtaatttagtagttacgtatatgtgggtttttaaaattcaacacagtcagttttaaagatgtgtatgtatataactatacatataaattgcacagcggagtatacatgtcaaatcatattaatcaaaatttatctagccttcctttaaacaatttatcctataatatgtatattagtcctctttttctacttagctccagtttaactacgtctaggctgatggtataaaaatcacatgaaatgcgcaatgtcctatttcttattagaaaccttaaatggacatataccaaattatgagaattataaatgtagcaaaaaggatagggttgagtctaaatctattctgtaaagatgaatgttcttattttctaaatctattctataaagatgaactattttttaatctataaacctcctttaagggacgcaaagcattcatatcacacagtacacatataattatagctatccttcaattatgtttttgtatgaatatagtgattttttaaaatgtaaaagtatcaggcttaaaccagatatatgttgggaaaaaaatggatgatccatatttattgaatgctttgatagtctcattttattaatagtcaataaatgaataaaaatgataccttgatccaggagccattatatactggtatgataataaatataaatctaggaatatttttaaaaaggataagagaacagttttctgattttttttttttaggggtaaaaatacacaaaacagaagatttcattcaggtgattgaaaagacagggaagtcttacactttaaaaagtgaaagtgaagttaatagcttgaaagaggagataaaaatgtatatggaccatgctaatgaggtacatacctaattgtaggtttttcataccaattaataatgattgcaaatgacataggtgaaacaatgacagaagcactcttcttttgaaatagggtcatcgtatttgtttagcactggaatccataatttcagaagaggaaaggaaaactaggagtgctccctttttcccaataatcataggaaggtaaatgtctgaaaattttaaacatatggctaaaatgttttaaaagtttgatgtttatattataaacattctttagttttctgtaaattgaaagcttcaagggaatatatttggacttttccccttcagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctgtaagtaaatatatgtcacttctgtactttaaacctttcaatgattgcctgatgcccttcttgtaaaatagtttattgtggctttactatcatctacgtacttttccagcctcatcctgagccactttatcccatactatttatgtttgagcgtcaaaggccttctttcagttctttaaacaagtcaaagggccttttcacatgctgttcacttgacctggaactcttttccccaaccacttaactttatatgtgtaagtcttatttttcaagtctctgtttaaatgttacctcaatgagccctaatctcagccctctggggaaagctaagtgtattaacatatacatatgtagtttttttttttgtttttttgagacggagtcacccaggctggagtgcagtggcacgatctcggctcactgcaagctccacctcctgggttcacgccattcttctgcctcagcctcccgagtagctgggactacaggcgaccgccaccatgcctggctaattttttttgtattttcagtagagacggggtttcaccatgttagccaggatggtctcaatctcctgaacttgtgatccacctgcctcggcctcccaaagtgctgggattacaggcgtgagccaccacgcctggctagttgttttatttttactagtaaaatatcattaactgcctaaatgctcatgatagactcatgattaaatttattatatatttaatgaacatggcgatgaagattatatagcagtgtagaaaaatgcaacattaaagaaataggtgtgtatatttgtgtgtactcacccacatacacaaaaagaacatgccatgggataaaaagatgaaagaaatccaccaaaatgaaaacagcaattgtgcaggagggtggggggttcttttctgtatttttctaatttccaataatgtggttatattttcgttaaaaaatgtttgtttttaaaaaaattaagctaatgaaaaatctcataattgtctgcttttgctgaatgtggcttataaaaatgctgaggaataatatcttcctgtcctttattctttgtagatggttacaaatgaaggacttggtcttacaactacagcttctggaacagacatctcttctaatagtctaaaagattgtcttcctaaatcagcacaacttttgaaatctgtttttgtgaaaaatgttggttgggctacacaggtgagaagtttctagtacagtgcattttctcagtatgaatttcttttcattttcacactgataagacaattaccaaaaaatacaaattattgtaatgatatctttttacaaggaagtttttgtaccttttaacattggttatatcattaaaaattttaacttcttaaatttgtattcagttggaagactccagacattgctgataagaggttgcctgctaggcttgggtgacctacttttgccatttgtttttaaagtagaggtcatgataattactaattgtgaagagtagagtgtgatatctgggacgttttaaattttggaaattatttgtaatcaatattagtagagtaactttcttttttttttttttttttttttttttttgagacaaagtctcacactgcaagctccgcctcctgggttgacaccattctcctgcctcagcctcccgagtagctgggactacaggcgcccactgccaagccgggctaattttttctatttttagtagagacggggtttcaccatgttagccaggatggtctcaatcccctgaccttgtgatctgcctgcctcagcctcccaaagtgctgagattacaggcgtgagccactgcccccggccagtagagtaactttcatctggcaaaagaagaaaaggatttttccattaaaagtcatgtgaaagccaggtgtgatgtcacgtgcctatagtcccagttactcaagaatctgaggtgggagggtcatttgagtccaggagtttgaggccagcctgggcaacaaagcaagaccccatcttttttaaaaagtgaagtcaatattgagtttcaaacttatagaattttatgtagttgtgaacctatatgtgtatattatctaaaatcttgaaacttggagagacttctgagcctgacacatgtacttttacttaacagtgaagtaaatgcaacctagtactttatgggggtaggtaacatttgttgagcacctgctttgtggtacctaccatgtttttcacatactttgtctagtttatcccccaaaataacctagtaaagttgtatctccttttatagatagtaaaattatgcttcataatggtagattaacttgcacaatcctacactgtactcttaagttggcagagtctagatgtaagcctaggtgtgtttgatttggcgtccatgtactatgcacttctccattttgagtgacacattgtgactattaatgactaaaggaagaagtttcagaggctaaaatgtaatattctcaggccaggaaagaaattcttgtggcttaaggacaaagaaaatgttgcttttattccctaaatctcttcttgttaagaaatactaaatatttcttgtgggggaaaaaaaccaacaaccaaaaaacttagaaatcctaatggaaattaatgggaaacaggattcactttctaataattttaatattgtaataccttagctattaaaggaataatctgaaaaagacatgaatattctcagtgctctgccatcgtagccccaaatttgtagtcacttagagagttttttttttaactgtggaaaacctgttaaatatgttaaatattaatacagaaccacaaaccctctactgtatagtaattttgtgtgctactactgctgtttttttttttttctgtgcctgttcttacccatgcttattatttttctagttaactagtggagctgtgtgggttcagtttaatgatgggtcccagttggttgtgcaggcaggagtgtcttctatcagttatacctcaccaaatggtcaaacaactaggtaagttcttaaaatactggtcgagattcagccctttgctataatttctctttctctatatgttgaaatggatgatttaataaagatacttctttcattttgacaatgatcgtgtgattctttaaactgttaattattcttagcaattcatgtagtcattaatgcatattttatgattatctgtattaactcagggcaattggtataaataatccactctaagaggttgggttccttgtagccttactgttccatagtgtaactcgatggcctttttcagaagtaagggactcctaattctaggttcaaataatataccaaacctatttacttaaaagaacagaaaaaagaaatctttaagatataacctgcttatttttcccaaatgaaaggctatatccccaatctaatgtaacgtgattaatgtttgaaagacttttttgaatgtgtatattcattctatatgaaaatatgtgtcaggcaccaagccaaaaataaagaatctggcaatatgaaaaacaaggagttatttgctttcctcatttaaatcagaacttactaaaagtagggtactgacgatgccaatgcaggcgttctcttttatgagaagtgcttattgtaatggaagtacttgggacaaatataatctgtagatacctaccaactgcatttttgtgttaaatttagataatgcagtgccatcacttaaataactatgtttcaagtgagaggctttgttaaaagctctttgaggtgctccagaaagtggaaggatgcagatgcaaagtgggtaaaacccttgttcccaggatacatgttgacattttatttgctatggtcatttggaaaatgttaacatttaaatagaaatatattcataatgtgtttagcttggtatttttctgtagaattagggcttttttttttttttttttttttttttttttttttgagacagagtctcgctctgttgcccaggctcgagttagtggtgcgacttggctcactgcaacttctgcctcctgggttcaagcagttctcctgcctcagcctcctgagtagctgagattacaggcatacgccaccacacctggctaattttgtatttttagtagagacagggtttcaacatattggccaggctggtctcaaacacctgacctcgtaatccaccccccttggcctcccaaagtgctgggattacaggcattaaccaccgcgcctgtccggggccttttaaatttaatgaggaatccagatttttggcttgcttttgaaattacgaagccagttcaagtttatctaattttccttctgttacttaaatgtgtttagaaaatggtctgttttaaaagaaaagaaactgtatgcttcacttgatttaggtatctaataaataattgttataatttttctgaggtgcctcttgttattgaagaattactgaaaaatataatgtgctttttgggactctcatgagaaccaagtaattcagttacgattttgtctttttttcttttgcttcacttaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttacattatcttttgattcatttaattaaatacttatttttaaataacttaccagtaaactcactttttaaattttgttgcctgttgaggagccaattaaattttaaatattaattttgcaaatgttaaatacattgtttctctattatctgaaaatcttggtatattttaatgaatttttttaaattatacattaagttctgggttacatgtgcagaacatgcagttttgttacataggtatacatgtgccatggtagtttgctgcacccatcaaccggtcacctacattaggtatttctcgtaatgttatccctcccctaacctcccatcccccacaggccccagtgtgtgatgttcccctccctaggtccatgtgtttttgtgggtttgtttttttttttttgagacagagtctcactctgtcgcccaggctggagtgcaatggcacgatctcgggtcactgcaacctctgcctcccaggttcaagcgattctcctgcctcagcctcccaagtagctgggattacaggtgcatgccaccatacccagctaatttttgtatttttagtagagatggggtttcgccatgttggccaggctggtcttgaacccctgacctcaggtgatctgcccgccttggcctcccaaagtacttggattacaggcatgaggcaccacacccagccccatgtgttcttattgttcagcttccacttatgaatgagaacatgcagtgtttggttttctgatcttgtgatagtttgctgagaatgatggtttccagcttcaagtccctgcaaaggacatgaactcatcctttttcatggctgcatagtattccatggtgtataagtgccacattttcttaatccagtctatcattaaggggcatttgggttggttccaagtctttgctattaggaatagtgctgccgcaataaacataacgtgtgcatgtgtctttatcgtagaaagatttataatgctttgggtatatgcccagtaatgggattgctgggtcaaatggtatttctagttctagatcctcgaggaatctccacactgtcttccacaatggttgaactaatttacactcccaccaacagtgtaaaagcattcctatttttccacaacctctccagcatctgttgtttcttgactttttaatgattgccattctaactggcatgagatggtatctcattgtggttttgatttgtatttctctaatgaccagtgatgatgagaattttttcatatgtctgttggctgcataaatgtcttcttttgagaagtgtctgttcatatcctttacccagtttttgatgaggttgtttgcttttttcttgtacatttgtttaagttctttgtaaattctggatattaccctttctcagatggatagattgcaaaaattttctcccattctgtaggttgcctgttcactctgatgatagtttcttttgctgtgcagaaactctttagttgaattagatcccgtcaattttggcttttgttgccattgcttttggttttttagacatgaagtctttgcccatgcctatgtcctgaatggtattgcccaggttttcttctagggtttttatggtcctaggtcatacatttaagtctttaatccatcttgagttgatttttatataaggtgtaaggaaggggtccagtttcagttttctgcatatggctacccagttttcccaacaccatttattaaataggcaatctttccccattgcttgtgtcaggtttgtcaaagatcaggtggttgtagatgtgtggtgttatttctgaggcttctgttctgttccattggtctatatatctgttttggtaccagtaccatgctgttttggttactgtagccttgtagtaaaatttgaactcaggtagcgtgatgcctccagttttgtccttcttgtccaggattgtcttggctatacgggctcctttttggttccatatgaagtttaaagtagttttttccaattctgtgaagaaagtcagtggtagcttgatggggatagcattgaatccataagttactttggacagtatggccatttttacaatattgattcttcttatccatgagcatggaatgtttttccatttgtttgtgccttctcttacttctttgagcagtggcttatagttctccttgaagaggtccttcacatcccttgtaagttgtattcctagatattttattctctttatagtaattgtgaatggcagttcactcatgatttggctctctctttttctgttattggtgtataggaatgcttgtgatttttgcacattgattttgtatcctgagactttgctgaagttgcttatcagcttaaggagatttgggactgagacgatggggttttctaagtagacaatcatgtcatctgcaaacagagacaatttgacttcctctcttcctgtttgaatacgctttattgctttctcttgcctgattgccctggccagaacttccaatactgtgttgaataggagatgtgaaagagggcatccttgtctcgtgctggttttcaaagggaatgcttccagtttttgcccattcaatatgatattggctgtgggtttgtcataaatagctcttattattttgagatacgttctatcaatgcctagtttattaagagtttttagcatgaaaggctgttgaattttgtcgaaggtcttttctgcatctattgagataatcgtggtttttgtcgttggttctgtttctgtgatggattatgttgattgatttgtgtatgttgaaccagccttgcatcccagggatgaagccaacttgatcgtggtggataagctttttgatgtgctgctggattcggtttgccattattttattgaggattttcacatcaatgttcatcaaggatattggcctaaaattctcttttttttggcctcataaaatgagttagggaggattccctctttttccattgatcggaatagtttcagaaggaatggtaccagctcctctttgtacctctggtagaatttggctgtgaatctgtctggtactggactttttttggttggtaggctattattgcctcaatttcagaacctgttactggtctattcagagattcaacttcttcctggtttagtcttgggagggtgtatgtgtccaggaatttatccatttcttctagattttctagtttatttgtgtagaggtgtttatagtattctctaatggtagtttgtatttttgtgggatcggtggtgatatcccctttatcatttttattgcatctgtttgattcttctctctttattattagtcttgctagcggcctatctatcttgttgatcttttcaaaaaaccagctcctggattcattgatttttttgaagggttttttgcatctctatctccttcagttctgctctgatcttagttatttcttgtcttctgttagcttttgaatttgtttgctcttgtttctctagttcttttaactgtgatgttagggtgtgaattttagatctctcccgctttctcttgtgggcatttagtgctataaattcccctctacacactgctttaaatgtgtcccagagattctggtacattgtatctttgttctcattggtttcaaagaacatctttatttctgccttcattttgttatttacccagtagtaactcaggagcaggttgttcagtttccatgtagttgtgcagttttgagtgagattcttaatcctaaattctaatttgattgcactgtggtccgagagacagcttgtgatttctgtttgtttacacttgatgaggagtgttttagttccaattatgtggtcaattttaaaataagtgcgatgtggtgctgacaagaacgtatattctgttgatttgggatggagagttctgtagatgtctattaggtctgcttggtccagagctgagttcaagtcctggatatccttattcattttctgtctcattgatctgtctaatattgacaatggggtgttaaagtctcccattattatgtgggagtctaagtctctgcacatctctaagaacttgctttatgaatctgggtgctcctgtattgggtgcatatatatttaggatcattagttcttattgatacctttaccattatgtaatggccttctttgtctcttttgatctttgttggtttaaagtctgttttatcagagaccagattgcaacccctgcttttttttgctttccatttgcttggtagatcttcctccatccctttattttgagcctatgtgtgtctttgcacgtgacatgagtctcctgaatacaacacaccgatgggtcttgactgtttatccaatttgccagtctgtgtcttttcattggggcatttagcccatttacatttaaggttaatattgttatgtgtgaatttgatcctgtaattatgatgctagctgcatatttcgcccattaattgatgcagttttttcatagcatcgatggtctttataatttggcatgtttttgcagtggctggtaccagttgttcctttccatgtttagtgcttccttcagtagctcttgtaaggcaggcctggtggtgacaaaatccctcagcatttgcttgtctgtaaaggattttatttctctttcacttatgaagcttagtttggctggatataaaattctggattgaaaattcttttaagaatgttgaatattggcccccactctcttctggtttgtagggtttctgccaagagatccgctgttagtctgatgggcttccctttgtgggtaacccgacctttctctctggctgcccttaacattttttccttcatttcaaccttgatgaatgtgatgattatgtgtcttggagttgctcttctcaaggagtatctttgtggcgttctctgtgtttcctgaatttgaatgttggcctgccttgctaggttggggaagttctcctggataatatcctgaaaagtgttttctaacttggttccattctccccgtcactttcaggtacaccagtcaaacacagatttggtcttttcacagagtcccatatttcttggaggctttgtttgtttcttttcactcttttttctctaatcttgtcttcttgctttatttcattaatttgatcttcaatcactgatatcctttcttccacttgatcaaatcggctattgaagcttgtgtatgctttacaaagttctcgtactgtggttttcaggtccatcaggtcatttaagctcttctctacactggttattctagttagccattcgttttatgaatgaaaaagccattcaaggtttttagcttctttgcaatgggttagaacatgctcctttagctcggagaagtttgttattaccaaccttctgaagcctacttctgtcaactcatcaaactcattctccatccagttccgttcccttgctggcaaagagttgtgttcctttggaggagaagaggcattctggttttggggattttctgcctttctgccctggtttctccccatctttgtggttttatctacctttggtctttgatgatggtgacctgcagatagggttttggtgtgggtgtccttttcgttgatgttgatgctattcctttcagtttgttagttttccttctaacagtcaggcccttcagctgcaggtctgttggagtttgctggaggtccactccagaccctgtttgcctgagtatcaccagcagaggctgcagaacagcaaatattgctgcctgatgcttcctctggaagctttgcccagaggggcacccgcctgtatgaggtgtctgtcagcccctactgggaggtgtctcccagtcaggctacacagtggtcagggaccaacttgagaaggcagtctgtctgttatcagagctcatacactgtactgggagaaccactgctctcttcagagctgtcaggcagggacgtttaagtctggagaagctgtctgctgcctttggtcagatatgccctgcccccaaaggtggaatctagagaggcagcaggccttgctgagctgcagtttgagcttccctgccacttagtttacactgtgagcatagaaccgcctactcaagcctcagcagtggcggacattcctccccccgccatgctcccatgtcccaggtcgatctcagactgctgcactaggagcaagcaaggctccgttggcgtgggacctgccaagccaggcatgggagtggattcttgttctgctgcttgcaaagaccatgggaaaaacgcagtatttgggcaggagtgtactgctcctccaggtacagtcactcatggcttccctttgctaggaaagggaaatctcccaaccccttgtgcttcctgggtgaggtgacatcccatcctgctttggctcgccctccgtgggctgcacccagtatccaaccagtcccaatgagaagaactaggtacctcagttggaaatgcagaaatcacccatcctctgcgtcgatcttgctgggagttgtagaccagagctgttcttattccttaatgaaatattttaacactgaagaacttgatgcaattaattgacatgatgaaaaaatatgtgatagtgggatagccattcctaatgaaggaataagaatagaatgaaacaacttcaatatcataaagactgtttaacctaatgtgtcctgctggtttttataatcagaaatattagagctgtttcttttaagtagacaagtagacaatgttatgattattcaacattgttttggaggtttttgcctcagacaataaggaagaaaaataatacttatatttgcaacataaattgcagaactgatattaaactaccaccatacccctctcccagagaaaaccagtaacagaaaaaaggggattgaaggaaattttctgttgtcacacagtagaaaaatggacaagacatatgaattgatagttcacaaaggaaggaagtccatatggtcaataaaaaggaaatatgctcaacctcataaaagttggggaaatgcaaagttaaagcaagataataattttcctttatcaaagaatgggtttaagattaagtaatagcccagtgcagtggctcatgcctgtaatcccagcactttgggaggccaaggcaggcaggtcccctgaggtcaggagttcaataccagcctggccaacatggtgaagcagtgtctctactaaaaatacaaaaattagcgaggttaggtggtgcacgcctctaatcccagccacttgggagactgaggcacgagaatctctagaacccgggaggtggaggttgcagtgaactgagatagcgccactgcactccagcctgggtgacagagcaaggctctgtctttaaaaaaaaaaaaaaaattgaaataataatgctcacaatatgtataagacattctcaggtgttgattagggtgtaaatgataactgtgaaagtaatatggcagtatctataagaattaccacattgataatccaactttggggaaaggaaggatgtaagcccttagagaaaatatgatcagtaataacaatttccctttaaaaattgaaataaaatgccaggcacagtggctcatgcctgtaatcctaacactttgggaggccaaggcgggtgaatcacttgaggtcaggagttcaagaccagcctggcaaacatggtgaaaccccatctctactaaaaatacaaaaattagctgggcatggtggcacacgcctgtaatcccagctactcgggaggctgaggcaggagaattgcttgaacctgggagacagaggttgcagtgagccaagatcatgccactgcactccagcctgggcaacagagcaagactctgtctcaaaaataaataaaataaaaatggaaataaagtaatcccgagctaaattttattttattttattattttttttagacggagtcgccttctgtcacccaggctggagtgcagtggcatgatctcggctcactgcaacctctgcctctcaggttcaagcgattcatctgcctcagcctcccaaatagctggaattgtagacatgtgccaccatgcccagctaatttttgtatttttagtagagatggggtttcaacatgttggccaggctggtcccgaactcctgacctcaagtgatccacctgtctcggcctccgagagtgctgggattacaggcgtgagccaccgcacctggcctgagctaaattttaaaggccaatgactcaaaacatacatttctgctttgacagatgttaactagtatactttttattatctcttcgtctttatgagtgagtctattttttaagtatttttcttatacataacatatagctaaattttattttgattacaatttaataacttctaatttttacatatattgttatttctggctgtcttattgtcattacagttctatttggatttatgtctagcaattaattttgtgctttctagcatgtactatatttttgctttgcttttctttttttcctgttacttctttcaagctgagtttcctttaatccccttttttctctctactcgttttctctgggggaggggtatggtggtagtttaatattcaatgtttatattactgtgactatgaaaatattcatagctccgccaggcgcagtggctcacacctgtaatcccagcactttgggaggccaagggaggcggatcacctgaggtcgggagttcgagatcagcatgaccaacatgaagaaacctcatctctactaaaaatacaaaattagccaggcatggtggcacatgcctgtaatcctagctactctggaggctgaggcaggagaaactccaggaagcagaggttgcggtgagccgagatcgcaccatagcattccagcctgagcaacaaaagcgaaactccatctcaaaaaaaaaaaaagaaagaaaaagaaaaaaagaaaatactcacagctgaactatgtactatgctagaattatatttcttgaacaattttttttctggaattcttttgttttctctgatatgtcaggtaatctgtctgtgcttttttgttgatccatttatcccctcttttggagacatctctctgctttcctttttctacctggactggttcctttgtagttttccagtgtaggaatgtacagcagtttgtttatatgttatactgttgatggacatttgagttgtttccagattttggctgtaaatatatactttatgaacatcttctggtgcagctacatacaagtttctctaggattttactgcaatgaatttagtaatcttacgatttgtgtatgtcaaactttagtagataacgcctaatttttttacacttccatttgcagcatataaaagtatattttgcttcacatcctcgccagaacttggtgttagagtctcttaaaattattgccagtttgatagaatagtgtaaggccaggcacattggctgtaattgtagcactttgggaggcagaaaggtagcttgaggccaggtgttcaagaacagtgtatcaatgtggttttaacttgaattctcctcattactaaagaggttgaaatgttaaatgtttattagatatttgtcttgtgatttgcctgttaatatcttttgcctattttttcctattgtgttgtctggctttttcttagtggtttttaagagttctcagtatgggctgtgcgcggtgactcacacctgtaatcccagcactttgggaggccaaagcgagcggatcacgaggtcaggagatcaagaccatcctggctaacacggtgaaaccctgtctctactaaaaatacaaaaaattagccaggcatagtggcgggcgcctgtagttcccgctactcgggaggctgaggcaagagaatggcatgaaccgggaggcggagcttgcagtgagccgagatcgcgccactgcactccagcctcggcgacagagagagagactccgtctcaaaagataaaaaaaattaaaattaaaaaataaaagttatcagtatgtatccttcgtttattgatatatgttgcaaatatcttctccctttctatgcttgtccttttttaaaatatatatatatttctaaaatactttattaacacgtatgtaaggaaaacatgttaccaatgctagaagacatcctccttaattaagttggcgagaggtaccacattctccacaggctggatggcgccagtggattttggcagatttcactggagaaagaaaatgccaggctgacaacctttatattccttatggaagacgttgttttgtaaaattcccatttgggacaatatccatctctgagatctttcaaaggaagctcacaaagtatcccagaggataactgacacggagctaaacatgacatgggagtgaaaacagttatctgttttcctagtgagcatgatacaggaaaattagcgtttgggacaaagatgacatttctaaatgattggatcaatcagtgcaacattaaaccaaatttagaacagataaaaactaaacaggcaagatgaaatgcacagaaggcaccaagtacacattcttcatagataaaaacctcgaacacttatgaaaatctttatcagttcttaaacatattgctaggagcataaacatattgctctgtgtatcagagaaggtcactatttcatcataattgtttcataaacgtaggaccagttcttgttttccagtaacaacaacaacaataataggaataatagcagccaatattcattgaatgattactacacaccaggcatttctctgagaactctgtaaattgtctctacctatctgtgtataggcttgtcctttcactctcctaatagtatcttttgataaacagaagttcttaactttaatattatccaattatgcaatctttctttatggctagtgttttttttttttctatttctttctttagttacatacaaagttgcaaagatattcttctagattgccttccaaaacatatggtttgttttactttcataagtgtataatgtggaaagttttttgttgttgttgttgttgttgttgttttttgagacggagtctcactctgtccccaggctggagtgcagtggcgcgatctcggctcactgcaagctccgcctcccggcttcacgccattctcctgcctcagcctcctgagtagctgggactaccggcgcccgccaccacgcccagctaattttttgtatttttagtagagacggggtttcaccgtgttagccaggatggtcttgatctcctgacctcgtgatctgcccgccttggcctcccaaagtgctgggattacaggcgtgaaccactgcgcccggcccaaccaatcagctttttaagtccttcacttaaaagctattttattatggaaagattcctacaaatataaatggactagcatgatgagcccccatgtaaccatcactcagcttcaatagttagcatgtggcgaatcttgtatcacttgtacctcattttatcctctcccagctagattatttagaagaaaatcctaggcatcataccatctcatcccaccacagcctcttaagtagctgggactataagcacatgccaccatgcctggctctttgtatatttttagtagagatggggtctcgtcatgttgcccaggttggattctagtcttcttagtttaaaagaatttaaacaagagacacacagcgaaggagatgcagcatagggcaatttatcggaaaggaaaaagaatatttcgaaagttaactgcagaatagacagcacaccctaaaagagagaggatcctgggcatgctgctcataaggatgagacaacattgattattgctaaggaggtggaaagaagtgttactagtaagcatgttctgagtgacgtcctggctgcatatgtgcagtagctgtacgtgctcgttcatatgttccatgtctcattagcatcttaaatctccatgcagggttgtgtttttcactcttataacaagcaaagggtcagtttgaggacaggcaaaatcaaaatcagggaaaatttcctactgaagattgctttgcttgaatgagcgttaactgcaatgcgaatgctgaggcttatcatgtcgccacatttgccatgccccacggacattgtcacttccttgactacctatcctgccttataactacgatccatttccagaacttttcatcaccccaaattctgtacccattaaataacaacttcccatttgctcctctgtctagcccttggtaacctctgttctactttctgtctctataaatttgcatattctgggtaccttgtgtaagtagaatcatacaatgtttatacttttttgtctggcttatttcatttagcataatgtcttcaaggttcatccatattgtatcatgtatcaatatttaattccttttttaggctgaataatattccattgtatttacatactgtaccatgttttgtttatccattcatccactgatggactcttgagttacttccaccttttgagtattataaatatctttctttagctttttgtgctgggtacataattggtttattttctactgtcatttttattgatatagatatttaatgttactcattttcctctgaaatctgttttagctgcatccattctgatatgttatcttttcagtattattttttcaagaaattctgtgatttcagttcatatttcttctatgacctaagtttgttacaaagcatgttttacaaattaatttttaaggaagtgtccaatatatacagaagtagatgggatagtataatctatctcactgtactaatcactcagcttcaaaaattatcaaaacttatcaattttatttcaatatctgcccatttccttcctgaaactgtattatgtattgcttggcaatggggttatgttctgagaaatgcatcattaagtgagttcattgttgtgtgaacatcatagagtgtacttacacaatcctagatggtatagcctactacatacctagactatatggtatagcctattgtttgtaggctacaaacctgtacagcatgttaccgtactgaagactgtgggcagttgtaacacagtggtaagcatttgtgtatctaaacatatctaaacatagaaaaggtacagtaaaaaatgtgatatgaaagaaaaaaatggtacatctgtatacatctgtgtacacttaccatgaatggagcctgcaggactagaatttgtactcagtgagtcagtgagtgagtggtgagtaaatgtgactatacacttaggctgtactacatttataacatctgtttttttttgtttgttttttctttttttgagatggagtcttgctctgtcacccaggctggagtgcagtggtgcgatcttggctgcaacccctgcctccagggcttatatgatcctcctgcctcagcctcctcagtagctgggactacaggcgcgtgccaccatacccggttaattttttgtatttttagtagagatgggatttcaacgtgttcaccaggctggtgtcaaactcctgatcttatgtgatccacctgcctcggcctcccaaagcactgggataacaggcatgagccaccacgcccggccgaattatacttttcagaattcgttgtttcattgctttggtattcttttccaagatttatatgtacgttaaatcatctgtgcctagtttctacatgtattgctttctcacaataattttttattttatttttattttttttgagacagagtctcactttgtcacccaggctggagtgcagtggcgtgatcttggctcactgcaacctctgactcctgggttcaagcgattctcctgcctcagcctcctgagtaactgggattacaggcgcacgccaccatgcccagctaaattttttttgtatttttagtagagacggggtttcaccatgttgatcaggctggtctcgaactcctgatctcaggtgatctgcccacctcagcctcccaaagtgctgggattacaggcatgagccaccacactcagccttatttaagttattttgatttcccctcatcttttattttcttatgaagttatttgtgataattaaatcacttttgtgttccttttaatttggtcttcatgcctaaaattgttttttaaatttcttattctttcctgagctctcccagcaatattttcatatcttcctattgtctgtctcatttctgcttccttttctttttttttttttttttgttttgttttgttttgttttttgagacaatcttgctttgctgcccaggctggagtgtgatggcacaatctcaactcactgcaacttctgcctcccgagttcaagcaattctcctgcctcagcctccagagtagctgggattacaggcgcacaccaccaggcctggctaatttttgtatttttagtagagacagggttttgccgtgttggccaggctggtctcaaactcctgacctcaagtgatccacccaccttggcctcccaaagtgctgggattatgggcgtgagcccccctacttggccacatttctgttttctaattacgattttcacctttcgtcaagtttccattacctaatcatttattttagctcatttaaaatgacattcggttcttaccttttaaaaaatttttatttttcatttgttttagagacaaggtctgcctctgtcacccaggctagagtgcagtggcataatcacagttcactacagccttgaacccctgggctcaagcaattctcccacctcagcctccagagtagttaagaatacagatgtgtgtccacaatgcctggctaatttttaaaaaagaaaaaaaactttttgtagagacagcatcttgccgtgttgctcaggctcaccaatctactctctaacttcatgagattcgcttttttttttttttttagctgatatttatctttctgtgcttggcttatttcacctaacatgatgaccctcagttccatccatgttgctgcaaattacaggatttcattctattttaatggttgtgtatatacatttcttcccacccctccctccctccctccctcccttccttcctttcttcctttcttcctccctccctccctctcttctttccttcctccctccctccctccccatattttatctctctctctctttctctcttttgttttctttttttgacagggtcttgctctgtcacccaggctggagtgcaatggcacaatctcagctcactgcagcctcaacctcccaagctcaaacgatcctttcacctcagcctcctgagtaggtgggttacaggcatgtgccggcatgcccataagacatcatataatttctatataaaaatttcagtatgtatctttaacgaataagaattttttaaaagcacaatattctcacacacctctaaattaataattctttaatatcatctaatatttagcccagcttcaaatttttccaattgcttcagaaatatcttttttacatttggtttgtttgaaatagcatccaaaaagtctatataatgcatttgatttatatgtctcaagtttcttttcatctgaatcctgtcttctcaacctttccatgtccttcccccgcccccatttttaaagtaactggatcatttgtcctataaaatatatcaccttgggcctggcgcagtggctcacatctgtaattccagtactatgggaggcccaggcaggcggatcacctgaggtcaggagttcgagaccagcctgaccaacatggtgaaacccccatctccactaaagatacaaacaaacaaaaatagctggacgtggtggtgggcacctgtaatcccagttacttagtaggctgacgcaggagcatcgtttgaacccaggacttggaggttgcagtgagctgagatcgcaccactaaactccagcctgggcgacagagcaagactctgtctcaaaatatatatatatttttttatgttatatatatttatattatataatatatataatattttatatatatatcaccttctggatcgtaattacttcctggaggtgacatttaacatgtttttttatcctctatatatccaaaaacttgtagtttatatgtacaggcttggttagattctggttcgatattttgggcaggacactttcacagatggtgctgtgtacttcctgctctatcaaatcaagaggcacataatgctaatcccacttttaatgatgtaaacagtgctcagtgtccaactgttgtcagcctcaaccatccttagaaagttcctcattaatctttcacctaatagtttaagcatccattgatgagtgttgctcattatttcactagaggttgctaaatagagatttttccattatcccctctgtatttatcggcctggattcttctacagaaaagaactttccttcaatatttgtttaccctgatgtttaggtacaggagaggcagaatagatgcttcattctttattttctgggttttgctgttgttgttgagacggagtctcactctgttgcccagactggagtgcagtggcacgatctcaactcactgcaacctctgcctcctgggttcaagcgattatcctgcctcagcctcctgagcagctgggactacaggcacacgccatcactcctggctaattttttgtatttttagtagagacaggatttcaccatgttggccaggctggtctcgaactcttgacctcaggtgatcctcccgcctcagcctcccaaagtgctgggattacaggtgtgagccacagctattttctggttttcagaataaagagtgaatgctctagaagcctccaaaggtgaccaacaagtttcttatttttaatatcattttgaattcatggattttcacacatttgtttaaattaacaacagatactattctttatgcgttaattaccccattttttggcctactggccactttgagtcctctgtccttttggcaagatttcagtagtctttgataacttccttgctttctggcacaataaatgtctccagctctccttgccccagacctgaaactagccatgtctacaagatgcccagtattcttttaagagaaaatgttaccttaaataccttctcacttttttttatttttttgagagggagtctcactctgttgcccaggctggagtgctgtggtgtgatcttggctcactgcaacttctgcctccctctgcctcagcctgcagagtagctgggattacaggtgcctgccaccacgctgggctaatatttgtatttttagtagagtcagggtttcaccatgttggccaggctggtctcaaactcctgaccgcacgtgttccacctgcctcagcctcccaaagtgctgggattaccgacatgagccccatgcccagccacttttcttaaataaagtccaaaatacctaatatggaacagtaccatgcttttaacattggtatatcacaaataaatacttgttatacttgtagacggtaatctgatcccttctgagcttggaggtgattcacagggcctgcactggctaaagaagctgggtacaaatggtttcatccatttccacagtggggcatataatatttcctatgagtgcaatgatgtggaaacagctgggaggggtagtggggatatattttttgtcagcaaacctttctttggtggaatctccttttcattcagttatgtctgtttagaccatgtaattgggacgagctccacagggttcttcccctcctccctcccacattgcatttccagaatggatgcgtgatctatatctgggttagtagaggagtctatcctcatgtggtcaattcagggatgtgtacatgagctaaacttggctacttcatattttttctggtactactacccaagccatttttctctagaattgtgaactataaggatgttgtgtgcctagggctgccagtggtcctcttcctacaaatatggacagcatctgaaaataaagtcaagcagagacatgtagaacccaaagaaaagagtcctgatgacatttggattctagctccaaccatgcctaaatagaactcttaaactcttagttgcacaagaagtcttaatacctggggcctgcaaggccttgcattgtccctttatagactcagctaaaattaggcttcttctcaaccactatactccacccaacttggacctatttttagttctgtgaaagctccaagatcttcccacctccagggctttgtacacactgccttctgcctgaaaagtacttgtcccactcttcaccaatccaaattttctcttccactaggtcttggctaatcatttcttctggagaaacatgcctgactctcctgttcaggtcaggttccctgttaatcatattcaccctcatagctccctatgcttctctctcatcacccctccctcaatcataatcatctgtgaaatcatcttgtgaatatctgactttcttgctggtacataagcctcatgaaggtcggagctctgtgtgttttgtttaccgcacaatcccccaaatgacattgtaattggcacatagtgggtacccccttaaatatgtactgaaagacgactgaataaagttttaaagcttaaggtacatatgcaaaataatcttgtttattagaaaatgaacattcacaatgtaaagtagaaattaaattacaaataagtcttcaatggtcaaaaatggtgcccagaatttcttctcaaaataagttaatctattcttaaacagatgcaggtaagtagtttatccttgtcaaaacaaaaaattaacagatttcactttatgtaagagataaggtttatatgaacaagaagagtttatttttaaatgtaaagctgaacaagatagaatggagatgctttgtgaagttataaatcccttcaaaatatgaaaatcatcctttcaagtttaaatttgttttcaaaaacatattttctcttcttaaatatgtactactcttaacaatatatcataccttaaaatctcctgttgtcattttctctttatacgcaacttggcctactcaagaagacatcaacatggtgattttttttcctcaaactttatctccttgctcttttcccaatcccatgttacttcctttcgccttcttttgtgccaagatgagcaaggtataatcctccaaagaagaaaatgctccaaagaaaatgctctcaataaaaaggaaagtaagagtcatttgtgtaaggttaagtttatctaaattttaatcaatattataaacctttgaaagctgggaaacttttttctgttatattcttgctggaaacaggttattatgctaagacaaaagctccagtcagtgggcttatgttgcccaaatatttctgctagtaggactcactggtatagttaaattaccctacaattagtgattaattgaaactgcaactttctgggatattttcctcactatgaaaaatcaagtggttaagactgtggactttaaggatagactgttacttagacaagtaacttttctgtgcctccattctttcatctgtaaaacgggaatcataatagtattttcactccataagactgctgtaagaattaaattgtatgttacacattacctggaatgtggaaagcactccacaaattttgctcttatcattttcatcattaccattattcttgttatttttgtcatgcacactatgcaaaccaagggtagagtttactctttaagattagacgtggcccaaaaaatgtaagacagagaaagcagctgcagaatagcaggtaagagggatcccagacttgaccaaatagccagaactggctacggttctgagaaatctatggaagcagtcttgctatgggcggcagaggagagtgaaaacagtcttcaaaatttaatcgtagaataattctatcaaattaagccctttattagagctgaaaaaattgagtttaagagcacagctagtttagcataaagtgcagattatacagttttaaatttttgtttttattttttgtaaagacagggtctcactttgtttcccaggctggtcttgaattcctggcctcaagcaatcctcctgccttggccttccaaagtgctgggattacaggcatgagacactgcacccaacctataaagtgcagattatatagtgtttattctcagatttgaaactatttctaacttaaagtagaaaacatttggaaaagtgtttagaaatatttttgcattttcttaacagtgcttatcaatatacatagttatctactagttccttttatcagcattcaacttatgtagaggtagaagttaaacatacagtgttatttagccaacttcaggtaaactcagtaaattgttagattaaagccattttgcctcaaatacttattagcctgactagtttggggctgtcagggatcatccaaattaaaaatccaactaaaattctgcagctctacacaactatgcagacatagattgaaaactgttgtgttcctccccgccactactgagagatgggaaaaattaaagtaaattaattaatgttttactaattaaatgtttttctccagtttaagggggttgaaaaatagcaataattttaagaaaccatttactgttttgtatatatatatataaaataacacatatctggattatgtttctaatgtgaatttttggcatttgaaagaaagtaggtatccctattaggctaataggcagtgaagtatcttgatctcttaatcctctgtattgctcaaatattagcattatccatactcatttattaatgtaggggttacttagtgaaaccctgaactaaaataaggcagaggtgtagtattagaagaaagactcatagaaggcaaggtaggatgttaggcacgctaaatggaaaatatgtgttataatttttatttcataagtgaacttgataatagaaaatgcatttttttataaataaaaagtaggtgtctgaataaaaatacctctacttgggtagaggtatttaaaattctataattttgttctgctatggctaattcttacagaaccctctttctggttccactgtatattattttaatgacacttctgcagtgggtattaagaatacagcttcacatttattcatcattgtccattcactcattagttcatgcaaccacaaaaaggtattataagaataatatttcatttctgaggtaaggaaattatcatctagtatgtttttatataacctactattcacaatgacatgtagaattctctctgttattcaacatatgttcttgttcttcaaaatctgcaatatctgtagtctgattcttggagactggctcaccgcaattgtctagcagagctttagaccaggaagtgccacacagcaagtagtttccatcacagtcttagctagtttattcctgaatcctcccatatcttacagaaagagcaatgagtcttttgtaaaccactcccaggagggtgatggtgagcactattattccacacaccaggctgaatgcccatcgtggtccccagtgagcatacacttggctgatgaacataggcccaagaatccgggctccacttccagatgctgttaaccagcccatgtatacaccctgttgggggtgaaatggaggacaagcagattgatattggggtttagttatttaaaagcaaagaaatggtattaccaaactacagcaaacttacaagaatcatttctgcatcttttacttttaaattaaacataaaatgcctcctataaatatagcatttaatattaagtcagattaaaaaaaataaaaggagtgtaaagggaaaaacttactgtctgctgaagccctgggaataataaaattgattaaaataccttttaaagctaacatttattttgtacctgctacatgccagtcactgaggtaggtgctttaaatacatcatttgtaatgttcacaagtttcgatgacaggtgttatgcctgtttaacaaaggtagaagctgaaactcagaaagtttaagtaacttgttcaagaggtttgaagccatatttggctgactccactgtgccactttacactctaccacaatgccactcctacaacttctgtatccaaaactataacccacataacctacccaagaatgaactttatagaagttgtgggatttttaaaaattttaaatgctgaatatgataaaaatccctcaaatcagtctgtgtaaaaatagagaatggcagcaaaaaatgttgagtgcttacaagtatattttctataattgcaatgtcagggtacctggcttacctgaggttttggtcctagaatttttgaatatagagtataggacataagattgcagactggatagcctaatcctattagcacagctgatgtaaggaactgggccagatgaatcaccggggtgtagaggcaccaggcttgttcaatcgagcaaccagttggtctttcattgtcatcttccattggagacttccaaagaccaataataatttccccaaatgtggtattagggattgaattattgtgcaaatctgtaaaaacaaaaccattgcagtgcattacttgttgattttagataaataacagaggttaacattatagaattatgtatggctataccttcccactgtattttgggaaattgatttccccaaggtaacaagataaagaagccaacccatacaacgatgagtcctcccagtagaatagcacgctcgccaatcctgttaaagaacagaaactctgtaattttaaaatgaaacattataacatagcttcattactttcataattttaaaaactaaaaataatatcttgtacttttagtgatatatccattaaaaagaatgctaaatataattttccactaaaaataaccaggactcctctgaaaaatggctgacttaaggtctgggacacaaaaagtagatgagctcagatctttcacagcaaaaagcacagaagttatcagtgactactaggtcatgagtctttttgactcagccaatttgaagaagctggccaaaaatgtgacaatgtgagtaccaaaacagaataataatggcaatggattgaaacacacaaaaagtattatcatctgtggcctggtgtagtggctcacacctataaccccagtactttgggaggccaaagcgggaggactgcttgatgccagaagttcaaaaccagcctgggcaacatagcaagaccccatctctacaaaaaattttaaaaattagccaggagtggtatttggtgcctgtagttctagctacttaggaggttgaggcaggaggattacttgagcccaggaggtcaaggctgcaatgagctgtgatggcaccactgcactccaaactgggtgacagagcaagaccctgtcgccaaaaaaaaaaaaagtgttataatctatgaattcatagtatattaaaataaagtactctttggtcagtttttgaggatgttagggaaacaaaagaaaataatcaagcctttatcctgcctttcctatacaactatagctcaggttaaccaaatagttggtgagggaaagattctcttcatggtaagtattctagcaaataaataaaggaatgatagaattaaaataccagaattttgtaatgattcattaatgaattaatggatctatggaataatcagtggctacttacatgttaagaagagataaacaaaacattatatttcttctgatataagcacatattcccacctataaagtattcttgccaaaaaattgaacccaaatttcatcaagcttctagatgcaagtactagtttttaagaaatacagcaatcatgtcatctgcaaacagaggcaatttgactttctcatttcctaattgaataccctttatttctttctcttgcctgattgccctggccagaacttccaacactatgttgaacaggagaggtgagagagggtatccttgtcttgtgccggttttcaaagggaatgcttccagtttttgcccattcagtatgatactggctgtgggtttgtcataaatagcgcttattattttgagatacgttccatcaatatcagtttattgagtgttgttagcatgaaggagtgttgaattttatcaaaggccttttctgcatatattgagataatcatgtggtttttgtcattggttctgtttatgagatggattacatttattgatttgtgtatgttgaaccagccttgcatctcagggatgaagcagatttgatcgtggtggataagctttttgatgtgctgctgaattcagttttccagtattttattttttatttttatttattattattattattattattattattattattattattatttgagacagagtcttgctctgtcgcccaggctggtatgcagtggcgtgaacttggctcactgcaaactccgcctcccgggttcatgccattctcctgcctcagtctcctgagtagctgggactacaggtgcctgccaccacgcctggctaattttttttgtatttttagtagagatggggtttcactgtgttggccaggatggtctcgacctctgacctcgtgatccacccacttcagcctcccaaagtgctgagattacaggcgtgagccaccgcacctggcctgggtttgccagtattttattgaggattttcgcatcgatgttcatcagggatattggccttaaattttttttgttgtgtctctgccaggttttggtatcaggatgattctggcctcataaaatgagttagggaggagtccctcttcttctacggtttggcatagttacagaaggaatggagtttcagaaggaatggaaactttgtacctccagtagaattcggctgtgaatctatctggtcctgggctttttttggttggtaggctattaattactgcctcaatctcagaacttattattggtcaattcagggattcgacttcttcctggtttagtcttgggagggtgtatgtgtccaggaatttatccgtgtcttctagattttctattttatttgcatagaggtgtttatagtattagagaatactgtggtattctctgacggtagtttgtatttctgtgggaccagtggtgcccaaaatctccttaagcgacaagcaacttcagcaaagtctcaggataaaaaatcaatgtgcaaaaatcacaagcattcctatacaccaataacagacaaacagagagccaaatcaagagtgaactgccattcacaattgctgcaaagagaataaaatatctaggaatacaacttacaagggatgtgaaggacctcttcaaggagaactacaaaccactgctaaaggacataagagaggacacaaacaaatggaaaaacattccatgctcatggacagtaagaatcaatattgtgaaaatggccatactgtccaaagtaacttatggattcaatgctatccccatcaagctaccattgactttcttcacagaattagaaaaaaactactttaaatttcatacggaaccaaaacagagcccatatagccaagacaatcctaagcaaaaagaacaaagctgaagacatcacaatacctgacttcaaactacactacaaggctacagtaaccaaaacagcatgattcttgtaccaaaacagatatatagaccaatggaacagaatagaggcctcagaaataacaccacacatctacaaccatctgatctttgacaaacctgacaaaaacaagcaatagggaaaggattccctatttaataaatggtgttgggaaaactggctagccatacgcagaaaactgagactgggccccttctttataccttatacaaaaattaattcaagaaagatcaaagacttaaacataggacctaaaaccataaaaaccctagaagaaaacctaggcattaccattcaggacataggcatgggcaaggacttcatgtctaaaacaccaaaagcaatggcaacaaaaaccaaaattgataaatgggatctaattaaactaaagagcttctgcacagcaaaataaactatcatcagagtgaacaagcaacctacagaatgggagaaaatttttgcaatctatccatctgataaaggtctaatatccagaatctacaaggaacttaaacaaatttacaagaaaaaaacaaccccatcaaaaagtgggcaaaggatatgaacagatgcttctcaaaagaagacatttatgcaaccaacaaacatatgaaaaaaagctcatcatcactggtcattagagaaatgcatatcaaaatcacaatgagataccatctcacaccagttagagtggcaatcattaaaaagtcggggaacaacagatgctggagaggatgtggagaaataggaacacctttacactgttggtgggagtgtaaattagttcaaccattgtggaagacagtgtggcaattccccaaggatctagaaccagaaataccatttgacccagcaatcccattactgggtatatacccaaaggattataaatcattctactatgaagacacatgcacatgtatgtttattacagcactattcacaatagtaaagacttggaaccaacccaaatgcccatcaatgacagactggataaagaaaatgtagcacatatacaccatggaaaactatgcagccataaaaaaggatgagttcatgtcttttacagtaacatggatgaagctggaaaccatcattctcagcaaacacaggaacagaaaaacaaacgccacatgttctcactcataagtgggagttgaacaaagagaatacatggacacagggaggggaacatcacacacaggggcctattgcggggtggggggctagaggagggatagcattaggagaaatacctaatgtagatgatgggttgatgggtgcagcaaaccaccatagtacatttatacctatgtaacaaacctgcacatatattccagaactcaaagtataataaaggctgggtgtggtggctcacgcctgtaatcccagtactttgggaggctgaggaggacggatcatctgaggtcaggagatcgagaccatccaggccattgcatggctctttgctgacttcactaaggtctcagcttaaatgtaacttcctcatatataccttccttgagcagtgtatcaaatacaacatttccccacttcccagccctgcccttgtcactccttattcttttctcttctattcttctttgtagtacttaccactatctgacttcacatttgtgtttattggctttccccctactggaatacacgtgctttgaggggatggtattggacattctataagaatgtgtatcagcagcactgctctacttctgtagcaagatgtaatgtacttcctattaactttgaatataaatatatgtctatcttatatcttgatccctctacttggctccataaggacaagaattctcatagtacccccatagcactgaacctgatacactgacttaacatttgttgattaattttagaaccttattaaagtacatacagtctctgacttatgagtgtccaacttagaactgttcagctttacaacagtaggaaagtgatactcattcagtagaaaccacacttcaaattttgaattttgatatttttccagactagtgatctgtggtatgatactgtttcatgatgctggacagcagcagagagccacagctcctaatcagccacatgatcacaaaggtaaacatccagtactataatctacagtatactgtatttggcaaattacatgagatatccaacactttattataaaatacgctttgtgttagatgatttagccaaactgaaaactaatgtgagtgttggagtgtgtttaaagtaggctaagctaagctacaatgctccgtaggttaggtgtattaaatgtttttttttttttgtttttcgctttttttgagatggaatttcactcttgtcatccaggctggaatgcaatggctcattgcaacctccacctcctgggttcaagcgattcttgtgcctccacctgtggagcagctgtgattacaggcactggccaccacacccagctaatttttgtgtatttagttacgacggggtttcaccacgttggccgggctggtctcgaacttctgacctcaggtgatctgcccgccttggcctcccaaagtgctgggattgcaggcgtgagccactgcacccagcctgtattttcaacttagtgctattttcaacttatgatgatcagtttatcaggatgtagccccattgcaagttaaagagtatctgtatttgaggaatacttaaatagaactgtctaaattcatcaactaatgttccaccatagactatatgactgaacttaattttacacaagcatttccctaaaaatatgttccttacagttgtacttttacaaaatgattctttttttaagagatgggtcttgctctgtcacccagactggagtgtagtggtacaatcacagctcactgcagcctcaaactcctgggttcaagcaatcctctcgcctcaacctcccaagtagctgggactacaggcgtgctccatcatacccagctaattgtgtttgtgtgtgtgtctgtgaagaaatagggatctcattatatcatagtgagataagatctcactatgttgcccaggctggtctcaaactaactcctgggctgaaatgatcctcccattttagcctcctaaattgctggggttgcagatgtgagtcaccatacctggccaaaattattcttttatttatttgtatttatttatttattttgagatgaaatctcactctgtcacccaggctggagggcagtggtgtgatcttggttcactgctgcaacctccacctcccaggttgaagcgattctcttgccttagcctcctgagtagctgggactacacgcacatgccaccacaccctctatttttagtagaaaaatttttttgttttagtagaaatgtgccaccacgccctgtatttttagtagaaaaatttttgtatttttagtagaaatggggtttcaccatgttggccagactggtctcgaactgctgaccccaaatgatccagctgccttggcctcccaaaatgctgggattacaggcatgagccactgcaccaggccctcaaaatgattcttttaaacagtgaatagacattctcaaaagacatataaaaggccactaagtaaataaaaaatgttcgacatcactaatcatcagagaaatgcaagtcaaaaccacaattaggtattctctcaacccaattaaaatggctttaatcaaaaagagggaataatggatgctggcgaggatgtggagaaaggggaacccttgtatactgttggtgggaatgtaaattagtaaaaccactatggaaaacagtacagaagttcctaaaaacttaaaatggaactgccatatgaaccagcaatcccattactaggtatatatctaaaagaaatgaaatcaatatatcaaagacacatctgcactcccatgttcatttcaacactattcacaatagtcaaaatatgaaaccaacctaagtggtcatcaatggatgaatggataaatgtggtatatatatatgggaatattattcagccattgaaaccatgaaatgccatcatttggggtaacatagatggaattcatggtcattatgttaagtgaaataagccaagcacagaaagacaaattatcacatgttctcactcatgtgggagctaaaaaagtgaatctcaggtcggcagcggtggttcacgcctgtaatcccagcactttgggaggctgaggcgggcagatcatgaggtcaggagatcgagaccatcctggctaacatggtgaaatccgtctgtactaaaaataaaaaaaaaaattagccaggtgtgatggcatgtgcctgtagtcccagctacttgggaggctgaggcgtgagaatcgctggaacccaggaggtggaggttgcagtgagctgagatcgtgccactgcactccagcctgggcaacagagcgagactccgtcacaaaaaaaaaaaaaaaaaaaaaaaaaaagaatctcatgaagatagagagtagattggtgagcccaggaaacaaagcaagatcttgtctctacaaaaagttaaaaaaaaaaaaaaaaattagccaggcattatggcacatgcctgtagtcctaactactcatgaagctgagacaggaggattgcttcagcccaggagtctgaggctgccatgagctatgatcactccactccactccattctgggcaacagagtgagacgccatcttttacaaaaagaaaaaaaaaaagaagaaaagaaagaaagagactagattggtagttaccagaggccacgaataatagcgggaaggaggcaataaacaatagttgattaataggtacaaatacacagttagaagaaataagacctagttttcaatagctcagtagggtgactatagttagcaataatttagtgtacatgtcaaaagctagaaaagagtaattcaaatgttcctagcataaagaaaaggtaaatatttaaagtgatggtatcccaattatcttgatttgatctttatacattatacgaatgtatcaaatgatcactcataccccaaacatatgtacatctatcatgtatcaattaaaaaacacttatgctgggcgcagtggctcatgcctgtaatcccaacactttgggagactgaggctggaggattgcgtgagcccaggaatgagactagcctgggcaacatagtgagataatatctctacaaaaaataaaaataaaagaaattagccaggtgtggtggtcatgcctgtagtccagctattcaggaggctgagatgagaggatctcttgagcccatcaggctgcactgagccatgattgcaccactgcattccagtatgggtaacaatacgagaccttgtctcaaaaaaaaaaagagtgttgtgtggtctgggaaatgacacaaattttatttgccatgatgatgatatagaatatatatactatggatagaagttctagaataagtttggtaatcttaaccaagattttccaaacttaaccatgaatcttttttgttgcacaatatatattacaatacagtagaacaatggtttatgaaatatactttcaggaaaacatagtagacaaaagataaataagagtcaattatatactttgtgagaaattttgttttaccaaagaaatgctgtaatgtatagaaatatgataatctcttaataaattgtaaatttgtgtgcaaaaaaaagctttaaattattttcctggtatatccatttgcattgttagctctgttttttgttttattttttaaaaacagacataaaaccaaaaacacttaacttactttttggaaagcaacttaactcctaagaaaataacaacggcttcaaccccaagagcagcaagtattatgccattatataacacagcttgttcttgagtccaggcatacatatccattgttaatggagtaatgatgctaagaaaaaaaaaattattcttattttatttaaatcacagtaactgttatacttaaagtgaagtgtaagttttaataacgacatctacacattcaagaatgtgcatgccttttagcaatgacaacagacctaagcaaaagtttgaacacattttaagcgtttgttgttacatacctaagttactaagtctgcctactcatattttacttcctaatgtttattttaattatataactaatatagccatattacagaaagtctgaaacaaaggaaaaggaaacaagccacaccaatcataatgcctatcattctaacattactaaataatcatggttatatttttaattaaattggtctctttcaatgcaataatgttatattaagttatcagaatatactggatttttgaatatatatatttttctctttgcctctcaatgtctcttcctttatatgactatatccttccttgccaagtttctctccctacattcgatctctattaactgactacaaaatgcaatttatatttattgtttattactattatttttgagacgccaaagtctcactctgtcacctgggctggagtgcagtggcatgatcttggctcactgcaacctccatctcctgggttcaagcaattctcctgcctcagcttcctgagtagctgggactaaaggcgcctgccaccatacccagttaatttttgtatttttagtatagacagggtttcaccatatggccaggctggtcttgaactcctgacctcaagtgatacacctgcctcaacctcccaaagttctgcgattacaggcgtgagccaccgcacccagtctgaaatttatttaacattgtttaattggtatgttactgtttaatgggtatggaacttctgtttaggatgatgaaaacattctggaaatagctagtggtcatggttgtacaacattgtgaatgcacttaatgctactgaactgcataccttaaaaatagctaacatgatagtgccaggcgcggaggctcacgtctgtaatcccagcactttgggaggccaaggtgagcaaatcacttgagcccaggagttcgagatcagcctgggcaacatggggaaatcctgtctctacaaaaaatataaacaaattagctgagcatggtggcgcatgcctgtggtcccagctacttagagggctgaggctggaaggtcacctgagcccaggaggtcaaggctgcagtgagccgtgattgcaccactgcactccagcctgggtgacagagtgagaccctgtctcaaaacaaaacaaaaaaagttaacacgataaattttatgttatgtatattttcccacaataaaaaattgcccctaaaatatcaggtgagctggaactttcatatatctcaataattttgaaaataaaaacaccaagcaaacctacaagtactaacataaaaatgacacaatgtattaacaagtaaataaaccaagttgtcaaatgataatatcacataatctatgtaagtttaatagatacatgtatatacatacactcttatacatacataggaaaaatgtttgaaaaaacacaaactaaagtattagcagtggttactttcacagaaaggagtggatatagaaatacagttgtaatatttgggatttgaatgtactatttttataatttcatggaaagttattttaaaaataaaacagccatatgataaaggtcaataaagcctgcacaaggcagagattttgtaatatactaggtttttcttcaaggtcaggtattaaattgagttaaaattaccagattgaatcatatatatatatacatatatgtaggaaattatagagcttaaggataattaaatcatggcactaaagttttataactgtatttatcataaaactcagatgaaagagggaaagagtagtgaaacagattcttttataagaaaataagataaggtagttaagattatggacaaataattaactacattcaagttacaagcaacaaaatgtatatacattttttacatcatggtaagaaaaatttgccttacataagattttcaataacatctatatgcctaattaacattgcattaagaaataaaggttaaaacataatctgattcagatgaagatggaataaaacttacgtttcaaaaagggcaaagataaatagagtcacaaaaaacagaacattgatggccacaacagcaacctggtcaatatttccttggggaacctgagcttcatctgtacttgctatagggaaataggagaaaaattacattacctatacatctaatttttcttatgacattaaagtaatgtagaaattacattgtagcaaaatttataaataaacatttaaaaaaatttttaggcttcaaagtagtttaataataagagaatttgtttatttttattttttgagacagggtctcactctgtcacccagactagagtgcagtgtcatgatcacagctcactgcagccttgacctccccaggctcaggtgatcctcctacctcagcctcccaagaagctggggctacagatgtactaccacgcccagctaatttttatattttttgtagagatgaggtttcatcatgctacccagtctgggcttgaactcctgagctcaaccagtccgcccgccttggcctcccaaagtgttgggattacacgtgtgagccactgtgcatggccaacaataagataatttatatgacagaaataatttttaaatggcatttaaaagcaaggtgaattttcttccccagagatatacttcaatcctgttatcttaagaaatactcagatgtattttgtacttggtatatctcaatccaaaaatgggaatgtaatttatagaactctgttaacatagtgatctcatactaaatatatttgctttaaatttcaactgcagattttttccaccttacttaaatcttagacttacaagaatttcatgaagaactccagtggtttattaaatcagttcccagttctatgatttactacaatggatatatattttgaatttcagtgttacatgaaattagtactcatggccaggagtggtggctcatacatgtaatcccagcaggtgggattacatgtggtttacatgtggattacatgtggattacagcaggtgggaggccagtgcaggtggatcacctgaggtcagaagtttgagaccagcctggccaacatggcaaaaccccatctctactaaaaatacaaaaaagaattagccgggcgtggtgccacatgcctgtaatctcagccacttgagaggctgaggcacgagaattgctttaaccaggagactgaggttgcagtgagccaagattgagccactgcacttcagcctgggtgacagagaccctgtctcaaaaaataaataaataaataacaagaaattagtattcgtaaagatccttatgttatcattaccattttaaaaacccctatcatttatatttctgcaaagaaataatcaggatttgacggtggttttataaataaggaggacaaagtaagtgtactgacttctcatcttgaacaacgccttaaggttaatacacattaagctattcttgatgtaactgagaatcatgcagacatattaatctactcatatatattcatcacactgttttgtaatttatccacttattcagaataaaatagtatttttacacaaataaataccaaaataagccaggtattttttttttttttttttggcgggggggacggagtcttgctctgttgccaggctggagtgcagagacccgatctctgctcaatgcaacccccaactcccgggttcaagcgattctcctgtctcagtctcccgagtagctgggactacagctatttttgtatttttagtagagatggggtttcaccatgttggccaggatagtctcaatctcttgacctcgtgatctgcccgcctcggcctcccaaagtgctgggattacaggtgtgagccaccacgcccagcctatgccaggtattaatacataaaatattacaaaaatatgtttatttatgctatcttaaattgtgtgtagtgtcagttgttgttagtgggtgggtgggggggctttcctaagatgcagtaagtttctatgatttttttcataataatgcctgcttttctatctcaggattcttgagaaggagttcctcctccaacaataagtagatttggaaatagtctgctatacttaaagggaattaagcaccttggatgctcaacatagccttatgaccttcctttgtaatcacacaaagagaactggccacctttgtccagaacctttgccaggggtaggccctgatggttgtggctcttgtactattttggatagacctctctgattcttaatcaccacctagaagtcagtctttactccttcaagtcagtatcaatattgccccaagtcagactggagtttgcttcataatatgtggttagtttcctatagcttctactcagtgttggcttcagtggggtatctcagaaatgttgcatcctagactatggggattgactagatatcctaattacacattttttaaaagactacattagtatatggattcaaattctatgcaattagaaattataatcctgtctcataataacctctttaaatttgaatagctttaaattaaaacaattatggaagtttttaccagacatattttatgcaaacatttattgaaatttaaaaattttattttataaaaattattttgaagtaactagaaatctcataaaagaaaacactacatcttctctaaactcattcccatttgtactttagaacagtgctgcccaacagaactgtgacatgacggaaatgttatttatctatgctaatacagtggccactagccacatatacccattattgagcacttgaaatgtggctagtatgacagaaaataatttcttaaatttactttatttaaatagccacatgtggctaatggctactatattgggcagcatagctctcaatctttgctgcacaaagtgtgatttgtagaccagaagcatcacatcacatggtagtttgttgtaaatgtagatgctcagcatctcactagggttgccagatttagtaaatatacaggagacccagttaaatttaaatttcagataaacaataagtgttaatataaatatgttctgtgccatatttgaaagttaagtataagaatgttccatgaagtatttggattgtatttatactttttttttttctttttgagacagagcctcactctgtcacccaggctggagtacgtggcgtgatatcggctcactgcaacttctgcctcccaggttcaagcgattctcctgcctcagcctcatgagtagctgggattacaggcgcctgccatcacacccagctaatatttatatttttagcagagacagggtttcaccatgttggccaagggtggtcttgaactcctgacctcaggtgatccacctgctttggcctcccaaagtgctgggattacaggcatgagccactgtgcccagctggattgtattaatactaaaagttatttgtttccaggtgcagtggctcacacctgtaatcctagcactttgggaggcccagggaggcagatcacttgagtccaggagtttaaggccagcctggacaatatggcaagatcctgtctctattaaagaaaaaaaaaccaacgttatttgttgtttattgaaatccaaatttaactgggtgggacatatttatattaaaacattattaaaatttaattgggcattctgtgttttattttttattataaattatatatttttatatttctttattaactcccctattctgagaagcaacatcctgtgttttacaggcaaccctattaagtatcaccctaagcctaatgaatcagaatttgcatcttaacaaggttcccaggtgatttctaagcacattaaagtaaatgaagcactgatgtatatcattatccccttccaagttctgaaatactgatttttacatatcttccctttgtcatacctctacctcaccctcttaacttcctccgtcactttacctgatagctccttgaagttagcatcctattttttacctttgaaaaaaggagtttatacgcactgctggcacttcacctctcattctttgtgttttattttgaaagttttcaaacatattctcacatattcattcctcagattcaacaatcttttgccacacttgaatcatcatgccatcctttctctcactccctttctgctgccatagtgtgtttcactgggtgactcataaatttttatctctagcttttatttctactgtcaaaattacaaatgcctgtgggattttttagttgttctagagtaacagcatattcagcttgatccaaattgaaatcatcttctcttttcatctaacctcccttcctaaattcttgttctctctcattcttccaggtgatctagaatcaaaacctggcagcaatgttggctttctctaatccttaatattctctatccaaatctctatcttgattcctctttcaacaactcctacttatcccttctccattctcagtcactgccctacttcaggcctagtcaaaattaatacttttacactgtcttcctgagtcatccacacaatgttctcttaaaaagaaaaacacaaatattgtacctatgaaaagcttaataaagaaattgtttaaatttgttactggcattgtatttttttcacatttgatacagtttcttttactggcttttcagtaatgaaattgttaccaatgagatattaccagtgagatataaccaatctggattagcctctgcatggaatcaatgtcaaacttctcctagttcaaaaacttactgtagctcctcaccactctgctctactacatttatcttccactatttcttttgtgaaaattaaataaaagagctatgaaagtacctggtaaaatagtaaaataatactatgtcttttccacaactttatgaactactgagggccaggatcagtccttgcattctttccgcaaggaggatataattagtacctaaataacaggtttttttttggtaaaatatagctacttactgggttctctggcttatatgaatcagagaagatctaaaagatgaaaatgtatatttctaaagtataccaaaacaacaaaaataaaaaggcaaaaccatacccattttcatacttaagataataaagaactgctttaaatagacatatttatttggtagtaaagatatggaaatcattgcaaatatctcaaaggctttaggatactggctctctgaaaataagacaaagcgattttttacaatgtttgtaaccttgtcaatcatgaccaccaaataaccaatatgggtatgcctctttaaaaaaaatcaatttgctcacgcctgtaatcccagcactttgggaggccgaggcgggtggatcacaaggtcaggagatcgagaccatcctggctaacatggtgaaaccccatctctactaaaaatacaaaaaattagccaggcgtggcggcatgcgcctgtagtcccagctactcaggaggctgaggcaggaggatggcatgaaccccggaggcagagcttgcagtgagcagagatcgcaccactgcactccagcctgggcgacagagcgaaactctgtctcaaaaaaaaaaaaataaataaataaataaataaataaataaataaataaataaatttaggtcactttcagctttgaagatcttccccaatcacccactgtgttgtcctcagaagcaaaatcgaagtaaataccaaacaaacagaatcattagaaacactttgataatgttatattaattcagccaaatgggttaaaagtaccttcttcaaaattaatacttttacactgtcttcctgagtcatccacacgatgttctcttaaaaagaaaaacacaaatattgtacctataaaatgcttaatagagaagttgtttaaatttattatcggcattgtattttttttcacattctaatatagtttcttttattggtttttcagtaataaaactgttaccaatgagatataaccaataaacttaagacagaagttacaattcttatcaaattatcataaacaggtaaaatgaaaaaaatccaactcatcctaaagcatacatgatctactttagtatttgaagttttacagtgattataaacattagtaataaatgtttttagactattgaataaagcactctaaataaaacataattttaaaaaattttttcgaatatataaaagataagagatatacattactagtaacttttatatttaagactgatacaaatccattaatctatttaaaatgttacttccatgcctttcccctacttagcaacatgtagttagtaaatcaagaccaaaccttgaggccgggcacagcctcacatggcctcatgcctgtaatcccagcactttgggaggccgaggtgggcagatcactttgaggtcaggagttcaagatcagcctggccaacatggtgaaacaaaaattagctggatgtgttggcatgcacctgtagccccagctactcgggaagctgaggtatgagaatccttgaatccgggagatggaggttgcattgagccgagatagtgccactgccctccagtctgagcaacagagtaagatcttgtctcaaaaaaaaaaaaaaaaaaaaaaaaaaaactttgaatcttcaaagaccttccttttctgttctcatttatcaggttgtcttttggttgccagtattacatgctttagtactacctgaccaaaaaatataaacaaactatagacataaaaaactacgtacacttcataaggataattatcttccaacaattacaaagctcattaaatttcacaatctacaaaaatagttttatcatttctatctaattaccttagtatggcaaggatcagaataatatttaaaattcccaggaaggcgctaagtaaaactggtgttgtatacatgtttatctgcagtttaatcacatcccatgtcacacctttttctccaaggaatgtaaaacaagtctgaaaaacttattaagataaaattttcacagatgaattattatatgagaagcataggataaaaaaatgaaaaagacatttacaacagaattgggaacaatgttatggaatcatccttctatatcatgcattctcaacagatggaattggttcttgatggggggtcaaaaaatttcctctttttatgtataaagcaggtatgtacagatatacatatggtacataaaagatatatgacacatctgtggcactaaaattttatggggtaaagagagtaggaaaaaaataccgaaaaaggctccttagggagacaataatgaaaaaaaggttgtgaaacactgatttacatgcattcacaaggaattgtatcttacataacttctcagttttttacaaaacatctccataggcaatttaaattatacaatttcttccaaaaattaattataaaggtttaatcagcttcattataagaatgaaaatatcatattttagaccagatatcttaaatattattctgtatatggtatatatatatatatatatatatgtgtgtgtgtgtatatatttattatcatttgaccatagtattatatacaagtaaaatgaaaaaaaaaaattatttcatccaaaagcatacataatccaccttagtatttgaagttttttttagtgattttaaacattagttagaagtgtttttggactgctggataaagcactctaaagaaatatgaagtggcaaaatctaatttggatctgtggcaaaaactcaattggaagagtactggtttgctcttctgatttagattcaatatgtggctctatagtaattcacatataactctagggtgaggactaaaatattgcacctaccgtacttagaacagtgactagcatacagtaagcacacaataaatgttagtgcttgttgagggcttattattggaaaagtcatcgaagcttttcaggcttacatttactcatctataatgcaaaatttttaaatgacataatctttaaaatgcttttaaggtggtaaaaaatatttactaagaacataagtctataccaggtattatgctagatactgagggtagactggtaaataaagactcaaaccatgtcctcatgtactttacaatatagtattcaagttcaattattctacatttgtgcttgtatttgtttcagggtacaaaactgaaatagtagattttggtgaacagtgaattagattcccttctgttgagccttttctttttggctaaatagaggaacgtaatggaaactgggggtgggagatggggtgttaatgatgaagtaagctgagttggattcaaactgataatattcataacttcaatattcaaaatatggaccaattatatggtttttcaatattattctaggcatgaaaatgactgattctttactcagcagaaaattaatttgccttgaggaaatactaaatctcattaattttttttgagacagagtctcgcgcttgttgcccaagctggagtgcaatgatgtgatctcagctcactgcaacctctgcctccgagttcaagcgattcccctgcctcagcctcccaagtagctgggattacaggtgcccgccaccacacctggctaatttttgtatttttagtagagatggggtttcaccatgttggccaggctggtctcaaactcctgacctcaggtgatctgccttccacagacccccaaagtgctgagattacaggtgtggaccaccacgcatggcctcactaatttttttaacactcagcaaaagggtgaccttggacaatttacttagattctctatgcactggcactctcaactataaaaggggactaatagcacttaatttagtggattggcatcaagataaaatgagtgtagcctcattcctggattaaaaaaaaaattagctttcctccctttcccttcagctatgagtttttatacttgggttacactgaatatttaagcctcaaaagttttcccaattcaaattcaagtaatgacatgtgaagaacacctacctggacctagaataaaacctaatgcttgacacatgcttatgtttgccatggaacttgttctttcctgaagggaagtagcaccagcagtatatgatctaacaactgctacatttccttaaaaacaagacacaataatccaaagtaaaagaaagtatcattcagcttataaaattcaatccaatttgactttatacagaagaagaaatcttggtcaacagtacagtcactgcttcctctttatgatcacacaaagcatgtaaggtatttttattaagcaaatgcatcaattaatggaccatactagttttggtaatatgaaaacagttaaagatatcaatgagtgaaaaaatggtatcataagaaaaccaagccgggcacagtggctcacatctgtaaccccagcactttcagaggttgaggtaggtggatcattttgaggtcaggagttcaagaccagcctggccaacacggtgaaaccccgtctctattaaaaattcaaaaattatccacctgtagtcccaactactcaggaggctgaggcagaagaactgcttgaacccaggatgctgaggttgcaatgagccaagatcacgccactgcactctagcctgggcaacagtgaaaaaaaaaaaaaaagaatatcaaacttacttagtactaaaaaagcactgagtgaatggcataccattgattactacaactgtttttaaaagaaaagtattacaatattacaaactctgtatgcatagacatgtaatataagaaacagaaaaaaatgcactaacaattttactgaaaattttcattgagtacattacattcaagagactctgttagggggcataggatatttttaaagtatcattaattctttctaattgcaaaaagtttaggttgggaatggtggctcatgcctgtaatcccagcactttgggaggccgaggcgagtggatcacgaggtcaggagttcaagaccagcctggccaagatggtgaaactgcgtctctactaaaaatacaaaaattagccaggtgcagtggcagacgcctgtaatcccagctactcgggaggctgaggcaggagaattgcttgaacccaggcaggtagaggatgcagtgagccaagattgcgccactgcattccagtctgggtgacagagtaagactccgtttcaaaaaaaaaaaaaaattattatctggttagtgagaaaggatagaaacagtacaatactataagcaagtgccagagacatgtcagagaagaaaaaaatctctcaaggggcagggtagcccaagatggctttgtggaaaatgtggagcttgaattggatctatttttgttttgggtttttttttttttagatggaggtctccctatgttacccaggctggcctcgaactcctgggctcaagagattctgctacctcagtctcctgagtagctggtattataggcacgtgccaccacacctggtttaaactgaatcttgaaggatgaagaatgatgagaacagaagagaaactataggtaatgagaacatcatgagcaaaggcaaaatgataagaaaaatatttgtttacaatgagaaacatgtatgttgaactgtgaaatatgagtttaaaaggggatgagaccagttaaaagtgagccataaatgtcagaatgaatgtgaatatgacacaaccaaacatatacatacaaccttacctgctccaattcccaacaatccacgagcaaccagcatgtagtatttattatgagaagctgggatgtggagatatgcatagaggcagttggctgccacggaaatcaagatggagacaataagaggctcttttcttggtctataattagaccataaaccaaatataggtgaagctaccatttggccaagactatatgaagcaataacccagcccaaaaaacttgtatcagctgtcggatcaatctgcagaaaaaggtacagtgctttaagaattgttatccaagaaaagtttaaaactaaatacatttgtcataccatgtaagatttcctatcaaaaaataaaaacaattctaacgtataagttttataacactattacttatagtaagggattcaaacttctgacaatacaattaaatgtgctaacaatagactgtacacaagggaaaaatgcttgggaggctcatttttaagaatgactggaaatttttggttcatataaaccttggtaagaagataatcacacacactatatacgcatatagcaataacatcatgaaaaataatataagctattctttaattcttgtaaatagaattctttagacttatgctaccctatacgttaaacagccattagcgctgtaaatcattttttttaaaaaaactaggcacaagagtcaaatgcataaagaagataataaaaacacaaaagatgatagacaattatctcaataaacctgttataaattcttccgttctatatagaccactcagtattctaccactttaaaagggtttacatatcatgatgaacttaaggggagaaccaaatgactacaactcagaaaataaaatactttcagaaaaatagaaaatgttagcttagaaaaggcactattgtttatttttatttttattttttttttgagacagggtctcactctgacatccaggctggagcgcagtggtccgatcacggctcagtgcagcctcgacctttgaggcccaagtgatcctcctgcctcagcctcttgagtagccaggactacaggtatgcaccaccatgcccacctaatttttttatttttgtagagacagggtctccctatgttgcccaggctggtcttgaacttcccgcctccaactctcaaagcaatcctcctgccgcgggagggaggaattctcccaccttggcctcccaaaatattgggattagtggcatgagccaccgcactcagccagattactttttttcatatgtggtaggctaagccaggcgaagtggcccatgcctgtaatctcagctactcagcagtctagagtagaaggatcccttgagcccaggagttggaggctgtaacacactatgactgtacctgtgaaaagccactgcactccagtctgggcaacataggaagattctatctctaatcttcctatttaatggcttttattaaattttaggaaataaatttaaacaaatatagataagtggtagaacaatttaataaggaaaactatgaccttttgttccctaaagatatttatttatttattttattttatttatttatttacttttgagacggagttttgatcttgttgcccaggctggggtgcaatggtgcgatctcaggtcactacaacctctacctcccaggttcaagcgattctcctgcctcagcctcccaagtagctgagattacaggcatgtgccaccacgtgggcacagctaatttttatattttttttagtagcgacgcggtttcaccatgttggccaggctgatctcttaactcctgacctcaggtgagctgcctgccttggcctcccaaagtgctgggattgttggtgtgagccaccgtgcctggtaattccctaaagatatttaaagtgaaaatatttaggtgcgtttttctttatgaaaaaaataagaaataatatgcaaaagtataatgatacataatatttaaagttctagccgttaaaatatctttcattttaggtactctggttttcattttcttcctgtattacctttagcttcatttgtcatctctactaaaatagaaaataataatttcatgttacataaaattttaattttcaaaaaagcaatgaaaactcaattttaatgttaaatgtgtagtggtttgaaagcaaaacttttttttttttttttttctgagacagggtctggctctgtcacccaggccagaatacagtggcataatcttggctcactgtaacctcaaactcctttgctcaagaaatcctcccaactcaggctcccaagcagctgggactacagggagtagcaccaccatacccagataactttttaaatttttttgtagagacgaggtcttatatcgttacccaggctggtcttgaactcttgggctcaagcaatcctcccaacttggcctcccaaagcgctgggattacaggcacgtgagtcacagcactgggcctgatagcaagactctttaaagagttttcaaaatatctggagaaaagagagtacttttcaaaactcaacatagtatgctgagtagacctaatcactactaatatccttcttttgagaattttgactaaaaagactaaatgccaagaaattaagaattttgatacatgaaaatatctttttagtagagaagacgttgctccagaattgtgccaattccaatgactaccagcatggaaagaatttttagtgtaatgggtaataatttcatgtaatattattttcaaaatagcaatgaaaatatggcactaaaccagtaaaaagtaaaatttgtatttcttttcttcttatattcctttaaaaatatattttaggagagcattttcaaaaagtagaaattcgtaaaaactgggctgggcatggtggctcacacttgtaatgccagcactttgagaggctgaggtggtgggtcacccaaggtcaggagtttgagaccagcctggtcaacacagtgaaaccctgtctctactaaaaatacaaaaattagctgggcgtggtggtgcacgactgtaatcccagctacttgggaggctgaggcaggagaatcacttgaaccttggaggtggaggctgcagtgagccaagattgcatcactgacctcgagcctgggtgacagagcgagactccatttacaaaaaaaaccacaaaaattaaaaaaaaaaacaatcctaacaatctagacaatctagtaggggagttaagtaaactctctgtaaatacagtgttaggacactccatattaagggctaatgataaagggaaacgggagtatacaggaaaagcttctgacccaaattgttgtgagggacagtgagagaagcctttccaggccaggtgcagtggctcacatctgtaaccccagcaactggggaggctgaggcaggatcacctgaggtcaggcgttcgagatcagcctagccaacatgccgaaaacccacttctactaaaattataaaaattagccaggaatggtggcgggtgcctgtaatcccagctacttggaaggctgaggcatgtgaatcgcttgaacccaggaggtggaaatcccagcactttgggaggccgaggtgggtggaccacctgaggtcaggtagagatcagcctggccggtatggtgaaaccccgtctctactaaaaatacaaaaattagccgggtgtggtagctggcgtctgtagtcccagctacttgggagactgaggcaggagaatcgcttgaacccttaaggcagagattgcagcgcaccaagatcacgccactgcatgccagccagggcaacagagcaagactccattgcaaaaaaaaaaaaaaaaacagagagagagagaaggctttccagaggaggtgacactggagcaaaaccttgaagagtgaataaaagacagtgaggaaggagaaaggggagagcaaaagaaagatggagagaggaaaagcattccagtaaaaagggagacaaatgtgtaaagacctgaggagcctgggttcatccaagtaccatggatttatctaataaattgttggctatacatctaatatgggacaaagttcagaatctaggataaaacacacatatgcacgtgtgaacacacacacacacacacacacacacacacacacactctctctccaacctcatagaaaaaccaacaagggataaactgataaggaagaatacacaaaagaatttaagaataagtcattagagttaagaggaaagccaggatagagaaatgtcacagaagctaagaggtggtgccatggtttgaatgtgtcccccaaatttcattttttggaaattaatatttaaattaatattattaaaatattgaaaggtaggacctttaagaagtgactgtgttacattaggtagctagttgggtatgaacagggcaggagaggtctcccctgcccctcacatggggagtgtggagagactgttaggtgatggtcaggcggttgttaacgctctctaaagtaattattggtcacagctagtgctaggaaaaggcagcctcctaataaatagaaaacacctggtaattagcagcttcctgatacgatctcaggggtggggtgagtggggagaagtaatgcaagaccccaaaattatgccagtgtatgaaatcccaagtcaaaaggtcaaaccgcaggcttgtctttcaagttgcccacttggccctcttccaagtgtactttccttcttttccttcctttcattcttgctctaaagctttttaataaattttaactcctgctctacaacttgcctcagtttctccttctgcattatgtcctttacttgaattatttctttcaggaggcaagaattgaggttgctgcagacctgtacagacacagatctgccaactaacaattggatcatgaaggctgtgccctcatgaatgaatccatttatgtattaatgggttatcatggagtggaactggtggctttataagagaaggaagagagacctgagctagcatgctcagccccttcatcatgtgatgccctacactgtcttgggactcttcggagagtccccaccagcaagaaggccctcaccagatgtggtctctcaaactaggacttctcagcctctgtaacggtaagaaataaattccttttttaaaataaattatctggtttagggtattctgttataagcaacagaaaacagactaatacaggtggtttcaggaagtaaggagaggacaacaatgtcaaatcctatccaggtgtcacctaaaataaggactgaaaagtatttcgtgatcaacaattaagtaattggaaaccttacaagagcagtttcaggacagcagaaaagttaatcagatagcagtaggttaaggagtaggttaggaaatacagaggaactctttaagaacctttactaaaacattgttatagatgaattatgtaaccaacttatatactgatttttagttaagtttcttcctggagatttaagatagaactgacaggacctgatgatcaactgatgttaagctacctaacaaacttacatattcatgtcaccccctcttccccttctagtaataacagcatcaaaaaatacatatgttctagtctttacaatgttacctgatagcccaaattaattttatgggaaaagcgttaaattattccacaaaaatatcatttacacactttaggaattcagactattactagtttcctttttattagggaagaggtaatgatggaatatgaatgtggcttctgagtaggtgaccatacatctacctttgcctgggactatctgggtatgatcctatttttccttacgtagcagtctcttcactacaaaagtgttctggcttgcacaataaagcatatggtcacattacttataagcctcttttaaggaactattatctcattattcttgtaaagattaaaccatagaataccaaagagactctttagaaaatgcttaactacgtaagagttactactactgtagctataagggaaaaatagattgaaatgtacaaaccttttggagatatggccatatggacatcatcactacagaaaaccctgtgaagaagcaaactaggttatttatacttataataatttaatcattattacagatacaattttctgaaccgtggcatggattttaaaatattctgaacctaaaatctatgcatacaaatgcctaatttatgaggcaatgagattttaattatcagaagaaaaataaagactaaaagaacatacaattacagtccctcatcataataacaaatacaaaaaagcagaggatctacttctccatactcatgtgcttttactgtaaatggaaataaccaaaagctttgttaagtttttatagcagaaatgaatggaggaaaggctattttgttagacaggaagtgctaggcttctatcctgtgttgtttggaggagataattgactgaagggaagagcaggaataaggaaaatgatcatctacaggggggctatagaaaaccagaatacttcaagatggccataccttaaaagaaaattcactatttctgctagcctttactacatgaaaactataatgattaactccaacactatctgtcaattttaaatgttaggcaaatgcagccagcagtgacttatgcctgtaatcccagcactttgggaggctgaggcaggcagattacctaaggtcaggagtttgagaccggcctggccaacatggtgaaaccctgtctctactaaaaatataaaaattagccgggcatggtggcacatgcctgtaatcccagctacttaggaagctgaggtagaagaattgcttgaacccaggaggcggagtaggttgtagtgagccaacatcgcaccactgcactccagcatgggtgacagagcttgactccatctcaaaaaaaaattaaaaatgaataaataaatgttgggcaaatcaagaaattctataaagcctgttcttcaaaatggctttactgaggctgggcacagtgtctcacgcctgtaatcccagaactctggaaggccgaggtgggtgaatcacttgaggccaggagtttgagaccagcctggccagcatggagaaacccctctctgcaaaaaaaaaatacaaaaattagctgggcatggtagcgcatgcctgtaatcccagccattcaggaggctgaggcaggagaattgcttgaacacggaggcggaggttgtagtgagccaagattgcaccactgcactccagtctaggtgagagtgagactctgtctcaaaaaaaaaaaggaaaaaaaagaaaaaataaatttaaaaatagctgttgagatatataattcccatatcatacaattatgcatttaaagtatacaattcaatgggttttaatataatcacaatgggttttaatataatcacagatatgtgcaaccatcattacagtcaattttatttgatttatttattttttgagacagagtttcttgtcgcccaggctggagtgtagtgacccgatctcggctcactgcaacctccgactcctggattcaagcgattctcctgcctcagcctcccgagcagctgggattacaggctcctgccaccacaacaggctaatttttgtactttagtagagatgaggtttcaccatgttgaccaggctggtctcgaactcctgacctcaggtgatctgcctgccttgcctcccaaagtgttgggattacaggcattagccactgcgcccagccattactgtcaattttagaacacatttgtcacctcaaaaaaaactctatacccttcagctatcaccctgtttcatcccctctcctgccagctgtaaacaaccactaatgtactttgtttgtactctatagagttttatctgtattttcatacaaatagaataatataatacatggtcttttgtcttgtcttctttcacttagtatttttttttttttttttgagacagagtctcgctatgtcaccaggctggagtgcagtggcgcaatctcggctcattgcaatctccgcctcccgggttcaagcaattctcacacctcagtctccagagtagctgggattacaagcacgtgccaccacacccagctaattttttgtatttttcgtagagatggggtttcaccatgttggccaggatggtctcaatctcctgaccttgcaatccgcctgcctcggcctcctaaaatgctgggattacaggtgtgagcaaccgcgcctggccttagcattatattttcaagattcatccatggtgtacatgtacattccttatataaaccctattttaaaacataatttaattattagcttcatttcaggccaggcacggtggctcatgcctgtaatcccagcactttgggaggcctgggtgggcggatcatgaggtcaggctatcgagcccatcctggctaacacagtgaaaccctgtctctactaaaaatacaaaaaattatccgggtgtagcggcatgcatcgtagtcccagctactcgggaggttgaggcaggagaatggcgagaacccgggaggcgaagcttgcagtgagcagagattgcgctactgcactccagcctgggtgacagagcaagactctgtctcaaaaaaaataaataaataaaaataaataaatattagcttcattttaaagtattttgaattgacatagttactttgatcagtaaaggactgaaagcaccaattaatcttttaaatcaaggctacaattttggagtacagaaatttgtaaacaaaatgtttaacatgccaattaaaatctaaagttggccaggcacagtggatgatgcctgtaatccaagcactttgggagactgcggcaggcagatcatttgaagtcaggagttcaagaccagcaatggcaacatggtgaaaccccgtctctactaaaaatacaaaaattagctgggcgtggtggcaggcacctgtagtctcatctattcaggaggctgaggcaggagaatcgcttgaacccgggaggcagaggttgaggtgagctgagatcgtgctactgcacttcagcctggaagacagagtgagactccacctcaaaaaaaaaaaaaaaaaaaaaatctaaagttaaaataattttctttttttgctgttgaatttgaaattgtttcttataattttagataattgagtactaaaaaccagaagtgtttaaaatggaaaaataaatcaattgcaggcattgctaccaaaacagtatccattggccccttccaccttcttgatggaaccccagttctattcaggtatccatacttcctcaacaaagcctcatggtctaagagaaactctctccatgttcgatcccagagggtacattctgattagtctaaaaaattcaactggagtaatcccatcatcttagttgatgttggtttagaaatttacaggtcacacctgtaatcctagcactttgggaggctgaggcgggcggatcacctgaggtcgggagttcaagaccagcctgaccaacatggagaaaccccgtctctactaaaaatacaacattagctgggcatggtgccgcatgcctgtaatcccaactacttggaaggctgaggcaggagaatcgtttcaacacgggaggctgaggttgcagtgagccaagatcgtgccactgcactcagctcaaaaaaaaaaaaagaataaattacgttacagtataagccaactgattcagcactttttctgatatttgcacaaggcattctgttttttttttttttttttttttttttttgagacggaatcttgctctgtggcccaggctggagtgcagtggtgtgatcttggctcagtgcaacctctgcctcctgggttcaagtgtatttttagtagagatggggtttcaccatattggccagactggtcgcaaactcctgacctcgtgatccgcccgcctcagccttgcaaagtgctgggattacaggcgtgagccaccttgcctggccctgcacaagtcattctaactgatacacaatgcaaggtgaaaatgtattataaagaattgttgaaaatatcctttatcattcacttttctttttacccagtactgaatcatgcacaactttggcaagtgagagaaaacaggatgattggggtaaatagaaaatatatggaaaatatatggaaagcaatttagtaaaatgaccttccttaattcctctcaggggaaagagaccacttgtaatattagtgcctatagatttagagggtttctacttggaaaaaaattcatttcctaaaacagtcctttaaaaactatcacaatattgatcattcctatatattctcatcccatccttttaacatggttatagatgtttaatattttgaaaagttttcctcatgaagttttactttttagtaactacatattcagaaataatgtgaataggttaaaatacatcaagcaatacaaattgagattcttgtattttactttttgtatgttttatcaatataaaaataagttgaggttagaggcaacaaaagataaaaacagccaggtgtggggctcatgcctgtaatcccagcactttgggaggccaaggcaggtggactacctgaggtcaggagtttgagatcagcctggcaaaaatggcaaaaccccgtctctactaaaaatacaaaaattagccaggtgtggtggcacacacctgcagtcccagctaccagggaggctgaggcacaagcatagcttgaacccgaaagcgggaggttgcagcgagccgagatagtgccattgcactccaacttgggcaacaaagcaagactctgtctcaaaaagaaaaaaacagagaaggtggactacatcagtatttaacacttctgtgaatgtgaatcacaggatacatttagcacactgaatagaagagtcctggaatgggagaaaatatttacaaatcatatattggataaggggctaacattcagagtatataaagaattcctacaactcaacaacaaaaaatccaactaataaatgggcaatggtcttgaacaaacacttctccaaagaagatatacaaatggacagaaagcacaagaaacatgttcaacatcactaatcattaagaagatgcaaatcaaaacaagataccatctcatccactaggatgactactatccaaaagaaagttaacgttggcaaggatgtgaaaaaattggaaccctgactgttgttgagaatgtaaataaaatggtacggctgctatggaaaacagtatggcaattttccaaaaaattaaaaaattaaaaagaaaatcataatatgatccagcaatttcacttctggatatatacccaaaaggactaaaagcaggatcttgaagagatatttgcacacccatattgacagcagcactattcacaacagccaagaggtggaagcaacccaaatgtccatcgacagataaatggctaaacaaaatgtggtaggccaggctaggctgtaatcctagcactttgggaggctgaggccggtggatcacgaggtcaggagttcaagaccagcctggccaagatggtgaaaccccatctctactaaaaatacaaaaattagccgggcatggtggtgggtgactgtaatcccagctacctgggaggctgaggcagagaattgcttgaaccccgcaggcggaggtttcagtgagccaagatcacaccactgcactccagcttggacgacagagcgagactttgtctcaaaaaaaaaaaaaaaaaaaatgtggtatatactgaaggcaatcagagtatgctactccaaaaatctgctgttttgccatattaattatctcaaactgaaggcaaccgagaaatagcagatgcaggaagggttctctgctctccccctttctgcctgaatgcagagaatagattgaattttgttttgttgttaattctttgaggcacaattgagattctgttacctacaatctgtcttgggacattaagacacaggtataattaagactgtatatttaaacttaagaaattttgcactggccaggcggggtggctcacgcctgtaatcccagcactttgggaggctgaggcgggcagatcatgaggtcacgagatcgagaccatcctggctaacgccgtgaaaccccatctctactaaagatacaaaaaaattagctgggcgtgatagcgtgcgcctgtagtcccagctactcgggaggctaaggcacaagaattgctcgaacccaggaggcagaggttgcagtaagccgagatcacaccactgcactccagcctgggcgactccacctcaaaaaatgaataaataataataaataataaaatttttttaaaaagaaattttgcacatcttcaagaagtagcagaacaaataattgactgatggctgtaaagatgaaatacttttggccaggtgcggtggctcaggcctgtaattccagcactttgggaggctgagtctggcagatcacgaggtcaggagatcaagacatcccggctaacacagtgaaaccccgtctctactaaaaatataaaacaattagcgtggtggcgggtgtctgtagtcccagctactcgggaggctgaggcaggagaatcacgcgaacctgggaggcggagcttgcagtgagccgagatcgcgccactgcactccagcctgggcgacagtgcgaaactccgtcttgaaaaaaaaaaaaaaagaaaaaagatgaaatatttttaactgggggcggtgactcacgcctgtaatcgcagcactttgggaggccgaggtgggcagatcacctgaggttgggagttcgagaccagcctgaccaacatggagacatcccgtctctactaaaaatacaaaattagccaggggtggtggcacatgcctgtaatcccagatacttggcaggctggggcaggcgaatcgcttgaatctgggaggtggaggttgcagtgagctgagatcgtgccattgcactccagcctgggcaacaagagtgaaactccgtctcaaaaaaaaaaaaaaaaaaagatgaaatacttttgtgagtacatgaaagtgttagggactcttagtagttgtctagtttcgtttgtatgtacattccttaatgttatttgtttcttttcattaaaaaatattaacatcaaataaatttgtatacttttttaactgttagtctttcttttgtcagcttaattcacaagccttaagcacataggagaatagaggaaaaatttctcctaccctagaatacatataatgaactatacagcctttaaataaaaggaaattatcacaagtgcaacatgaaccaacttgaggacattgagtgaaataatctcatcacaagaaaaaaaatactatataattccatttatatgagctatctagaatagtcaaattccaagaaacaaagtttgctagggcttgggggatgggaaaatagggagttgtttaatgggtatagagtttctcttttgcaagatgaaaatgttctagggattggttgcacaacaatgtggatatacttaaggctattgaacttagatatggtaacacggtaaatttatgtcacgtattttttagcacaataaagataatttcagaggcaatgaaagtaaatgaagtaaatgaagttaaaatatgacatctgatctgaattgttaaaattatgtatttctaatacttacctacactgctgagaaacatagtaagatataaaatcctaatagatctccatcggctcttataatgctcttcagtctctaaaatgtcccattctctaggtgtaaagaagaaaaaagtagtataaatttatctcattacatgtggatcttaagtgtcaacagttttattctctagttatgaaaatgatgtgatagaggtagaatttaccaatattgattctgctacactaatttatctatgaataagcattatttttttgaatttccatggattgtatatatgcattattgtatacagaaatttgggaaacagtatagttttaaaagaggaaactttttgcaaggcaattattttgctaccattgacatgcacagatttattaatcaagagtgttgcaatttgtaaaaatgaataaattacgtcaagataaatcaaataaactagctacaactagatcccccgtagctactaagtactaaaaaataataactgtcatcattataacatgctctacttgatgacagcaaattaaattgctgcaggaagctcttttggcttcctacttcagaaaacaggaatgataccaggaaggtttaacgtaacctaagacattttcagccctgggacctcctaaatgggttaccagataaattttatcagcagaccaaagagagaccatgactccccagacttaagtgatcttttggataagcgtctgatctggaccaaaggcatgtatactaagtagatatcttacctccattaggtgacacatgagtctatatactcattacattttcacacacacaatagaaagagttaacaagttcaccttaacgtgagcattatcttttcaaataatcaagacatgcagaacagacaaaatgccttcttatgttccaagattaatttcttaaaaataagccttagaactgtcaaattagtcttcaaaaaagaaacttttttttttcaaacgtgatatggttgggagtggtaaagaggaaaggaagaagagaaacaatgtttttagatgtattatatgccaaacatattagttcctaatatatttaaagtgtttaacactatatatgtcattccatataaacaaacctcttctgagtcaaaggagataagaaaaaaataaaaataatgtagcttacctgagaaaaataccagaaccctagatgcccatactttgaaatcaatatactagaatttgaataaaaaaccagatatatctaagttagggaatcaagaagtaaattatttgattctaaaaaaataataaaattgtttgagtgactgatttagagctcagacaaaatctttcttcttttaatgacaaatgacaattattaaatattgaaaggataaaattagaaaataataatttaatggccactttctatgctataatggaaggatcatcaatggatgctaaaacaactgactggaagattgttaaggagaggatagtcaaaggccctcaaatgtcaccccagtgtctgcttactaattacaaaatggaacatgaacctttataattgaaagatatagcagtcaccctcttaacaagtggtcatgtttggcattcccagtagtgggatgtcctggcatcctgtaccttttgatgtaatgtagtggggtgttctcaacataacccatgtgatattcttgccagaaatgtttgaccaggatctattttgaaataaacagtccataaatccagaatattagatgttctgcagaaaacctgacctagactcttcaaagattttaatggtgacaagaaagagataggtcaaaggatagttttaggttaggggagtctaaaaagacctaacaacaaatgcataaacattgattatctcctgcatatggctcctggttttttttatttttgtttttttaaagaatataaggtatatttttggaacaattggaaaaacttgagtattaactatgtattgcatgatattcttgaattaatattgtatttctagttgtaacagtgatggagttgcgtaaaagaatttctttgttcttgggaggtgcaagctgcaattaagtacttgggacaaagtatcacaatgtctgcaacctacttttgggtagtttggcaaaagaggtgcgtgtgggtgtgtatgtacctgccgaaagatttcggcagtgtggaaaaggctaacagttagtgacaggatatacaggtgttcgtgattttttcatcttttctatagatttaacatttttcaaaataaaaagatttactttttccttttttaattaaaaaagtataacttcaatgaaaaaaattatctttctaccttgttggagacagtagaaatataggagaatgcaactgtccttcaatcaagtgaccatatttattacattttcttagctttgatgattcagacaaatatgtcacatatctgattgaatttccagaggcttctttcttgtatgaccgggtacaaaaaggaatgctgcatttctaagatgatttgcttaacttttaaaattcctttctataatcactgctgcattctggcattagttccccatttgagattttccttccagtaaaactgtagtactacagttttatcctgttcaacatttctattacaaactgaaatactccaaatgatagcatgcttgtcaaacttgtgacttaaaaactaaaaggaatacacaatatagtggagtgaactgatcagcaaaatgagttagataaaatttaacaacggccaggcgcagtggctcatgcctgtaatcccagcactttgggaggccaaagccgggcagactgcttgaggtcaggagttcaagatcagcctggccaacatggtgaaaccctgtctctactaaaaatacaaaaattagccaggcgtggtggtggatgcctgtagccccagctacttaggaggctgaggcaggagaatcacttgaacctgggaggcagaggttgcagtgagcagagattgtgccactgcactccagcctgggcaacagacagtctgtctcaaaaaaataaataaataaataagagagagaaaagaaagaagtgtgtgctcagtgacagaacagtgtagtggtataacagttacagaaataaactgaaaatattctataaagatatgccctataaggacagatgccctaataatacaaattttacagagactaggctaaggttgcaaaaaaattttgaaatcatttgtaacttggatcagtaacgtgagctacaaacggtttttacagatgaatatttatcagtttgatgacagaaaacaccaactctgaagtgcaattaaggaaaatgtcatcccctcccccaccaaattctatccctttcattaacaaacctatattatacttattattatattttaaatgtcattactaaaaaattttgtggaatttgttttctggttatctaaacacctatataatatccttgatttttccccttgccctaaacaagcctaaaatatttacaatctgggactttacaggaaatgttttccaacccctgttgtcttaaataaagctccatagagggggtcagtggggagcactgaggattcaagaggccagctccaccagaccagcaaataataatcaaccttgttagtgaggaaaagttggtggtgacctagacatgtttgtgcaatatattcaaagtgaacaggtcctgccaactagttgtacataggttcactttactagggaatatacttgtttttaaagacatatacttattattttcaaaatactccctttttgtttttaaaatgctaaatctagaacctcaatcagaggtattgattattggcaggaacacctaaatctggacagatcctaatgagcatcaatcactttgatgaaatcaaagctaagagtatgaaaaaaaattctcttttgtacaaggtgacagaatgtaccagaagaccacatttaaacataactcagggatcctgcaattatctggaaaatagctaaaaaccaggacgaagcaaaaagaattctgaggccgggcacggtggctcacacctgtaatcccagcactttgggaggccgaggcgggcggatcacgaggtcaggagatcgagaccatcctggctaacacggtgaaaccccgtctctactaaaaatacaaaaaaaattagcccggcgtggtgacgggcgcctgtagtcccagctactctactcgggaggctgaggcagaagaatggcgtgaacccgggaggcggagcttgcagtgagccgagattgcgccactgcactccagcctgggtgacagagcgagactccgtctcaaaaaaaaaaaaaaaaaaaaagaatttctgagttctgagaaaaccaaatgtcatgaagtccacgcactcaagcttatgcacttaactagtaggaaagacatttagctctcagtcagaactaccaggttgtaatgacacacagttacattaagcatagatccagggttatcaaagctataacaaacaagaagccccaaattaaagctggtggaaagagtatggtgacagcaacaacaataaaacaactgttgctgccagatttcaaaaacatgatgcagaacagtctgcgaggaaaacagtctgtcagaaaaactaaaaagcagacgtaagtacttaaaaagtatagcaacgggcctcagagcctattgagacatttgggactgtttgcttctacaccagcactttgggaggctgaggtgggtggatcacttgaggtcaggagttccagatcagcctggccacctggtgaaaccctgtctttaccaaaaatacaaaaattagccgtgtctggtggcccacgtctgttaatcccagctactccagaagctgaggcaggagaatcgcttgaacctgggaggcagaggtggcagtgagccaaaatcgcaccactgcactccagactagcccacagagcaagaccccgtctcaaaaaaaagtatagcagtgtagaataaattggtatagaagcaacagtcccaaatgtctcaataggctctgaggacatcactctattaaaattcatatcagcatcgatattcattttaatgatctcaagataaaatcaagtaaagataaaactgcactccaggctcaccactgcactccagactaggccacagagcaagaccccgtctcaaaaaaaaagtatagcagtgtaaaataaattggtatagaagcaaacagtcccaaatgtctcaataggctctcaggacatcactctactaaaattcatatcagcatctaaactcattttaatgatctcaagataaaatcaagtaaagataaaactgcattgcataaactctgtttagtaaatcgaggaccagagaaatacatttgccaaagggttttgagttagagtgctcacaaaaggttggtgcttaaggggaacaaatgagtaaaaattattatggtcatagacagctgaagtttaactgaatttattaatttacctgaggtaattattatgtatatttcaaataaaatagtaattccgttttcctaaaggtaaaaatacattaggtatacattcccgagtcactgcccataaactaggatcagaacaaccagaattataaggatcaaaatactgacgttattcctttaatgccttaaaattagtctttctttgtacatttggcataggacaaaggcgagctcattttggacagatttgttaaactatcaagaggttgtcaggcaattaggcagcaggtcattactaagaccgataccttcaagtatctattaaaaccatcattttgaaactgtgaaatctggaaagtgatcagctacaaagggccaaatatggaatgcagaagatacagaatgtggtggctttgtgtccgggattggtgggttcttggtctcactgacttcaagaatgaagctgcggaccctcgcggtgagtgttaacagctcttaaggtggcacgtctggagtttgttccttctgatgctcagatgtgttcagagtttcttccttctggtgggttcgtggtctcgctggctcaagagcgaagctgcagaccttcgtggtgagtgttacaactcttaaggcggcgcgtctggagttgttcgttcctccccgtggtctcgctggcttcaggagtgaaactgcagaccttcgcggtgagtgttacggctcataaaagccgtatggtcccaaagagtgagcagtagcaagatttatcgcaaagagcgaaaaaacaaagcttccacactgtggaaagggacctcagcgggttgccactactggtgggcagcctgcttttattctcttatctggccccacccacatcctgctgattggtagagccgagtagtctgttttgacagggcgctgattggtgcgtttacaatccctgagctagacacaaaggttctccacgtccccactagattaactagatacagagtgttgacagaaaggttctccaaggccccaccagagtagctagatacagagtgtcgactggtgcattcacaaaccctgagctagacacagggtgctgattggtgtgtttacaaaccttgagctagatacagagtgccgattggtgtagttacaatccctgagctagacataaacgttctccacgtctccaccagactcaggagcccagctggcttcgcccagtggatcccgcaccggggctgcaggtggagctgcctgccagtcccgcgccgtgcacccgcactcctcagcccttgggtggtcgatgggactaggcaccgtggagtagggagcggcgctcatcggggaggctcgggccgcacaggagcccacggagtgggtgggaggctcaggcatggcgggctgcaggtcccgagccctgccccgcgggaaggcagctaaggcccggcgagaaatcgagcgcagcgccagtgggctggcactgctgggggacccagcacaccctccgcagccgctggcccgggtgctaagcccctcattgcccggggccggcagggccggcctgctgctcccagtgcggggcccgccaagcccacgcccactcggaactccagctggcccgcaagcgcggcgcgcagccccggttcccgctcacgcctctcccaccacacctccctgcaagctgagggagccggctcccaccttggccagcccagaaaggggctcccacagtgcagcggtgggctgaagggctcctcaagtgccgccaaagtgggagcccaggcagaggaggcctggagagcgagcaagggctgtgaggactgccagcacgctgtcacctctcagcttgggtgctgcaacaggcaaagcagcagcctgggtttctccagccccgtcactcgaacccacgggctcatcaccgcacggtgcggccagacgccctttctcctacgttgggagcgaatctcctcggctcacacaacccagccaccggctcccaccgcgctggaacccctctggcagcgagggtttgtcccagtgcgggtgacgcccggaaaggaaccagtcccaacagcgcaggagactgaggggtccctccaccaggatccgctcacctgcttccaggtgtgtcgcctaagagcggctcctgttcactttcgttccgcaggccggccatagttacactccctacaaggcgtcttgcgcccaactctcgcgacacctgctttctcccatcccgggtggcgtgaagctggcaaaacaagcctgtaagtgcgcgtgcgcacctgacggtcagacgtaggcggaacgccccgaggtcataggcggggtcacgcggaaggccgggcagcgcagggcgaaaggaggctgtgtcctcagcctcctccctcggcacgcgcctcccatcctgacggggactgagagcccaggagagctcggggcgtgtccaaactgccgcgccgccctgctccgggtttgtcttcctccctccgtttctccttccgctgtatctagcatttcggttcctggaaaggttaccggagctgcgattggggctgggaccaaagttgagtcctggaaagggagcctggagagcggcggtgctgggaggcccggccagctcgatcgcaggcttccacctggcggccagtaagtagccggtccggttaagtagtaggtgcgctaagagctccccgcgcctcttagcgcgccgtgtacgcgcctggaggcagggaccggggacgcggagctgggcgggagactcgcgggtcagggacgcggggtgaggctgggggtgagagacaaggctggagtccgtggcgcgcttcggagggctgagataatgggggcgagcgcgcgggcagtcccttccccccgtgaaaggtagaggtggcttccagctctcttctctagctcggctaaatgcaaaggcgccttacctggagggcttgtcagagccaggactgaaggtgggatctgctgcttgtaacctgcaggtccccggatgcgcaccccaacggcgcctgcgcctacgggggcctcagccttgcaaaatgtcactcagcagagcctgctgctgaaacgtgggagttgaaaaaggtacagcacctgcctagcaatgaccagctcctttcgtcacaaggaagatgacatttttagaaaacatgtcatgggttttcactagatctccatgtttatttcttggtggttatgtattaacatcttatctctactattaggcttgtaggctagctggcgtcagtagtcattctgtgtctcataaattaccgttttattagcgccagatacattgtcatgtaatttcatttgatcacaagtatcctatgagataggcgaagcagacacattgctagtttactgaaaattaagatccagacaagttaacccagagtcactctgtgtggaagtggcaaagttggaaaccaaacttaatttttttaaattaatatttatgagcatttaccctatgctaggtcctatactagttacacagtcatgtatggtatatgccatcacttctgatctttgtgtcatttgtgaccttgtgtgtatcagccaggcgcagttcactggtgaacacctaaacttgaaacgtgcggtctgggtgcgatggttcatgcctgtaatcccagcaccttgggaggccaaggcgggcggatcacgaggtcaggagatcgagaccatcctggctaacacggtgaaaccccgtctctactaaaaatacaaaaaaaaaaaaaaaaaaaaaaaaaaaaaaaaaaaagccgggcgtggtggcgggcgcctatagtcccagctactcgggaggctgaggcaggagaatcccttgaacccgggaggcggaggctgcagtgagccgagatcacgccactgcactccagcctgggcaacagagtgagattctgtctcaaaaaaaaaaaaaaaaccaaaaaccttgaaacgtgctattcagaaatatcttctaaatcaagacctgatattttgtacttggattcagtcttgcagattcatttgtaacagctcacaaaaacaagtcagatttgtattattggttccaaaaagacacataggtagaaaagttagtattttcttgccataatgtcgctttattatattgtcttttttaattcctgggggctagcaatgtatggcacatatatagtggacaaggggatttttaaccagtatagcagtaagcagaatggctcctagataaatatatgttggatgaatgctcattgaattacttcatctcatccttacaacaatcctctgaggggggaattgtctcatgtgtacaaggaaatggaaggcagggagattaagtaacttgcctaggatcatactactaacaagcaacagagctagaattcaagaaatgcaggactcctgatcctaagcctgtgctctttaccaccaggcttcttatgggaaaaaatggcaaagcggcaagaagaatctttccttatatctcataaaaatatatagtagatattcagtttttatctaagtgaaataattggctatcatgtatcagggcagatattactttctgtttataggttaaggtggcttactcaaggtcacacagctggtagaggaatcccagccctctgacactgctcttttccattggtgcctccaagtgatgacttcagaccacaaaagcatatggaatgagtacatatacagctggtgaaatctaagtaagcttagtgtattgtaccagtaggaaaaaaaaaaaaagaaaatgtctcttaggaacacacacatagcatccaaagtaaacatttaaacatatatatatatgtaatttttttttataaagcccatggaaaagaggagctaaatttgaagagattagattatttcccgaatgtttcacacaagaatatgagactccatttggtgcatttccttaggtgactgcccaggatatttacccacacccctttcaaacaaacagccgggcgcggtggctcacgcttgtaatcccagcactttgggaggccgaggcgggcggatcacgaggtcaggaggtcgagaccacggtgaaaccccgtctctactaaaaatacaaaaaagtagccgggcgtggtgacgggcgcctgtagtcccagctactcggagaggctgaggcaggagaatggggtgaacccgggaggcggagcttgtagtgagccgagattgcgccactgcactacagcctgggcgacagagcgagactccgtctcaaaaaataaacaaacaaacatcctattttcttactcttgttcagtgtaagagtaaggaattatatttgttgaattatatttgtgaagctagggaagtagattttaacagtggatatctgaggtatctaaaccctttcttagctacttaaacttgtatagacattatttagaagtgaaattacaagataaaatttaaagtcttcttttttaggtaagggaataagttcttgtacatggtgatattttttaaattttcatttatgcctttgagatatgtatcaccaatgtaaggataaaagtccagaaaaaattagtattgcattgttaaatgcttaggtacccaaatgacaggaaataaaagcactagatagcataataaatgatgagtgtcactttagcaatagaactcatttctaggaaagactttttagttcttggcactgtactagaacttctatttttgtttccctttgcttttccctttcacattgataactgtgtcattttagcttgatatatacttcaaaaataggttctatttctgcagaagctcattgttgtctgtccagcctgaagtggggacttttaagtatctggcatgactccagatggtgccttattttggtgatttggagttacgttcaccctgggcttggatttttatctgttcatggtggcactagataccctggacccagccaaccctgtctagaaagacttacgtgtttagagagttccacaaaaactgtcttttatgttgttcttggagctgaaatgggatttaagaagatttgtatgaccccaaaccccagaaccaaatttatactaacctatatgtgcgtttgatttactttcttttcctcatttattagttgtttattagtaggtaaatatagtaaggaatatgctgtgtctaagtttggagtgctgacttttgtggcctgttatgcagggaattaaagtgatttgggaaggttttctttttttcttttttcttttttttttttttgagacggacttttgctctcgttgcccaggctggagtgcaatggtgcaatatcagctcactgcaacctccacctcctaggatcaagggattcacctgcctcaacctcccaagtagctgggattacaggtgcccaccatcacacctggctaattttgtatttttaatagagacggggtttctccatgggtcaggctggtctccaactcccaaactcaggtgatccgcctgcctcagcctcccaaagggctgcgattacaggcatgagctactgggaaggttttctagtttgggttgaaaactagaaataagtaaataatttaggcaaacaataaatatagtactttacaaaatatttgaaaagttcattgttcttaggtcctttcttgcttcctttgcaactttctaattctatatttttgctttatcttggttttatctaccaatctagaagaatatcaaagtttaggaaaatggagcatctcatgagcagtatattacttttcttcttactgtaaaatataggtgttggaatttttttttttttttggagacaggattttgctctgttgccgaggctggagtgcagtggtgcaacgatgtgcactgttgcctcaacttcccaggcttacacaatcttccctccacagcctactgagtagctgggactacaggtgtgcaccaccacacctggctagatttcaaaatttttttgtagagacagggtctcattgtgttgccagggcttgtcttgcgctcctgggcccgagcagtcctcccgtcttggcctcccaaagtgctaggattacaatcatgagccactgcgcctggccaggattttttttttttaagagacgaggtctcactatgttgaccaggctggtttcagattcctgagctcaagcaatcctccctcctcagcgtcccaaagtgctgggattgcagatgtgagccaccacacccagcctagccaggatttttaattaaatgttattttactattgtggattctacttattgttattgatgccatgggtgttacaaagaaagatgatgcccctggttcatttcatgctgatgttaagaaaataagtgggcccagtgtggtggctcacgcctgtaatcccagcactttgggaggccaagatgggcagatcacctgaggtcaggagtttgagaccagcctgaccaacatggagaaaccccgtctctactaaaaatacaaaattagccaggcgtggtggtgcatgcctgtaatcccagctactcgggaggctgaggcagaattgcttgaacccgggagacggaggttgtggtgagccgagatcgcaccattgcaatccagcctgggcaacaagagtgaaactctgtctcaaaaaaaaaaaaaaaaaaaaagaaagaaaataagtgacctataatatattgcaaaaggcagtgaagtcctatctgggtgcagttgctcatgcctgtaatctcaggactttgagaggctgagatgggaggattgcttgagctcaggagttcgagactagcctggtcaacatagcaagaccctcatctctacaaaaaataaattaggctgggcatggtgactcacgcctgtaatcccagcactttgggaggccaaggtgtgtggatcacctgaggccaggagttccagaccagcctggccaacatggtaaaacactgtctctactaaaaatacaaaaattagtcagaagtggtggtacatgcctgtaatcccagctacttggaaggctgaggcaggagaattgcttgaacctgggaggcggagtttgcagtgagctgagatcgtgccactgcattccagcctgggtgacaagagccagactctgtctcaaaaaaaaaaaaaaagaaagaaattagccgggcaaggaaggtggcctgtgtgcctgtggtcccagctactctagaggctgcactgggtggattacttgagctgaggagattgaggctgcagtaagccatgattgccccactcgcactcaagcctgggcaacagagcaagaccctgtctcaaaaaaaaaaaaaaaaaagacaatgaagtcttgcattccaatgacatgccactgttctattgcactttaataaatgtatgcaaaagatatattgatgctgtatattttaacaattccagaaagacccagggaataaaataattaaaattatcacctagaattatttttcctcatgccatagcatgtcatgccaccccctgccactctctgaatatgtccagagttggcttttttttttttttttttttttttttttgagacgatcttgctctgtcgctcaggctggagtgcagtggtgtgatcctggcttactgcaacctctgcctccctggttcaaatgattctcctgcctcagcctcctgagtagctgggactacaggcacccgccaccacgcccggctagttttttgtatttttagtagagatggggtttctccgtgttagccagggtggtctcaatctcctgacctcgtgatctgcccctcggcctcccaaagtgctgggattacaggcgtgagccaccgcacctggcctaagagttggcatcttatttggaatatgtaacactaatcagaattttggtaaagagtaatctattccatttccactccaactgggtgtacttcagttcccaattctgacactaaccacctagaattaatgcagaccccacaagttaagggctcagttcttcagatgcacttcaggggtctccaggcctctcatccttctgaccgacttggctaaaaatttaggagctcctgagagccctgtgggtctataatttgctagaatgactcagaactcaggaaacagctaaatttatgattataggttattataaaggatacaactcaggaacagcccaatgaagagaaacatgaggcaaggtatgggaatgaatgtggaactacctggcctcttcctatggactcagggagcatctccttcctgacgcaccaaggtgttcatcaactagaaagctccaccaaggtttagtgtccataatttttactggagtttcattaataggcatgattgattgaatctttggccatgtgattgaactcactttccagctcccttcccctctgtggaggtcagagggtcccaaagttcctttctggtggccagccctgattctgaaactttcagggggcccacagggagttgcttgtttagcataacagacactcatcacttaagaaataccaggggttttagaaacttcatgccaggagctgaggtcaaagaccagatatactcttttttttttttttttttttttttttgagacagagtctcgctctggctaatttttgtgtatttttagtagagacagggtttcaccatgttggccgggctggttttgaactcctgacttcaagtgatccacctgccttggcttctcaaagtgctgggattacaggcgtgagccaccgtgcctggcccagatatactctttattattccagagtgacatgccctctacaagaaaaacactagtcaagcaatttatatactacatatacttacatgattgtaattgcactaaagtagaaaatatataattaagacgcatttcagaagttagtttgccttttaccatttgtttcatgattaaaaaaattctaagaggcaagtgtttttactttgttttggtttttttgttgttgtttctgacaaaggtgttaagtgaatgaaaatatataaacatgatttagacaatcttttctctcccctaccctccccactcgtttcctttcttttcttttcttagaccgggtctcactctgtcacccaggctggagtgcggtggtgtgatcctggctcactgcatcctctgcctcctaggctcaagcaatcctcccgcctcagcctcccgagtaggtgggactacacaggcacacaccaccactcccgggaaagttttgtatttttcatagaggcagagtttccccatgttacccaggctggttttgaactgctggactcaagcggtcctctcacctcagcatcacaaactactgggattacagatgtaagccaccacgccttgctgatttagacaaactttcaaaatttgcttataaacaaatgtttattcaagtctgtggagtttgggggtttttttttcccccttactggtaggaaaatgtgaagaaagtaagtaacacctgttattgagggtgtcagcccagatactctactcaaatgctgagaagtataattggtttctctcagtgtagcagacagtttctaaggtggccctcaagatcctcaaattctgatgttcatatttttgtgtgatccccttccttgagtttgggcagaacccatgatttgctttctaaccaggcatatggcaaaggtgattggctgttattcccatgacgacattatgttatatggcaaaggtatggctcctgtggctcacacttattttcctgctggccttgaagaaatagctgccatgttgtgaacttcctatgaagagagccatgtgacagggggctgtggatagcctccaggagcagaggctggcctctggctgatgaacagcaaaaaaaaaaaaaaaaaaaaaaaaaaaattgaagctcatagtcccacagccacacacaaaaaaaatgaattctgccttcaacctgagtaagcgtggaagtgagttcttgtctcttcaagcctacagatgaaaatgaagcccagctgacaccttgattgaagccagatgaggttctgaagcagaaaacccaactaggctgggttcttggaagataatcctcaaggaaaagggaagaagatggaggaaacaaactagatgcaagagatttgttcttcaaattatattctttaaaggtcttagttattaaaagcttccaactatttaaattatgcaatggtcttttttgaagagaatattaaccttaagttctgtttttttttttttttttttttttttttgagacagagtcttactctgtcgcccacgctggagagcaatagcactatcatagctcactgccacctcactctcctgggctcaagctatcctcctacctcagccttttgagtagctgggactacaggcgcacaccactatggaccactgcacccaactgtattatttttgtgtgtgataaggtctcactgtgtcaccctggcctggagtgcagtagccatgatcttggctcactgtagcctctgcctactcagttcaagcaatcctcccacctcagcctcctaagtagctggaaccacagccatgcaccaccacatctggctaattttttgtatttattgtagaaatggaatttcaccatgttgcccaggctggtcttgaactcctgggctcaagctatccacccgtgtcagcctcccaaagtgcaggattacaggtgtgagccatggcatctggcaagttctgttctgagataaatagtgaactacttctggctgggcgcagtggctcacacttgtaatcccagcactttgggaggctgaggagggtagagggtggatcacctgaggtcaggagttcgagaccagcctggccaacacggtgaaaccccgtctctactaaaaataacaaaaatcagctgggtgtggtggttgtcgcctgtaatcccagctacttgggaggctgagccaggagaattgcttgaacccaggaggtggaggttgcagtgagccgagatcgcgccattgcactccagcctaggcaacaagagcaaaaactgtgtctcaaaaaaaaaaaaaaaaaaaaaatagtgaactactgcttactgacaaagttgtcaaaaggaaaagaaagcatcaatttacttcccctcaaaattttatttggagactcaaccccaaattctattttgttttctcagttttttttcttgtggtaaaatacagtaacaaaatttaccatcttaataattttaactctatagttcaaaggtaagtatatttatattgttgcgcaactgtatcaccaccatccatctccagttttcttcttgcaaaactgaaactctatacccattaaacagtagcctcccccttttcccatccccccagtactgggcaaccatccttctactttctgcttctatgaatctgactactctaggtatcttgtttaaattgaatcatacaatatttgtctttttgtggctgactaatttcacttagcgtaatgtcctctgagttcatccatgttgtatcatgtgccagaagttccttcctttgtatgactgaatatattcctattgtgtgtgtgtttgtggttgtttgtatgtacatactttgcttatccattcatctgccaatggacactaaaagctcccaccttttatgtatttatttataacctaggaagtgaagaagcttctgccaaattctaaattttatggaggaaaacaaatcatggctgattagataactagtgtttactttagatagaatattaattttaggtctactttatggcatatagaatttttttaaatcaatatttgcattatatttatgcccattttatagggttgggataatttacttatttattttactttattttattttatttattttattttgagatggaatcttgctctgtcacccaggctagagtgcagtggtacagtctcggctcactgcaacctccgcctcccaggttcaagtgattttcctttctcagcttcctgagtatctgggattacagacatgtgctgccacacccagctaatttttgtatttttagtagagatggggttttgccatgttagccaggctggtcttgaactcaagtgatccgcctgcctcagcctcctaaagtgttgggattacaggcatgaaccaccacgtctggcctgtaattttaatctagtgatttatagttgtatctttacatttataacattagtgttatatttgtgtcatacctatgatttatttgattttctaacccaggggtcaggaagctatggcctattgttcaacctgcctgtttttctatgtctttcaagttaagaatagattttacaggtgaacatttgtacccaatttcattatggggtactaactttgaatctcaattaagcaaacgcccaagaaaaaaaaagtttattcttctcattaattatacattacaaaaaattatactcagttatttttatgacattttgaatttcctcaatgcaaaaaatgtgactctgaaatgaaaaaaatgaaaaaaatgttatctgaaatacctacataatatccttaattttgcctcttgtcctacaaggcctatcatatatactgttcagccttttgtggaaaaactttgcagggtctctcctctagtctttttatagcattcttttcagatactatttggaaacatattaaaatggaaactaaaattttatgtttatatcatctatttattgtttttccatgaggaattctactaggtatcctaccagtcattggatatacttagtataagttgtttttaaaatatcctttagccaggcgctgtggctcacgtccgtaatcccagcactttggaagaccaaggcgggcggatcacaaggtcaggagatcaagaccatcctggctaacacgctgaaaccccgtctctactaaaaatacaaaaaattagctggccgtggtggcgggcacctatagtcctagctacttgggaggctgaggcaggagaatggcgtgaacccgggaggcagagcttgcagtgagccaagatcgtgctactgcactccagcctgggcgacagagcgacactccatctcagagaaaaaaaaaactaattaaataataaaatatcctttagtttttgtgtaccttaaaatcaatattttctcccaattaggtatattattaaggctgttttggaaaaatgttattcaggtataatcagaaatctgtttaaaaaaaaaacaagctgggcgtggtggctcacgcctgtaatcccagccctttgggaggctgaggcaggtggatcacctgaggtcgggagttcgagaccagcctgaccaacatggagaaaccctgtctctactaaaaatacaaaattagctgggcgtggtggcgcatgcctgtaatcccagctacttgagaagctgaggcaggaaaatggcttgaacctgggaggcagaggttgcagtgggctgagatcatgccactgtactccagtctgggcaacaagagtgaaactccatctcaaaaaataaaaataaaaaataaatttaaaaatctgttttaaagacagttataaaaatatttagggtaatacagattgaaaagcttaatcctataaaggtagtaacatgcatagaactttctttatgatttttcatcttgggtttctgataggcttaactttgaagaaattagaggagtggcatagtatagtagaaagatgcatattgcattacaaacgaataagtctctgctaaatgtttgatgcattcatttccaattctaatacaaaacttgcaggacagaagaaacatttagaataaattttttttttatgaattagtaataagcatctaagtagaaaacacaaagaaaaggaatcttatggtagttatcacaaatactaaataatttattagtagcagaatttgtgtagtaaagatacttaaaggatagcataaacattaactgagaaaataaataaaactggattaatgaataaataggtatatctcttgatgagaagactaaaactcacaatgctattgagttaatatatggattgaacactctattaaataattacattgccagtggtgtattttatgtcatgacataaactgaatatatatggaaaactcattgtagaattttaaacatgaaaacaacagttgtagtttataagagctatttgaaagaaatttaaaacaatatagattttagaacttaatccaagtttatgaaagacttctagatttttatttttgaaaatttttgtgggtacatagtaggtgtatggatttatagatttctagattttaaaaataggaattagaaaacagtagagagaaaatgttcctggaaaaatggttagtaaagagaagaaaaatactccattttacaatgaccgccaatgagaagaaggaatttaatattttaaagaactaaatttgaatacttttacagcgtattgaggagttctgctggatgtgatgagatggattggttgattatataaacatttaagcgtacagaatacatgtaaatataatttgtaaaattaatggaatggtagaagctttttggtataaatctgataaagacttaaaatcctgattctgtactaggtgtagcatttaaattttcaaagagctgtttaagtgccttctatatactaatttaaattgcataccaattatttgaggtaagtattatcattacttccattttacagatgaattacaaaaaggctaagtgacttgttaaaagtcttatagtaagaatttgacccaatttggctctagagtctgttctcttagccacagtgatatatcacatattaaatacagatgctcctcagcttatgatatggttacatcctgataaaccccactgtaaatagaaaatattgttaagttgaaaatgcacttaacactccaacgaacccactgtaaagttgaaaaatcgtaagttgaaccactgtaagtctaaatgttcctcagtttatgatgaggttacattgtataaattcatcataaagttgaaacatcaactttatggtaagtatgtaagtcaaactgtttattcaaagtaaatgtaaaatagctaaatgtgaacaacctacagaatcaataaaaaacaacaaaccaaatatttatcatcataataaatataaatgtcctaaatttacctgttaaaaagatgaggtggatctgtataccctgaatttgaaagagctttgcagctgtttataaacaagaggaggaatagcactgaaaaaataattagtagttactctcttccaagtttaaaaaacaccaaaaaggctgggcgcggtggctcatgcctgtaatcccaacactttggggagctgaggcaggtggatcacgaggtcaggaaatcgagaccatccttgctaacatggtgaaaccccgtctctactaaaaatacaaaaaattagccaggcgtggtggcgggcacctgtagtcccagctactcgggaggctgaggcaggagaatcatttgaaccggggaggcagagctggcagtgagctgagattgcgccactgcactctagcgtgggcgacaatgcgagactctgtctcaaaacaaaacaaagaaacaccaatggatggaacaaggtattaaatggatagaacaaggtattaaaatattaacaatggcggccgggcgcagtggctcacacctataatcccagcactttgggaggccgaggcgggtggatcatctgaggtcaggagtttgagaccagcctggccaacatggcaaaatcctgcatctactaaaaatacaaaaattagctgggcgtgctgctgtgtgcctgtaatcccagctatttaggaggctaaggcaggagaatcacttgagccaaggaggtagaggttgcattgagccaagattgtgccactgcactccagcctgagcgacagagtgagactccatctcaaaaaaaaaaaaaaaaaaaagacaatgggaggacacaaagaagtgatgaagagaagtttctccactttataaaatttttatattgtcttaattctgccaaaaatgtgttacattactttagtaattttttaaaaagtatgtgcagtggcttaaatgtgttcccgatagttcacgtgttggaaacataatccccaatgcaatagtgttgggaggtgggtcctaataagaggtgattaggttatgagggctttatcctcatggatggattaatggtattattttggaagtgaattagttatctggagagtgggcttgctctaaaagtgagttcgattctctattgctctcttatgtgataccttccaccatgttatgcagcaagaaggtcctcaccaaatgtttccccctcaaccttggacttccaacctgcagaattttaagaagtaaatttctcttctttataaattacccagctggtgttgctctgttatagcaacacaaaacagagcaagacagtgtgtgtaggtaaataagtaacatcaacaagaaaaagatcagaaagagtagaatccaaactgttagcactagatatgcctgaaatgcaaaattagaagtgattggaagggggccaggtacagttgctcatgtctgtaatcccagcactttgagaggccaaggcggacggataacctcaggtcaggagttcaagaccagcctggacgacatggtgaaaccccgtctctactaaaaacacaaaaattcgctggggtggggtggtgggtgcctgtagtcccagctactcaggaggctgagacaggagaattgcttgaacccaggggacggaggttgcagtgagcttgggatcgcaccactgcgctccagcctgggcaacagagcaagactgcatctcaaaaaaaaaaaaaaaaaaaaaagtgattggaaggggattattttctccatttttactatacataccttcatattgttgaatttaaaaattttacagtgagcattttttaatttaaaaacagtatttaatttttttttcttgcctttcccttatatgaattatctgtacctgtgctttacccactgggtagataattttcaacaaatctcattggaacatagtaatgggtagatttcaagaggtgtatgattttaatgagatttgcaatttaaagacttgggtgctccttttcatgtagctattggcttaaatacttacagtctctaacttatggtggtttgacttacgattgtttcaacttgaccataggtttgtcagggtattaaatgtatattccacgtatgatatttttttacttatgatgggtttattgggatgcaatcccattgtaggtcgaggagcatctgtatttttggtacctcttcaaagatttttttaaattaccaaaagagccctttagttgttagcacattgccttgtttcattttcatcatagtgttattctactcttattttgatagttagatagattttttaatttttaattattttccctccactaaaatataagatcaatgagaacaagaccattcctttgtcatttttgtggcacagggcctaaaataatgattggaatataataagcagttaataaatatttgttgaatgaaaaaaatcatacatattcttagaagtgcaggaacttattaacccacccagggatggttcatctatggtgaactgcactcaacactggatggatgataatttataggaatctagtaattaataccagtttatgtatagtggtagacacaaatagtataataaaactgtatatgcaatacatttttttgaacattattgtgtcaaaaccccacatttatcaaagagccattgaagagcacatggaaactgggaaaaagagagatgggtgctattaaaaaaacacttaatcctatactctggccatacgttgtcttgtctgacaagtacattagctagtaaatgtttcttcttggtactgagaattatgagaggcagtatgaaagacttggttttgctagtccaaccataaaatcaacttaaatgccagcccaattgatggtgggttacattctacacgtaggcaaacagaggaatattaagttggtcttgcaggttattaaaaaatgaaaaagtaaaaatagaagataaaagggatggtttcaaaaaaatctgaagcaatggataagtatttcttaaagcccattgatggaaatgcagatttcctaagatctgagaaaaaataaaaaacaattgaaaaaggaaatgcagattttcatttttcatttatttaagtagagtaaaccctgaatctgaatcaggtttcacccgcaaatcaaaaccataccattcagtttgacaagatagaggtagatacttaaaaatctttagaaatacttgagaagatagataaatggtataaaagtagtagcagtgattatttattatttttcattcactgtagtatagtagaggggagtgtagtgtggtagttagatgttgagctgtgtacctgggattgaatcttagctatgtttcccactagctgtgtgaccttgggtaaattatactctctatgcctcagttttcttgtctgtgtaattgggataataaatccttcctcaaaattgttggtaggtttaatgagaacctgcgtgtgtgtttgtagttcttaaaatagtggtgcctggcagataatacactatcacatattatcccctactatttttatccagcaaatagagggtacttatttcagcaactgtactgaggatgggaagatcctaccctagagaaattcacagttcagtgaagttcaaaggtgtacatcttctctattttcaactcagctcttttttttcccccaaatcttgtattttgtttccaaaggaattaattcgtctcaatctttaattttacatgatagtcaaagaaatggttagaaaattgacctgctaccttgaaacaaataaaatattttaaagccattttaaattttgttttatagatgcttgtttgctactgatgggtgtgagcaagttagatattctataccggagacttctcctaacaaaactttttatcagaggatggggaaggccagaagatctcaaaaggcaagcaattttttttcctgaatacttgttctgaatttgttgttttaatgaacatttaaaactttgttataaaatcctttactctcaaatacagagcaattgtccagcaaattaaactatgtaaaatgtaattatttcctttttacttttgtctttttagttatttctcttaaattttagcccatatcataaatgatactgttgtaaaaataattcagattttttaaatacagaactctcagaaacacagagtagatttttgagttcaataattattaagctgattagagttgtatgtagtttccaaggattgagtcttcttagataacccgaatttgtaatgactctgaaactggaatactccgtagctcacaggaaaatctggacttaagaaaattaattttcagccaggattggtggctcacgcctgtaatcccagcactttgggaggctgaggtgggtggatcacgaagtcagaatttccggatcagcctggccaagatggtaaaaccatctctactaaacataaaaaaattggctgggcgcggtggctcacgtctgtaatcccagcactttgggaggccaaggcaggcggatcacgaggtcaggagttcgagaacagcctggctaacatagtgaaatcccttctctactaaaaatacaaaaaattaagcgggcatggtgacgggcacctgtaatcctagctactcaagaggctgaggcaggagaattgcttgaacctgggaggtggaggttgcagtgagccgagatcgcgctactgcacaccagccagtgcgagactccgtctcaaaaaaaataaaaaaaataaaaaaatacaaaaattagccaggtgtggtggcacatgcctgtaatcccagctactcgggagagtgaagcaggagaattgcttgaacccgggaggcagaggttgcagtgagctgagattgcgccactgcactcgcctgggtgacagagcgagactccgtctcaagggggaaaaaaaaaaaaagaaagaaaatgaattttcaggattggtgcctttaattttgagtcttgtatgtattaattactttctgaacaatctattgtttctcacatttttctgaaaaaagtgttcagtttgggaaaaaacaacagcctaatcgcttcagtgatcaaaattaaattttaatatggcttatgaactggatttgctaatttttaattactgttaatcagtctcaattataatgtgcttagtaggtgatataaaagattaattttttcctttttgtcttctttcccataatagactctttgaattcagaaagatgattggaaatcgggaaagatgccagaatctggtttcaagcgattatccagtacacattgataaggtattcaaatgagagaaacacagttataggaattgtggtttgacataaatatgtctaagaatagattacatattggagtataacaacaataaacactaaaatatgagtgccgtatggatttttcatttcatatttaaagaatactatttgtgggccaggtgtggtggctcacgcctgtaatcccagcactttgggaggcggaggcgggtggatcacctgaggttgggagttcagaccagcctgaccaacatggagaaaccccgtctctgcttaaaaaaaatacaaaattagccgggcatggtggcacatgcctgtaatcccagctactcgggaggctgaggcaggagaatcacttgaaccccggaggcggaggttgcagtgagccaagatcacgcctttgcattccagcctaggcaacaagagtgaaactccgtctcaaaaataaataaataaataaataatactatttgtgcgttaactggatgtttttaataactatgttcacatatattggaagcatatgtttattacttgcctaaatatatagagaagtatttaggctggatatttctggacctcattttctgtctttaggctcaggagggttaaaccactcaacattacagaacaatagtgagtattaaaggggaataatctagttggagaatcagcacataagaaattattaacaaacaactgttaaataacaccaggaaaaatattatgggatacagttaattcctgagagaatggtagaaagaaaatgctataaaattagagaaggcaaggatgtttttgtaatcttttttttttaaggaggcacctggttttctgtaaaatatttctaggtttatgtaattgcatacttggaggtattgttggagaggggatacaaatgggcaagtttcacacatccctcactcgccttcaagcaaagtaactgtacttgcatctcatatgttttggatatcttttagatttctcttttcaaaagagttcgactgctaagaacaaaattttatagattgaaaactcctcctctatatcatagaagttctttctgtatcttctgaattaataacatttctccctgaccctcaaattttgctaaatatttttatcttctttatttttttctattaaaaaattataaacttaaaacaaaaaaatttaaaacataccaagttaaaaaaaaatctcctttaatctctgccactttccaccacctaattccatttccctcccaagagtgaattgctgttaagattttggaatgcattcttactgatctactacccttagtttttaaaaattgagataaagataccccagcactttgggaggccaaggcgggcagatcgtgaggtgaagagatcgagaccatcctggccaacatggtgaaaccccatctctactaaaaaaaaaatacaaaaattagctgggcatggtggcacatacttgtagttccagctttccagctactcgggaggctgagacaggagaattgcttgaacccaggatgcggaggttgcagtgaaccaagatcgcgccacagcactccagcctggcaacagagctagactccgtctcaaagaaaaaaaaattgagataaaattcacccttttacaatatacaattgaatggtttttaaattatattaccaagatgtgcagccatcaacattgtcactaattctagaatattttcattgtcctaaaaagaaaccctgtatccattagctgtcactttccattgcctcttcccccacctgctggcaatcactagtctactctctgtctctatggattcacctaatgtggacatttcttataaatggaatcatgcaatatgtaactttttttgtctggcttcttcacttagcataatgttttcaaggttcatccatgttgtagcatgtgtcagtacttctttttgtttttgtttttatagcatcagaacattcaagaaaaactttatccttttgtatagctaaataatattctattgtattgtataccacagtttgcttatccattcataaattgatggacatttgggttgttttcactttttggctattataaataatgctgctatgaatactcaagtatgagattttgtgtgaacatgtttttagttctcttgtgtatactgaagagtttaattattggtcatgtgatgataactctaaatttaactttttgacgaactgtcaaactgttttccaaagtgactatactattttatattcccaccagcagtgaataaacattccaattttgccatactcaccaaccttgtacttgtccaagccatcatagtgggtataaaagtatttccttgtggttctggctatgccctaatgactgtgaggctgaacatcttttcaagtgtgaattggccatttatataccttctttggagaactgtcttttcaaaccctttgctcctttttacattgagttatccatctttttattgttgggttgtatattgtttaattttaaaatccatgttatgtataatatgtgtaattctaaaattgtttattcttaccaagttgccagctatcagaacactaatttgttgcattatttttccctttaacattagtttgttctgcttcctttattaataattaataatgggctgggtgccgtgcctcacacctgtaatatcagcactttgggaggccgaggcagtggatcatttgaggtcaggagttcgagaccagcctggccaacatggtgaaacctcgtctctactaaaaatacaaacattagctaggtgtggtggtgcatgcctgtaatcccagctacttgggaggcggaggcaggagaattgcttgagcctgggagacggaggttgcagtgagccgagatcatgccactgtactccagtcttggcaacagagtgagacccagtctcaaaaaatagtaataataatgtattagtttgtgctgctgctttatcaaataacttattcttataaaatacataagagggttgagtgtggtggctcacgcctgtaatcccagcactttgggaggctgaggagcatggatcacttgaggtcagaagttcgagaccagcctggccaacctggcaaaaccccatctctactaaaaatagaaaaaaattggccaggcatggtggcacatgcctgtagtcccagctactcaggaggctgaagcaggagaattgcttgaatctgggaggcagaggttgcagtgagtcgagatagcactcactgcactccagcctaggtgacagagcaagactcaaaaaaaaaaaataaataaataaaaataaatacataagaagaacactttatgctaataggcataaaaaactaaattggaacgtttttttggattaaaaattcagttttatagagatattatgtctccttaatcattttttaaaatgcaatgcaatttcaattaaagtattgaacatagaacctagatccatacaagcatcctaaaattattttgagaaaatacttgagagtacaatcagatcaggaatactctggtaaggaagagtagtaaacaaagactagttcagtcatataacaatgagtattaaaatgctgcagttgtcaacacagcgtgatattggtggagaagtaaaagataggcaaataagacctaatgaaggattgaaaataacttgtagaaatatatggatatttagtacatgataatagtagcgttttaagtcagttgcaaaaatatgtgggttatttaatagatgacatttgtccaactgactacaaaaaaaatttttggtttttttgtaaacaaaatactgttttgttttgagacagagtctcactctgtcacccaggctgcactgcagtggtgtaatcatggctcactgcagctgtgacctcctggactcaggtgatcctcccacctcagcctcccacgtagctgggaccacaaccacatgccaccacgttcagctaatttttgtattttttgtagagacagagtttttgccatgttgctcaggctgatcttgaattcctgggctcgagagatctgcccaccttggcctcccagagtgctgagattacaggtgtgagccattgtgcctggcctgataatgggttttttaagttgtttttaattcaaatcagaaacaaaaacatatctgtggatgatatggccaccgtgcctggccaacattttacatttttcaaaagaagacatacacatggccaaccaggtatatgaaaaaaatgctcagcatcactaatcatcagagaaatgcaaatcaaaattacagtgatatatcatttaccctagttaaaatggcttttatccaaaagacaggcagtattgaaagctggtgaggatctggagaaaaagaggaaacctcgtacagtgttggtgggaatgtaagttagtacgaccactgcggagaacagtatggaacttcctcaaaagccaaaactggaactaccatatgacccagcaatccccccactgggtatatatgaaaaagaaaggaaatcactgtatcaaagtgatatcggcactcccatatttattgtagcactattcgtagtagccaagatgcggaatcaacctaagtgttcatcagcagatgaatggataaagaaaatgtacaaatatgcagtgaaatattattgaaccataaaaaagaatgaaatattgtcatttgcaacaacatgggtggaactgaaggacatcgcgttaagtaaaataagccaggcacagaaggacaaatttcatgtgttttcactcatatgtgggagctgaatatttttacaaattgaactcatgaagaatagattgatgattatcagaggttaagaaaagtagcagggaggggaagataaagtggagatgattaattggtgcaaatgtacagtcagatagaatcaataagatctagtatttgatagcataatagagtcactataattaacaataatttattgtatattttgaaataagagtggaattggaatgttcctaacacaaggaaatgataaatgcttcaggtgatggataccccaattaccctgatttgatcattacaactcgtatgcctgtatcaaaacatcacatgtaccccataatacattcaatgattatgcacacaaaataatttaaaataaagtacagtggcataaaaagtttacatagtaggtgctgaaaacatgattttaattggatagaactttttattagaagaacatccatgacagaccaagatatcttagttttcttgcatacatcttggttttgattttcttttagattgaagagcaatcagattgtaagatcttagatggacactttgtttcccccatggctcactatgtgcctgatatcatgccaattgaatctgttattgcaaggtaagaatttttttgttcaaaaagatgaatacattatttatgttcattaaaattataatatcaacactatgttatttgaaattaggagtaacaaggcaggcctaaattattgaaaaggctgaattagaagatattttaattcttcaaagaacataaggagtatatgtacaaggatattcattgaagcattgtttatagttgcaaaaaacagataatgcctaaatgttcaacaataggcgattaattatccatactgtggataccattagtaacatggaaatatggtcacaatgtgtgaaagtttaagaagataatacaaatgattttttagttccatttttgtaaacacacaagtatgcacaaacaatcacagagaagtttccaaaggatatatatgaatatacaaactctgcttatctctgagtggagagatttttggcttttaaatttttagttttaggtcaagcatggtggcttatgcctgtaattccagtactttgggaggccaaggcagtgggatcacttgaggtcaggagttctagaccagcctggccaacgtggcgaaaccccatctctactgaaaacacaaacaattagccaggtgtggtggcaggcacctgtaatcccagctacctgggaggctgaggcaggagcatctattgaacccaggaggcggaggttgcagtgagccaagtgtgccactgtactccagcctgggccacagagtgagactccatctcaaaaaaaaaattttttttttagttttaaatttttacaatgtacatgtgttgattttataataggaagaagaagtacttttaagtgaagaaattaagaaacgtggtaacttagactagacagactacacagttcagctaagtaaagtgcctcaggattggtatgtaattagcatatcagtttgagaatgtaaatagatgttccgaaatacctgaggttcctaagtggttaattatacaatagttgaaaactggctttttggatctttgttaatgtacagaggttattcttagcccagtcttgttaatggttttttgtttgtttgttgagacagagtctcactctgttgcccaggctggatggagtgcagtggtgctcactgtatgctgtgcctttcaggttcaagcgattctcatgtctcagccgcctgagtagctgggattataagcgtgtgccaccatacccggctaatttttgtatttttagtacggatggacttttgccatgtcggccaggctgttctcgacctcctggtctcaagggatccacctgcctcgcctcccaaagtgctgagattacaggcatgagccaccatgctcggccactgttaatgatttgtgttttgttttgtttcgttttgttttgtttttgagatggaatctcactctgtctcccaggctagagacagagtctccagagtcttgctctgttgcctaggctagatggagagcagtggtgctcactgcaccctccgcctcccgggttcaggtgattctcctgctgcagtctccggagtagttgggattataggcacccaccacacctggctaatttttgtatttttagtagagacggggtttcaacatgttgggcaggctggtcacgaactcctgacctcaaatgatctgcccacctcagcctcccaagtgctgggattacaggagtgagccattgtgcctggcctgataatgggttttttaagttgtttttaattctaaatcagtgttgaacctagatctttacacagttttctattttatgttttagctaattttatttaaaaagaacaaactactgtactttttttcccctacactgttgataataaactatttgctgcttctggttagtaggtgttttcttcttttaagattttgtctgcaatagcaatgataaaatagtgatacatgtatgggcatttgaaaaattcttcagtcaagaagagattattctgtaatggaaacctacttaaccttttaagtgaacgtattggaatcctgaattccaatacattcagaaccctataaatgaatctataaagtgtgaactaacagaagagtggtttgattgacctgattaaaagttgtagtcagctgtccattattttgttacccctaaggcattattttaaatttatatttttttctgttgataacctctgaatgaaaggcaagcaatgtcatgtagtggaaagagctagaactttggaattaaacagatctggaattgaaccctaagtctactctttatggacctaatgtcaattacttaaactctgaaccaggctttataaagtaggactaataacacttatctggtagggttgttaaaagtgataaataaggaatgaggccgggcacggtgtctcacgcctgtaatcccagcactttgggaggcctaggagggcggatcacctgacatcaggagttcgagaccagcctggccaacatagtgaaaccccgtctctactaaaaatacaaaaaaatttagccaggcatggtggcagacatctgtaatcccagctactcaggaggctgaggcaggagaatcacttgaacctgggaggccgaggttgcagtgagctgagatcgtgccattggactccaggctaggtgacaagaatgaaacaccatcttaaaaaaaaaaggaatgaaaatagtgtgcggggaatataaaaaacataaacatgtagctcgtttatgtatttatttatttgtttgacagagtcttgctttgtcaatcaggctagggtgcagtggtgctatcttggctcactgtaccctcaacctccctggctcaagtgatcctctcacctcagcctcctgagtagttgggactgtagactgatgtcactagacctggctaattttttttagttttttttgtagagatgggggtctcactacattgtccaggctgatctcaaattcctgggctcatgtgatcctcctgcctttgctccccagagtgctgagattacagacttgagccactgcacccagccttaactcttttagatatgctttatcttattaatgctttactgaaagcattaagtcagcctgagcaacgtagaaagaccctgtctctaccaaaaaaatagaaaataaattatctggccatgatggcatgtgcctatagtcttatatactgaggattgcctgatcgaggttagagtgagctataattttaccactgcaccccagcctgggtgacagagcaagaccctgtgtcaaaaaaaaaattttttttttaaagcataagtgaatgtgtagctctttagccagtatgctaaaggatatagaaggaaaagaaactttcagtttctgtatatcatcacttcaatccctggaactatgtgtccctttctcatagattctccaccttatctggacagttatacaagctataaaacataaagaaaggaggaaaattatgtgcttttactcagactcagaaatactcctcaacatctgttggaaattgaggaacggttctttccagttagtgacaggaatggggaaacaagttgacttcctgtctctgcagtggcatatttttacaacacaattaatatttttttcaacaatttctagtcaaatttgaagcataacttactttgatgaaatactataagttcccagatgatgcacattgacatctatttttcctttcccccgtcattcttgtgcagcaatttatcttattgcattaaaacattagaaaatgcaaataagaaaaaagaaaaaaaaattccaccaatgagtgttaaccactattttatgtatattctagtctttctcctatgtgttcacatacaactgtacttatttttttttacctaattaatcagtgaatatgcagttggttatcattaatggctctttggtattccatactgtgactctaccataatttactaattccttatggtgcacatttaagttgcattgtttttcactattataaacaacatcacaatgaacatccttatatacatctccttacctgcttctctatttttgtgccataagttgctaaacatggaatttctggatttataagatttgcgcagattttaaacttttgatcatattgccaaataagtaggaaaattttaaggctatgccaagtatagattaatccacaaggagaaacctatttgtcctattgtcatttggtccattactcatgattctgtctctttttcacactttctgtttttattgaggtagagaaaaatatatcaggtaaatgaaataagggaactgcaagcattcttttccgttaaagaacagttttaagactgcttaagatctgtggtgacaggttttatagaccacaaaatatggatttccctatgtaatgtaaaatagctcatgaattgtgatgtatctttgggacagcctatattggaaatttatttatgtcaaaattccaaatgaattataatattttaaaacatagcattcaggccaggcttggtggctcatgcctgtaatcccagcgctttgggaggccgaggtgggcagatcaccttgaggtcaggagttcgagaccagtctggccaacatagtgaaatcctatctctacaaaaattagcagggcatgatggcgggtgcctgtaatccaaactactcaggaggctgaggcaggagaatcgcttgaacctggaaggcgaaggttgcagtgagccgagatcgtgccattgcactccagcctgggtgacagagcaagaattccgtctcaaaacaaacaaaaaaaacaaacaaaatgtccatttgagcaaccttaaataattttatggtaacatggcatagtttagtattcaaatattacccaagattgaattctaatacaagttcaggaaaatttaatatttatcttctggtaaaatattaatattcctttgaggatagtttatatgtcttctatatgattttcatttctcagcatcagaggtaaaaaatatttttcacataattgggtttaggttcctcaaatatttagggataaagcactcattttatgtatgtatttattcatttttaaattttttagatggagtctcactctgttgcccaggctggagtgcagtggcgcgatcttggcttactgcaacctctgcctcctgggttcaagagattctcatgtctcagcctccctagtagctgggattataggcacatgtcaccacgcctggctaatttttgtatttttagtagagatggggtttcaccatgtggtccaggctggtgtcaaactcctaacctcaagtgattcacctgcctcagcctcccaaaatgctgggattacaggcgtgagccacttggcccggccaggcactcattttaaattatgcatacttgcaaataaactgctccaggctttcatgatattttattccatttatagaaatatgtgtgtatgtgtaggtatatatctgtgtgtgtatgtgtaacaaaaacagctatccttttcagcattacttcaggcattacttttatgccatattccaaattgaaccaaagaaataagatattacttaaaataacaaaatgtagataattcctgttctgatttcatgcttactactgatctagtttttatttttaaaagaatagtggtttattagagagtagaaagatcaatatttctaaattaatagactcgtgattttaaatatgtatgttaaactttaaaattaaattttacaacattttaaatatatatcaaaataaacataagcaggaaaaataatactttaattttcactgctactttattttgatggttttaacagcagtaaattaaatatatttatgtgtgattttaaatataagtatgtaactaagtaaattcaatattataagcagggaaaataatactttaatattatactctgcttttttctaatgattacaacaatagtttttgccaatattttaaaaatcattcttactgtctttaaatggcataaatggcattcagtagttctctactcattctaaaaaggaaaaaaaattgtataaaaattttccttggctataaaaaattctttgtaggtactggtaattccctgtgtctaacataaggaagagccatgggccatgactcagccactcagctccctgcccttgggcaatttatttaactgtatggtacttaacggcttcccacttctgaattagggcttgctggaaagatacaggcaggaataaagaaattaaagttgaaaggagtgtggatgagtagaggaaaaggagtagacagctacatattcatttacatgtgctggaaaaccagtatttagctaaaatcttttataaaactaatgtgatatgacctgagcagagccaaaatttaactgttcagatacatagtattcactcaccttttcacttttatcgggggaaccagcccccaatatttcaacatacattctattttccctaagtgtcagctggtctgagaaataaagagaaagagtacaaacagagaaattttacagctgggcctccaggggtgtcatcacatattggtaggaccatgatggcgaccccgagccgcaaaatcagcaagtttttattagggattttaaaaaggggagggggtgtacgaacagggagtaggtcacaaggatcacatgcttcaaagggcagtaaagatcacaggcaaaggcaaaattagaattactgatgagggtctatgtcccgctgtacatgcattgtcttgataaacatcttaacaggaaacagggttcgagagcagagaatggtctgactagaatttaccaggctggaatttcccaatcctagtaaacctgagggtactgcaggacaccagggcatatttcagtccttatctcaactgcataagacagacactcccagagcagctgtctgtagacctacccccaggaatgtattccttccccagggttattccttcctgggaaaagaattcagcgatatttctcctactcgctttctgcaagaggagaaatatggctctattctgcccgaccctgcaggcagtcagaccttatggttatcttcccttgttccctgaaaatcgctgttgttctgttctttttcagggtgcactgatttcatattgtgcaaacacacattttacaatccatttgtacaacagtggtcctgaggtgacatacattctcagcttacgaagataacgtgattaagagattaaagtaaagacaggcataagaaattataagagtattgattggagaagtgataaacgtccatgaaatattcacaatttatgttcagagattgcagtaaaggcaggtgtaagaaattataaaagtattaattttgggaactgataaatgtccatgaaatcttcacaatttatgttcttcgccttggctccagccggtccctccattcagggtccctgacttcccgtaacacactttctaattgatttgcatctaatacagatgtacatacacaatcttactgtactctctggagatcaggaaatatgatgaaagagtgttaaagacttacatttcaaaagactaggcagtcaaaaggatatttttattttaaaaaggaaaaaaagtaacaacaacaaaagactaggcagaatcagtacaaggagttctttgagggtggggtagaaggaatactgatttcatatgacttaaattagagtttccttgaatctcagccctcttcagtctgcctctcttctagactcaaaaagctatgtatttgccttttggaatgtgtagtttgaaacttgtagagtactgctttcagccttgtcaaaggcaacaagtgattaagaaaagcagtgtaccacctggcggcagtaggcaactatgtgattaaagatgtgtaaccatagcagctgttggctcagagaaaaacttagtcatttcttactagctctcatcttcctccctccttactttctgttccacttcttccttctttattcttccttcttcttctttcttcatctcctccttctcctccttcacctttttcctctcctcctcctcgtttttttttgtttgtttgttttttgttttttgacagattcttgctctattgctcaggctggagtgcagtagcgcaatcacagctcactgcagtcttgaactcctaggcttgggtgaccctccaacctcagcctcctgagtagctgggactacaggcatgcaccaccacaaccaactaatattttttttatttgtagagaacaaggtctctatgttgcccaggctggtcttgaattcctgggctcaagggatcctcctgcctcagcctcccacagtgctgggattataggcatgagccaccatgcccagcttcacttctttatctcacttcctcttttctctctctctctttctttgacatggtctcatttgtcttatcctttgtaaatttttcaagacgtttctttttttttttttttttttgagatggagtcttgctctgtcgccgaggctggagtgcactggcacgatctcggcttactgcattctcctgcctcagcctcctgttcccgccaccacaccctgctaattttttgtatttttaatagagacagggtttcaccatgttagccaggatggtctcgatctcctgacctcgtgatccgcctgcctcggcctcccaaagtgctgggattacgggcgtgagccactgctcccggctgactttttttttttttttaagagactggatctcactgttggccaagctggtctcaaactcctggactgaagtgattctacccatcagcctcccaagtagctgggactataggtgtgcgccattgcatccagctctaattcttcaggtctttctggtttttctccactcccctctctctgcaaatgccattattaaatgtagcccccaccaaaaggcaaagaactaaataagataaaagcaaaacagtttattctagtaacttataaatgttacattttaaattatatgaattgtctaagtctgtagcttgtctttaactctgccactatggtactttacgtacttaggaactttaaacatcttttgaatgattattgggatgaaatattgggcttttagagtctagaatccaaagcaaagcagttatgcagctatggaagcgatatagttgttcattgatttcttgattactcaagatgaaggagttcattattatacgcagactttcatttaaatatataaaatatatatatatttttaaaaaacatgagcctggccaacatggtgaaaccacatttctactaaaaatacaaaaattagctgggcttggtggtgcacgtctggaatcccagctactaagggggctgagacaggagaatcacttgaacctgggaggtggaggttgcagtgagcagagatcgtgccactgcactccagcctgggcgacagagtgagactgcatctcaaaaatagaaataaaaagtaagaaagtagccttctggtggcttagttcttaccatagcttaaaatgaaagaggctcctaggtgaaggtgagttgctgatgtggaaaaaaacaggattttttactctatttaaaaacaaaacaatgacaacatattagctaaagcactcatttagattgttttaaaattacaaaataatacatggtcattataaaatgagtgcaaataatacagattctggaggaatctttaggaaggctacctatcaggtactatgctcatgacctgggtgatgggattattattcttttgaaggctgcctatttgtatctttttcctgttttttagtgaggttatttggtttttgttaaattgtttaagtttattatagattccggatattagacctttattgaacgcaagtttgtgaatatttttctcacattctgtaggttgtctcaacctgttgatactttgttttttttctgtgcagaagctctttagtttaattaggtcccacttgtctcttttctttatgttgcagttgtttctggggacttacttataaattctttgccaagtgtattagtttgcacgctgctgataaagacatacccaatactgggcaaacaaaagaaagaggtttaatggacttaacagtccacgtggctgggaaggccccacaatcatggcggaaggtgaaaggcacatctcatatggtgacaaacaagagaagagagcctgtgcagggaaactcccctttttaaaaccatcagatctcatgagacttattcactatcacacgaacaacatgggaaagacctgcccccatgattcaactacctcccaccaggtccctcccaaaacacgtgggaattcaagatgagatttgggtggggacacagctaaaccatatcaccaaggctgaacccagaatttcctaggtttttcttctggggtttttattgttttaggtattacattaaagcctttaatccatcttgagttaatttttgtttatggtgaaaggaatgggtccaatttcaatcttctgcatatggctagccatctatcctaacaccatttattgaatagggagtcctttttcttttgtctgttattgttgactttgccaaagatcaggtggttataggtgtgtggctttatttctgcattctctatgctattccattggtctatgtgtctgtttttataccagcataccagtaccgtgctgttttggttactatagccttgtggtatattttgaagttgggtaatgtgatgcttccagctttgctttttttgcttaagattgctttggtgattcatgctcttttttggttccgtatatgaattttagaataatttttctaattctgtcaaaaatggttttggtagttttataggaatagcatggaatctgtgaattactttggacagtacagccattttaacaatattgattcttcctatacatgagcatggaatgtttttccatttgtttatgtcatctctgatttctttcagcagtgttttgtaattctcattgtagaaatcttttacctccttggtaagctgtattcctaggtttctgtgtgtgtggttgtgtggctattataaatgagattgtgttcttgatttggctctcagcttggatgttattggtgtatagaaatgttactgagttttatacattaattttctatcttgaaactttgctgaagttatttattagttctaggaggcttctggcagagtctgtggggtttttgaggtataatattatattgtctgcaaagagagatggttgacttcctctgtttctatttggatgccttttatttctttctgttgcctgattgttctggttaggatttccaatactgtgttgaatagtagtagtgagaatgggcatccttgttttgttccagttctcaaggggaatgcttctagcttttgcccattcagtatggtgttggctgtgggtttgtcatagatggctcttattattttgaggtatcttcctttgatacctaatttattgaaggtttttaacatgaagtgatgttgaattttatcgaaagccttttctgtatctattgagatgatcatgtggtttttgtaagtctgtttatgtggtgaataacatttattaatttgcatatattgaaccaatcttgcatcccaggaataaaagcccacctgattgtggtgaataacttgttgatgtgctagtgttgtccttatagcttctgatacttttttcattgaggttctgtagatagtaaattttctgagttatttatatgtaaagatgcctttattatccctcatacttagttaaccccttgcctacttatgcaattcttggttcaaaataacttccttcagaatttagaaggttttggtgtgttcttttctgtcttccaggattattgatgaaatgcttgataccaacttgattcttctacctttgtaggtaaccagttatttctctctagaaacttttgtggtcttttgtatatccttagtggttagatgttgagttttgttttgttttgtttttttttttaattccttgtgcctgccactcagaagaccctttcagtttgaaaaaaacagataaattttcatctattatttttgcaatttttttctcctgttttgtctccattcttttatgagagtcctgttagaaacatgttggagccaggcatggtggctcacgcctgtaatcccagcactttgggaggacgacgcaggtggattgcctgaggtcaggagttcgagaccagcctggccaacatggtaaaacccgatttctactaaaaatgcaaaaattagctgggcgtggtggcaggcacctgtaatctcagctactctgcaggctgaggcaggagaatcacttgaacccgggagatggaggttgcggtgagccaagatcgtgacactgcactccagcctgggcaacagagcaaggctccatcttttttttttttttctttttttgagatggagtctcgctctgtcacccaggttggagtggagtgtccctgcaatctcagctgactgcaacctctgcctcctggagtcaagtgattctcctgcctcagtctcccaagtagctgggattacaggcacttgccaccacatctggctaatttttgtatttttagtagagacggggttgtgccatgttggccaggctggtcttgaattcctggcctcaggtgatctccctgccttggcctcccaaagtgctgggattacaggtgtgaggcaccacaccctaccaagactctgtctcaaaaaaaagaaaaagaaaaaaaaaagaaagatgttggaactactagattaatactttgtttgtttgtttgagacagagtctcgctctgtcacccacgctggagtacagtggcgtgatctgggctcacgacaagccctgtctcctgagttcaagtgattcttctgcctcagcctcccgagtagctgggactacaggtaggtgccaccacgcctggctaattttcatatttttagtagagacagtgtttcgccatgttggccaggctggtctcaaattcctgacctcaggtgatccacctgcctcacctcccaaagtgctgggataacaggtatgagccaccaccaccacacccggccatattatctacaccttttaactcttctcttataatttatctctctgaatttttgttgttcaccacttgtttgacatttgaccttattcttctagtcttcaccttcattatttggtcattgtagaaattaattcaaataagccgggcacggtggctcacacctgtaatcccagcactttgggaggctgaggtgggcggatcatgaggtcaggagttcgagaccagcctggccaatatggtgaaaccccatctctactataaatacaaaaattagctgggcatggtggccgcgtggctgtagtcccagctacacaggaggctgaggcaggagaatcacttgaacccaggaggtggaggttgcagtgagccgagatcgcgccactgtactctagccagggcaacagagtgagatgctgtctcaaaaaaaaaaaaaaattaatccaaataatacagattctgttaaattaaaatacatattgtaaaccatagagaaactaccaaataaaaagagaagtatagctaataagagggataaaatagaatgaaaaacacccaattaatctaaaaaaaagatagaaaagaattttaaaaagaataaagagataacagatggaaagcaaatggctttttatcataatttccaagatctttttattatccagctaattcttttctcttaaaaacataattttttatatatttggaagtattctatttttctggcatgtaaattagaatgtgtatgtatattttaatttttaaacaattttattgaggtacattttacatataaaatttacttatttcaggctgggcagagacagcagtctctactgaaaatagcaaaaatagcctggtgtggtggtacgtgcctgtggtctcagctacttgggaggctgaggctgacgatcgcttgagcctgggaagcagaggttgcagtgagctaagatcatgccactgcacttcagcctgggtaacagagcaagaccctgtctcgatttaaaaaaaaaaaaaacaaaaaaaaaccaaacaaacaaaaaaccatttcaattgtagaattcactgattttttaatactttacctagtgatgaaactatccccatgatataatttttttaaattattctttttataacatctgtttccttcaagatcagttgttctatttgttcgtctctactttccctgcctctttttgtttttttagaaaatatgaggctcagccgggcacagtggctcatgcctgtaaccccagcactttgggaagctgaggcaggcggatcacctgaggtcaggggttcgagaccagcctggccaacgtggtgaaaccctgtctgtactaaaaatacaaaacttagccaggtgtggtggcacatgcctgtagttccagctactcgggaggctgaggcaggaaaattgcttgaacctgggaagcagaggttgcagtgagccaagatcgcaccactgcactccagcctgggcaacagagcaagactccatctcaaaaaaaaaagaaaaaaaagaaccaaaataacaacttctgcctctgctgcagccatctcctatgtctgttctcaaatattgttctagctcttcaatggaaaaactttaaactcatcttagtaataaggtttattcagtaaatttatgtttagctccttgttaaaaattatacgtgagagccgggcgcagtggttcacgcctgtaatcccagcactttgggagaccaaggcgggtggatcacctgaggtcaggagttcgagaccagcctgggcaacatggcgaaacctcgtctctactaaaaatacaaaaattagctggttgtggtggtgtgtgcctgtaatcccagctactcgagaggctgaggcaggagaatcacttgagcccggaggtggaggttgcagtgagctgagattgcgccattgcactccagcctgggcgacagaatgagactccgtctcaaaaaacaaaacaaaacaaaacaaaaattatacatgaggccaggcgcagtggctcacacctgtaatcccagcactttgggaggccaaggcgggtggatcacttgaggtcaggggttcaagaccagcctggccaacatggcgaaacctgtcgctactaaaaatacaaaaaattagttgggcatggtggcacacgcctgtaatcccagctacttgggaggatgaggcaggagaatcacttgaacctgggaggtggaggttgcagtgagctgtgatcataccactgcactccggcttttgcaaccagtgagactctgtctcaaaaaaaaattgtacatatccaaaacatgttgaaactttggtataaagtctgtttgttgtttcctgccctatttgtgctatcatcagctgatttcctattacttagattcataggtagctggaattgagaaaggcctatagaggtcatctagtttattattcctttaaatgctgttgctattgccatcatgccagtaaaggaatgaaaagcaaatcaacttgtatgcatttttctttctttttctttttttaagagacagggtctcactctgtcacctagggtggaatacagtggcctgatcacagctcactgcagccttaaatttctgggctccagtgatcctcttgcattggcctcctgagtagctgggactacaggaatgttccagcacatccagctaatattttttattttcagttttgcagagataaggtcttgaactcttagcctcaagagatcctcccaccttggcctcccaaagcactaggattatagacatgagccactgaggcggacctcctgtgtgcattttctacctcatgagattttagaagcgggaaatgggaagccatgaagatccaagaggatacttcccttatctcatcttcttccctgttgcacagtctcttgtctctgctttatgccctatgtctatgtcatgggcagtctggcctcctcatttctcatacagctaacaaaacatagctaccacagccccacagagctttcatatccaaaagctcaacagaatctaactatagtctgtcccaattccatattaccaaaagagcaaatctcattgccctaatttggcttatgcttgacccagtcagctgtggcagaggagtcacatggcctgtacccattcatcatgggacactggggaagactgttagaagatagtcgaatttgagcagagacactgattactgaaattaattaggtgggtagttagttaatactccaataaaaaattcctattaaagctattatccaataatgaagtcactacatgcattgctatggaacaaaaggaaagtacaaataatagcagagatgtccagctttctactgaaaaaattcttaagtgttttcatctccccaaaatctttaaaatatcaggaaactcgacaatgctgagaacgcaaaatgaagcaaaggtgttagttaacagtgccagttctcgttatgagattgaaaattaagagttcccatgagcacaacacagaaataattcttaaaccattctaaatttatctgtctttgttctattcagcaatttattgacagtggataaggggtaatattaccccttctgtccacgcaaagttttcagctcagaattgaggttttatgttgcctaagaatccagtcacctcaggtcaaaccttcagctgacagagtacagtcttttactatgatagtagttctaaaatacgaactgctaaggaaattaaaatgagaaatcagtttgggaagatgaaaatgtttttaagatagatgatagtgatggttgcacaacagtgttactgtacttaatgccactgaatcatacacttaaaaatggttaaaacggacacgtgtggtgactcatgtccataatcacagttatttgggaggccatggcgggaggatcacttcaacccaggagttcaagaccattcggggcaacataaggagactgtctccagaaaattaaaagaaattagttgttcaagaccagcctgactaacatggagaagctgcatctctacttaaaatacaaaattagccgggcatggtggcacatgcctgtaatcccagctacttgggaggctgaggcaggagaatcacctgaacctgggaggtggaagttgcagtgagccaagatcatgccattgcactccagcctgggcaacaagagcaaaactccatctctcaaagaaaaaagaaataaagaaattagccaggcgtgatagcacatgcctgtagtcccagctgcttgggaggctgaggtgggaggactgcttgagcccagcaggtcagggctgcagtgagctgtaattgtgtcaccgcacaattgtgtcacccaattatgggctaaagtgagaccttgtctctaaaaaaaaaaaaaaaaaaaaggttaaaatgtatattccaccagagtaaaacaaagagaagtcatataggttaaaagaaaaaacataaaacattaaataaggaccaaaatactacaataagaaaaaaacaaaggccaggtgcaatgactcatgcctgtaatcccagcactttgggaggctaaggcgggaggatcacttgagtctaggagtttgagaccagcctgggcaacatagcgagaccccatgtctaaaaaaaatgaaaaattagctgggcttggtagcagatatctgtaatcccagctacttgggaggctgaagtgggaggatcacttgagcccaggaagttaaggctgcagtgagctgtgatcatgccacggcactccatcctgggcaacagtaagaccctgtctccaaaaaaaaaaaaaaaatagacaaatagagaaaactatctgtgcgtttgtgttttttgttttctggcatggattgactttacttgtaagtatcaacatcttaatgaatcagattctatcatatactaaaagttttaaaaaaagacaacataaactcttattgatatatcaacagcttgtacagccaagcatttcttttgcaaagagaaaaagtcggagctatatctaaagagttatttcttttggctaggcatggtggctcacacctgtaatcccagcactttgggaggctgaggcgggtggatcacaaggtcaggagttcaagaccagtctggtcaacgtggtgaaacgccatctctactaaaaatacaaaaattaaccaggcgcagtggtgtgggcctgtactcctagctactcaggaggctgaggcaggagaagcacttgaacctgggaggcggtggttgcagtgagctgaaatcatgccaccgccctctagcctgggcaacagagtgagactccgttccttttttttttttttttttttttttttttgagacggagtctcgctctgtcacccaggctggagtgcagtggcacaatctcggctcactgcaacctctgcctcccgggtttaagcgcttctcctgcctcagcctcctgagtagctggaattacgggcatgtgccaccatgcccggctaattttatttatatttttagtagcgacggggtttctccatgttgattaggctggtctcgaactctcaacctcaggtgatccacccatattggcctcccaaagtgctgggattgcaggcgtgagccaccgcgcctggccaatagttacttcttttaagacttactcatatatagtggtgtctctacaagataagaaaatttctttatgtatttattaagttatgatattgaacaaggtaaagaatagggacaataaattctgtttgtgttgtattgaatattttaatatcctaacagaaagcagatttacaatatctttgtagcgtttggacaacttaatttagttaattacaatttgaatgttaaaatttcgactgatcttttctgtcagataatttaaatgtaaaagttttaagaactgaaagtttttattgaaagtcctttaaagagaattttattgataagtctatgcttttaaaaataggttccaatttattgtgcctaaagaatggaacagcaaatatagacctgtatgcattcatcttgctggaacaggagatcatgtaagactttattataatgccttaatctctagataatttgttaacatattctccttaacagaagtggctactatattcttttgagtatgtgttcttttctttccttagcattactggaggcgacgaacactaatggcccgtcctatgattaaagaagcccgaatggcttctttattgttagaaaacccttattatatccttttgtgatatctaagaaatcttttgccttgtttatttattgatatatttagtcatcaaaaggaatgatagtaaccaagttttctaaaccagttaaatttagtcatcagttcagaaaatacttaaggagcaagaatcaaaaggagtgaaagactatttcatgctttttaaaaattaacataaggattgtacttctattgtgcagtaaagaaattgtacttccatttcttgggagacttatgctagattttaatattagtaagtcaaatgtttgctattaaggaaacaatcatgttttaaatgcatttacagtatcagttgaggtttagacagttcttaacttaattttcaagatgacgtcagactattcacagaagaagaaatgaaactggtgcacagatataaagaaatgttcaacgttgctggtaataaatgtagagttaaaacaacaatgatcaaatattttaaaaaaaacagtactggtgaggctgctttgaaatgggcactcttgttactaatgactgaaaattagttcaaccgtttgagaaaacatattttaccatatgtatcaggagctttgaaacatcatatcccttgacaaaatgattttgattctgggaaatttattctaaggataaaaactaagaaaaaattaaataacaaaaacatgtttgtatagctttagtaaacatgtcagtaaagcattagaaatagctaaatgtctaaaatagaaatagttatgtaaactgtgattcataatattggaattttatgcaattggttgtattccatttatttctctacctgtgttatatttatttctctaccacttaccacttttgtgaccttggacatgttacataacctttagtacctcaattttctcattgataaatgggaataatctcttaggttattgagattattaaatgattaatactgtctagaacagtgcctgataaataataagcattcagtaagttttaactgttattattaaaaagtttacaataatgtatgaccagtatttctgatgtgaatgtaggatataggccaggtgcagtggctcacgcctgtaatcccaggactttgggaggccgaggtgggcagatgatctgaggtcaggagttcgagaccagcctggccaacatggtgaaaccctgtctctgctaaaaatataaaattagcctggcatgctggcatatgcctataatcccaactactcaggaggctgaggcaggagaatcacttgaacccaggagacaggttgcagtgagccaagatcacaccatggcattccagcctgggcaaaaagagtgaaactgtgtcaaaaaaaaaaaagaaagaaaaggaaataggatataaaactctatggtgtggcacaggtatgcaaaaaaaaactaaaaacaaaatccaaagcaaaaactgtgcattggcctggcacggtggctcacgccctgtaatcccaacactttgggaggccaaggcaggaggatcacctgaggtcaggagttcgagaccagcctggccaacatggcaaaacccctatctctactaaaaatacaaaaattagccaggcgtggtggcgtgtgcctgtaatcccagctacttgggaggctgaggcaggagaatcccttgaacccaagaggcagaagttgcagtgagccgcctgcactccagcctgggcgacggagcaagactgcgcctcaaaaaaaaaaaaaaaaaaccgtggataaagagaaatacaccaaaatgttaatatggttgtctgtagataaagtagttgttctttaatctgattttttgtactttttggattttctataataaaaattttatgaacgaaataaaaaataaacttcattttaaatttaaattgaagagtgtacaaccctgttaatttactgaaaacattaataagtatactttattggctgaattatgtgatatatgattttttttttttttttgagacggactctcgctgtcgccccaggctggagtgcagtggcacaatcttggctcactgcaggctccgccccccagggttcacaccattctcctgcctcagcctcccgcgtagctgacactacaggcgcccgccacctcgcccagctaattttttgtatttttagtagtgatggggtttcaccatgttagccaggatggtctcgatctcctgacctcgtgatccgcccgccttggcctcccaaagtgctgggattacaggcgtgagccaccgcgcccggcctatgtgatatatgattatatcagtaaagctggttttttttttttttttaaaaaaaaggaaaataattaagttgaaaacttaagaacttctaaacagcctacttaagataattagaatggagttatttcagtattaaattgtgtaaaatttaactatttaatgtactctcagacaaacaaaattatttaattattttaaaactttctctttgacccacattcttaaatggctgcaggaaacccaaggaccaagtgtaagtatatatcactttcatttttgcagtctttttacccaatatccagcagtattaaaattttggttgccttcagttaaccatttctaaattgaatacctaaatattatggggggggggagttctgttatgaaactgtagtatgaatactgactttaatttttatttttaagatttttgcattttaatgtctgttaaggaaatacaataaaaaattttaacaggtagacttaatatatagtttagttgtgaaactgtaaatgaagaaatgataaaaccctttctttttttttttttgagacgcagtcattctgtcacccagtctggagtgcactggtgcgatctcagctcactggaacctctgcctcctgggttcaagcgattctctgcctcagcctcccaagtagctggaattacaggcatgcaccaccacacctggctaatttttgtatgtttagtagagatgggctttcaccatgttggtcaggctggtctcaaactcctgacctcaagtgatccacccaccttggcctcccaaagtgctgggattataggcatgagccactgtgcccagcctaccttttcctttttaaggtacatttactttgtgtaattagacactttattcttacaatgcatagtatagaaaatctgaagataaactttctcttttcagtcttttaaaatgataaactccaaggcatttccataatctgtattgtgtttggtttggttcagtcaataaatatttgaccctagacactaggaatactgcaacaataagacaacattttctcataaagttcatattctagtgtgggagatagataacaataaataaggtgatttcagatatttatcaatgaccagtgaatgaagtaaagcagggcaattgtataaagagtaatatgggatgcagtgtagtaacagtattatatatgagaacatgatataatgagaaggagccacctgcatgaagacttggaataagatcagccacagagaaggaaaagtaaatgaaaagcccaatgtaagcgtcaggaggggagagtagtacaagatgaggtcagaaagataggcaagggctggctgcagtggctcacacatgtaatcccagcactttgggaggccaaggtgggtggatcacttggtgtcagtagttcgagaccagcctgaccaacatggtaaaaccctgtgtctactaaaaatacaaaaattagccaggcatggtggtatgcacctgtagtcccaactactggggaggccgaggcaggagaatcgcttgaacctaggaggcggacgttgcagtgagcggataccatgctgctgcatccagcctagacgacagagcaagactccatcccaaaaaaaaaaaaaaaaaaaaaagacaaggaccagatggtgaaaagccatcatgctttcaatgtgaatgatctgaaagtgcaatgggaagtgtctagaggactttaagcagatgagtggcctgatttatattttttaaaacctactttggctactttggtttactgggacaagagtagcagcagagaaaacaaataggaagctattgaaatgatgcaggaaagagtagtgactttagtttaactaggtagtagtggaaatggagagaagttttcctgagttcaagatatagttaagtttaaataataggacttgtgtatgaattggatggtgtgggagggaaatcaaaagttctgggccgggcgcagtggctcacgcctgtaatcccagcactttgggagtctgaggcgggcagatcacaaggtcaggagattgagaccatcctggctaacacgctgaaaccccatctctactaaagatacaacaaaatccgggcgtggtggtgggcacctgtagtcccagctactcaggaggctgaggcaggagaatggcgtgaacccaggaggcggagcttacagtgagccgagattgcgccactgcactccagcccgggcgacagagcgagactccgtctcaaaaaaaaaaaaaaagttctgacttggatgtgtcaaatttgtaatttctgttaaacctgcaagtggagaaatcaagtaggcagttggaaagtgctggagatgtagatttggaagtcccatgttctatgtggtcatagcatgaaagaggtatagatgaaagtaggatggggtggaggcaaaccggtatactatgaagaatgaaacttgatagtttataatgaactttgtgaaaccttgtgaaaaattaaaggccaagctaagtagttgaagaatttccacctttttttttttttttttttttttgagatggagtttcgctcttgttgcccaggctggagtgcaatggcgtgatctctgctctctgcaacctccgccttctgggttcaagcaattctcctgcctcagcctcccgagtagctgggattacaggcatgcgccaccacgcccagctaattttgtatttttagtagagacagggtttctccatgttggtcaggctggtctcgaactcccgacctcaggtgatcctcccgcctcagccccccaaagtgctgggattacaggcagcatccaccgcgcccagctgaagaatttccactttggaaccaagcccagaattcagaattaggtatgtaatttttaccttatccataaattggttaaaaagcaagaagagtttatttaggtctagtgagaggcagcctgggtttaatagaaagactgactttggagtcatacaggcataggttggaattgtaacatttgtttactgattacctcattcataaaatgggaatactatgtaatttcttccatgtagaagtgttgtgagaattataatgtttataaaatattctatcacatactgtatactcaagtcaagaaatataataatggccctatgtatttgatttttctctaataattcatcataagaaatggcttactgactgggtgcagtggcttatacctgtaatcccagcactttggaaggctgagatggacagattgcatgagtccaggagttcaagaccagcctgtgcaacatggcaaaaccctgtctctacaaaatataccccccgcccctaaaaaaaaaaatggccaggtgcagtggctcacgcctgtaatcccagcacttgggaggccgaggcaggtggatcacctgaggtgaggagttcgagaccagcctggccaacagtgtaaaaccctgtctctactaaaaatacagaaattagctgggcatggtggtgggcacctgtaatccaactactcaggatgctgaggcaggagaatcgcttgaacccaggaggcagaggttgcagtgagccaagatcgccccattgcactccagcttgagtgacaagcgcgaaactccatctaaaaaaaaaaaaaaaaaaattagccagacatgatggtgcacacctgtagtcccaggtactcaggaggctgaggtgggagaatcacctgagcctggcaagtcgaggctgttgtgagccatgatcaagccacttcactccagcctgggcaatgagagtgagactctgtctcaaaaaaaagaaaaaagaaatggtttgcaatttaaatcacagatacttctctgtcgctctctctttttaaaaagccatcttaagtctgttttcatcaaaagtgctgaaacaatttgagaccgagtctactattataaataactactgtcccagaatttcatatcagtaacttctactaaaagagcaatctgggggacctgagaattcaaggctcccatacaaggctaaaagaaaaagttggggaaattgtgtaatcataaatagaaaaatgacttgaggataggaaacaaagataagaataatttttttttttctgatgaagcatgactatgatctgtttggacgaaggatagcatagtttccataaaaagaaaccctcccttctggacttagagctctgagaggacttggtaggacagtggaagtaagctctttgggagccaagattttgtttttcacacttggcattccttctggcacctggttctttgcacatattatgtgtaggcatatgataaataatcattggtaaaatgaatttttgtatactttggcaaggtttcattcaataaccagttacatgtgtcttaatacaagttacattttgaaaagtagattctaatttggtcattttagtaataatatatatttattttgatcactatatacggatggttctaggacccaaaaagatatatttaaatacttttttttttttttttttttgagatggagcctcactctgtcacccaggctggagtgcagtggcgcaatctctggctcactgcaacctccacctcccgggctcaagtgattctcctgcctcagcctcctgagtagctgagattacaggcgcgtgccaccacgcccagctaatttttgtatttttagtagagacagggttttatcctattggtcaggctggtctctaactcctgacctcatgatctgcccaccttggcctcccaaagtattgggattacaggcgtgagccactgtgcccagcttaaatactttttataaggaaatatacttctgtgtaaaattagcttctaaaaatgaaattccagttggtctttatttaaaacatgtatatttataaaaatgtatttgttttatattttattatattcataaattatgtattttgtgaaaataagcaacatatttgagatttcagtaatacatgagcctagtgtttggttaaattctttatttatattgccttttttaaaagttatgctttaagactgggcgtggtggctcacgcctgtaatcccagcactttgggaggctaaggcaggcagatcacttgagctcaggagttcaagaccagtctggccaacatggtgaaaccccgtctctgctaaaaatacaaaaattagccaggcgtggtggctcacgcctgtaattccacctactcaggagactgagacaggagaatcgcttgaaccctggaggtggaggcagcagtgagccaagatccatgccactgcaactctagcctgggcaacagagcaagactccgtctcaaagaaaaataaaaagttatgctttaaattctgttataataatttcagtaaagattatgtgctatagaacaggaacacttttttttgttaagttttaggtgatttgatatgtaatccaatgttagcagctgtgtaattctattttttttttctctttttgagacagggtctcattctgttgcccaggctggagtacagtggtgcagtctcagctcactgcagcctctgcctcccaggttcaagcgattttcatgcctcagttttccacgtagctgagatcacaggcatgcgccaccatgccctgctaatttttgtatttttagtaaagacaaggtttcaccatgttgcccaggcttgtcttgaactcctgacctcaagcgatccccctgcctcagcctcccaaagtgctgggattacaggcgtaagccatcacgcctggccctaattccaatttattacattgttttacttaactatctggtcctttagaagagatgcatgaagtctggcagcctgttgtaaatttgcatatattagcatgtaaatacataaaataatcattttctattttgttttgtgaggctagaaggtccagcttaaaaaatgtgtccgacctttttgtgatgggaggagctcttgttttagaatctgcagctctcttgcactggctagagagggaaggttacggccctttaggaatgactggaatatccatgggaggacacgtaagcctttttatttctgcttacatttaattatgtttatgtttgtaagatctagagaacctggttattttaaaaattcactttaggtatagaattagttttagtaaaagtaggaagcagaaacagattccaaactcttactccaattatgaagtaatgatgttaattttttgtacgatttattgattgtactactccacagttgtatctcagatattagatttaacagaaattaattataaaatttaacttttcaagtctcaagtataaatgcccaattttgctgttacattggtgaagatagctgaattggaaaatactttccatttatctgtctccctagtaccactaacctattttactttttgtctgccttttagagtgtactaaaatggattcctaattgctttctctgtctctagtcttttctcttattaatctttgtcttaaccatttctcctccacaccctaactacagtgatctttctaaatctagtctttgttctgtcttgttcaaaacctgccaaaagcttgcgtgcacactgggctccagctgtgtcacgtgctagcatctctctagtgctcccttattctctttcacctaggagtaacagcttacccttctgtttcagctgtgacacccagccttacctccagactatacttcaaactctgattagtaactttttactgtactttactgacttgtttagcagtctgttttctccatgaagcatttgagatattgagggccaggaatatgctctggtttattacttggcacatattagtcactcagtacatttttaaaaaattattagtattttgtttgtgtgtgggctcaagtgatccacacagtttggcctcccaaagtgctgggattataggtgtgggccactgcacctggcctaaaaaataataataccccaacctaggcaacatagtagtaagacccaccctgtctctacaaaaaaaattgtttaaaaaattagccaggcatggtggcacatctctgtagttgtggctacatgggaggttgaggtgggaggatcacttgagccccagaatttgagactgcagtgagctgtgatcataccactgcactcctgattaggtgacccagacagaagcgagattctatctcaaagtaataattattattatatgaagtttctgtatgcctcttgaattagaaaattaagctcaaaaacttactcaaattcaaaactatgctgggcacggtggttcacacctgtaatcccagcactttgggaggccgaggcgggcagatcacctgaggtcaggagttcaagaccagcctgaccaacatggtgaaaccccgtctctactaaaaatacaaaaactagccgggtgtggtggcacgtgcctgtaatcccagctactcaggaggctgaggcaggagaatcgcctgaacccaggaagcggaggttgcagtgagctgagatcgcaccactgcactctagcgtgagcaacagagtgagactacatctcaaaaaaaaaaaaaaaaaaaattcaaaacaactacctgacagtgaaacaaaagatggaaaaggatttattttcctacctagtagtgtttccattgttatcacctaggtcaggtccttataactttcacctggattactgcctattaactggtctcctacctcagttctccccttctctattcaatcctgtaaactactatcatgttaccttctttgaatcacttctttgacaatactactcctttgctcagacctctttattaattcccgattatctatagaacaaaggacctctaatctgatcttgatcaatctttctagccctacttacctccctcactccattggccatgtgtgcctattgaccatcccaactgaagtatattggctgtttccctatgagaccctgtgcattctcacagtcttgcctttgatcatactgattctttctctggaagacaagaccctatctttcattcctctagaagactcatccatttcatgaagcctgcctttcccttctgattcctccagcccagaagggaaagtaactttttgaaaagataaagttttcccttctccaaaagggagagtgattttaccttctctaatcacacacattacattattttagatctattatataatctgctttgtagttcaccaaattcttggcatactcagtcaacctcaatggtctgatgttttatagttgtgattttgctctatctggcaagtcacttaagtaatgagtgtgtttaccctgctgcccagcatctacatctcagcatctttgctccatatttacacagtagaaagtagctctcagcgaatggtcttgaggttaaagttttgtattacattttattgctatctaagggggaaattaaatgttgaatttatgatttggggaatttaatgaggtggctagacattctcacgaatgtttgcagactttgtgtttatctgaccaactatttactgcacggaatgcttattaatattaaatatttttattttaatgaatagaaactctaaatagacgctctctatctgttatattacagatggcttccttagcggtatccaactggcctaagcccatgccattgattccatgcctgtcttggtccacagcatctggggtcttcactacggtaatttaattgtaattaatattaggtagctatatataattagaggtaattgttttgggggggtccccaaaaccaccctcagctttggtgattcaaagaaagaattataggactcaggatatagtcgtaatcatgattaagccttaactacagcaaaagatacaacacagtcaacagaaggaaaaagcgcatgaggtagagtccaaaggaaaccaagaacaagcttccaagagtcctctcctagtggagtgttacagttcatgcttaattcttccaacaataattattgacaataagtgcaaagtgctgtccatcagtgaagctcccctgagccttgcagtccagagtttttatcaggggttagtgacttagataacttctgcctagcatgcaccaaaaattcagaaggaaagcaggtgttcagcagaaaccgcattgtttatataagcagtttaggtacagtgacccactcttatcatttaggaaaagttttatataagtatagaaagctgtttactggtcaagttcccagactccagttaagggccaaccttacaagcaggctaaagataggaagtcttaggccaggtgcggtggctcacgcctgtaatcccagcactttgggaggctgaggctggtgaaccacctgaggtcaggagttcaagaccagcctggccaacatggtgaaactctgtctctactaaaaatacaaaaattagctgggcgtggtggcacatgcctgtagtctcagctacttgggaggcggaggcaggagaattgcttgaacccagaaggtggaggttgcagtgagccgagatagtgccattgcactccagcctgggcaacagagtgagacttcgtctgcaaaaaaaaaaaaaaaaggtagtctcacacagtaataataataaaagtattgggcaaattgccttatgatgtggtttgatcttaatttagcttattatttcagggtgtgttgagtaaatcaattaattggagggagctggaaaagcaatattatacccagacagtttatgaagaagaaattattcacatgcttgaatactgtggagtaagtatttcactttccacccaacattggtggtggggggagttgattgtatatttaatgattcaggtttttaaagagaatagcaaatttttaaaaacatagctgtacatactattttttactttaaaagatttttcatttttgtctgggcatggtgggtcacacctgtaaccccagcaccttgggatgctgaagtgggttgatcacttgaggtcaggagtttgagactagcctggccaaccccatcactactaaaaatacaaaaattagccacgtgtggtggtaggtgcctgtaatcccagctattcaggaggctgaggcaggagaatctcttgaacttaggaggcagaggttgcagtgaaccaagattgtgccactgcactgcagcctgggcgacagagtgagactctgtcttaaaaataaataaataaaaattcttttaaaataaaacacagatacagagaatcatgcaaagcaaatatgtggtttactacatttattaaaaggcaaacacactgtaactagtacctaggtcaaaaataaaacttgaccacccaacccagaaaccccttcaaatgtgtcctaatcacaaggccttcctccctgcattattagtaatcgttatccttatgtttatagtaattactccttctgcctttaaaataattttattatccaaatgtgtatctgtagaccctatagttcttttatttgaagtacctttaataagttgccttccgatagaaaaccaaacaccgcatgttctcactcataggtgggaattgaacaatgagaacacttggacacagggcggggaacatcacacaccggggcctgttgaggggtggcgggctaggggaaggatagcattaggagatatacctaatataaatggcaagttgataggtgcagcaagccaacatggcacatgtatacctatgtatcaaacctgcacgttgtgcacatgtaccctggaacttaaagtgtaataataaaaaatcaatcaatcaatctgtaaaaaagaaaaaagataacttgccttccatccctttattttccttataatttatttcatgaagaatttaggttatttgacctgtagggtttctcacaatctagatttttctgattgcattctcatggtacagttcagcatattgctctacgttgcctgaaaattggcagttggatctaaaggcttgattaaactcattgttttgatttctttcacaaggctatataggaaacacataatatctgattatctctttttttatgatataagcctctactgatgcttaatgactatatcaattcattgaaggttgctgatattctattatttctttttcatgtatttgaatacttttatagggagacacttacctcatatattatttagttacatggtagttcagtttgtataagaaaggcagttatggtaaatgcttgattttttttctgtaatttaccagttttcaagatgatgaattggtttcctactgctcttcaaaagtgaccgatccttttcttttttttttttttttctctgtcttgctgtgtcgcccaggctggagtgcagtggcacgatcttagctctcagctcactgcaacctccgcatcccagattcaagcaattctcctgcctcagcctcctgagcagctgggactacaggcacgcgccactatgcttagctaatttttgtatttttagtagagatggggtttcaccatattggtcaggctggtctcaaactcctgacctcctgatacacctgcctcggcctcccagagtgctgggattacaggcatgagccaccgcgcccagcaatccttttcatgaatttaaattttttactgtttgaaagatactgagactcttaagaaacttcaaaaaaaagaaatctttctactatgaatgagaactttttatttataattaaatcactgtaaactttactcttgtaaagtaggtctatctcacgtaacttcaaaaggtagttgattgcttgcctaagaactttattacaaaatagctttatcgggaccaggcgtggtggcacatgcctgtaatcacagcaatttggaagactgaggtaagaggatcacttgaagccaggagtttgagaccagcctgggaaataaagtgagactcttgtctctacaaaaaaaaaaaaaaaaaaaaaaaaaaaaaaagctgggcatggtggtgcatgcctgtagtcctagctactcaggaggctgaggtgggcagatcacttgatcccaggagttcaaggctgtagcagtgagctatgattgtgtcattgcactccagcccaggtgacagagcaagaccatttctcttaaaaaaaaaaaaaaggctgggcgcaatggctcaccctgtaatcccagcactttgggaggccgaggagggcagatcacgaggtcaggagatcgagaccatattggccaatacggtgaaaccccatctctactaaaaatacaaaaaattagccgggcgtggtggcaggcaggcgcctgcagtcccagctactcgggaggctgaggcaggagaatggcgtgaacccagaaggcagagcttgcagtaagccaagatcacgccactgcacgccagcctgggcaacagagcgagactccgtctcaaaaaaacaaaaaaaagctttacctgctagttagttcctatacatataatcagaagaatacctgtatttgaaagtttatgagaaacttacatgtatgttttaaaggaagtttataaattttggtcatctgaaattgcaatgtagttgtcttagtcaattttgtgttgctgtaacagaatatctgagactgggaaatttataagaccagagatatatgtggctcacagttctggaggctagaaagtccaaggttgaggggcccacatctggtgagtgccttcttgctgcattatttcatggcagaaggcataagggcaagagagaatgtgtgtgtgtgcaaaagagatagagggagggaagaggctgaactcattcttttatcaggaatccattcccggtaactaacccactcccacagtaagggcattagtccatttatgagagcagaaccttcatggcctaattaaaggtcccacctttcaacactattacattggggattaagtttccaacacatgaactttgggggacatatttaaaccatagcggtagtcttatttggcacttctcatctcacttagaaccagttcacaataacgaatattcaataaatgttaagatgttttccctactctttgtattttcccagtcaaaaaaaaagttcaatttattgatgtcccactctgagtaattcggggaccctttgatctttacatttccatatgttactaaacttccttcctcttatagtgatttgttgtggtaaccaggttgttcggtatttttgttttccttgccttcaaccaattttaattttttttttttttgagatggagtttcactcttttgcccaggttggagtgcagaggcacaatcttggctcgccgcagcctccgcctcctgagttcaagcgattctcctgcctcagcctcccgagtagctgggattacaggcatgtgccaccacgcccggctaatttcgtatttttagtatagacggggtttctccatgttggtcgggctggtctcgaactcctggcctgaggtgatcctcccacctcggccttccaaagtgctggtattacaggcgtgagccactgcgcccggccaaccaattttaattctttaacttaaaaaaaaaatgtatggtcatataattcaagcatcaaaaagtataaatagatacatatagtgaaaagattcctaccccatctgtgcttaggtccaatccccatcaacaaataacaacctatattgtttagtgtttcagggaatttttggtccatgtgcaaaccaataaaaatatgaactttttttatctttttctttttattttgttgaggtagggtctggctctgtcaccttctacctcagcctcctgagtagctgggattataggtatgcaccaccacacctggctaatttttgtattttttgtagagatgggatttcacaatgttgcccaggcttgtttcaaactcctgggctaaagcaatctgcctgcctcagcctcccagagtgctgggattacaggtatgagccactgtgcccagcctcacttcccttttttatggactatacaaagtgtttccttattattttttactgctatataatagtctattatgtgaatggatgtaccataattaatcagtaccctgttgatagatgtttatgttgtttctcatcttttgctattaataaacagtgctgcagtgagtaactttgtacattcatgttatataagtgtaaattcctagaaatatgattgctgagtcaagggtataataatgtagttagattttgtctaattctggttatgtcagtttacaccaccagcaggaatgtgtctttcttcataagttctcaaattcagtgtgttatcaaactttagtttttattttttgtcaactggcactggaaaatggcgtagttttaattaacttaagcatgagggaagttgagcaagtttttataagtttaagagcagtttggctgggcacgacggctcacacatgtaatcccagcactttgggaggccgaggtgggcagatcatgaggtcagattgagaccatcctggccaacacggtgaaaccccgtctctattaagaatataaaaaattggccgggcatggtggctcacgcctgtaatcccagcagtttgagaggccaaggctggcagatcacctgaggtcaggagtttgagaccagcctggccaacatggtgaaaccccgtctctacttaaaatacaaaaattagccgggcatggtggcaggcacctgtaatcccagctacccgggaggctgaggcagagaattgcttgaacccaggaggcagaggttgcagtgagccaagatcatgccattgcactccagcctggaggacaagagcgagacttcttctgaacaacaacaaaaaaaaaaaattagccaggcatggtggcatgcgcctgtagtcccagctactcaggaggctgaggcaggagaatcgcttgaacccaaaagggtgaagttgcagtgagctgaaatcgtgccattgcactccagcctgggtgacagagtaagactccacctcaaaaaaaaaaaaaaaagagcagtttgtattttgttttctgttgcccttatgtgtatatcctttgctcatttgggggttctgggctttcaaaaaaattattcaattctagctcttaataaattaaagtgatttgccatttgtaatatgagttgcaaatatattttcccaggctgtcattttttcttttgactttggttttagcatataacaaagtttatttttacttaaattctattgtacagtcatgctctgcataacaatgcttcagtcacatatataaggtggtccaaaagattgtaataccatatttttactatatcttttctttttcttttttttttttttgagacggagtcttgctctgtcgcccaggctggagtgcagtggcacagtctctactcattgtaacctccgcctcctgggttcaaatgattctcctgcctcagcctcccaagtagctgggattacaggtgcccaccacacctggctaatttttatattttagtagagacagagtttcaccatgttggccaggctagtcttgaattcctgacctcaagtgatcaacccacccttggcctcccaaagggcagggattacaagcatgagccaccgtgccttgcctactgtaccttttctatgattagatacacaaatacttacaattgtgttacaattgcctacagtattaagtacagtaacatgttgtacaggttagtaacctagaaacaatagattataccatatagcttgggtgtgtagtcagctataccgtctagatttacgtaaatacattgtgatgttcacacaacaatgaaaccacctagtgatgcatttctcagaacatatcccatcattaagcaacacataagtgtatttacaagtccttaaacttagaatatagttttgagactttaataggcaatatttctttttttcttgataatttttttctttttttttttgagacggagtctcactctgtcgcccaggctgaagtgcagtggcacgatatcaggtcactgcaaccactgcctcccagatttaagcgattctcctgcctcagcctctcgagtagctgggataacaggcacacaccatcatgcccggctaaattttgtatttttagtagagacagggttttgccatgttggccaggatggtgtcgatctcctgacctcgtgatccgcctgcttcagctccccaaagtgccgggattacaggcgtgagccaccgcgcctggccagtaattttaaattctggttagttcaaccagagaaagggatttggagaagctggtatcctcctgtgcttgaatttacattactcagttgtaagacttttggaagttcaaaggttaaggcagatcatggattttaaaactttggctataaaaaaaaatgatgcaggctaaatgataccctttactgtttagtaggaaacagcaataaagtgtaagtcatttatcttagtcgtgagttaaattttaatacatctttgttttttaaaaaagtcatggtaaatatatacaacataaaatttactatcataaccatttttaagtgcatagttcagtggcattaagtatatacatgttgtgcaaccatcaccaccatctatctccaaaacatttttatcttctcaaactgaaacttacccattgaacaaaactattcattcctcccttctcccagtctctggcaactgccattctctttccatcgctatgaattttactactatagggacctcatacaagtggaatcatacaatatttgtccttttgtgtctggcttattcacttaagataatgtcttcagtgttcatccatgttgtggcatgtgtcagaatttcattccttttaagactgcataatgtttaattgtttgaatatactacattttatttatccatttattcattgatggacatttgtcttttctcttttttttttgacaaagctgttaataccctattttatattaaataatgttttctttcctttcatatgttcagacagattctttcaaaatgggacaagagtttgtgaaacacttcactagcagtgcagacaagctaactaaccttaatctggtttccagaactttaaatttagatatatcaaaccaagttgtatcccaaaaacctgctgactgccataattctagcaaaacatctgtcagtgcgacatcagaaggactcttattgcaagatacctctaagatgaagcgcttcaatcaaacactttcaaccaacaaaagtggttatacaagtcgcaaccctcagtcataccacctacttagtaaagaacaaagcagaaacagtcttcggaaagagtctttaatatttatgaaaggagtcatggatgaatgtactcatgtagcaaatttctcaggtactaatttttatatgaaattgagaatatttgctgatgtgtaagtatttgtgaaatattttaaaagatgctctataagataattttatattttcaagggtatatttttttgttggctccagaatatgtttgcaaagataagttggttacttaaatgtatcatattctatctatgaaaatttaagattatcttattcattaagaaacacactggacagccgggtgtggttgctcatgcctgtaatcccagcattttgggaggctgaggcaggtggattgcttgagcccaggagttcaagaccagcctgggtaacatggtaaaaccctgtctctaccaaaaaaaaaaatacaaaaaagtagtcatgtgtggtgttgcaagcctgtagttccagctacttgggaggctgaagtggaaggatcgcttcagcccaaggagttggaggttgcagtgagccaagatcacaccactgcactccatcctgggtgacagcaagactctcacacacacacacaaacacacatacacacactctcacacactctggagctggacacagtggctcacgcctataatcctagcactttgggaggctgcggtgggaggaccgcttgagcccaggagtttgacaccagcccgggcaacatagtgagaccctgtccttatcaaaaatgtaaaaattagctgggtggccgggcccagtggatcacgcctgtaatcccagtgctttgggaggccaaggcgggtggatcacttgaggtcaggagtttgagaccatcctggccaacatggtgaaacctcatctctaccaaaaatataaaaaattagttgggcgtaatggtgtgtgcctgtaatcccagctactcaggaggctgaggcaggagaatcatttgaacccgggaggtggaggttgcagtgagcagagatcatgccactgcactcagcctgagtgacagagtgagactccatctcaaaaacaaaaataaattagctgggtgtggtggcatatgcttatagtcccatctactcagaggctgaggcaggaggatcccttgagcccaggaattcaaggtggcactgagctatgattgcaccactgcaccctagcctcggtgacaaagtgaaactcttatctcccaaaagaaaaacactggattgctgagtgtggtggcattcacctgtagtcccagctactcaggaagttaaggagggaggatcacttgagcccaggagttcaaggctgtagtgcactatgatcttgccaatgaatagccactgcatttcagcctgggcaatacagtgagatcccatctttaaaataaatgattgaggcgatgcataccttacgtactctgatgtgattattatgcattgcatgcccgtatcaaaatatctcatgtaacccataaatatatacacctactgtgtacccacacccacacaaaagaaataaattagttaatttttaaaaaccacagtattttgtatcatttttagaatatttatctcgtactggagatgagtaaggtagcatattatagttgatttttaatttaatcaaaaatgtttagtttgacgaatgttttatttactgcattgtgtgggtttttttattttctaatgtgtatatgttgaatttttaaaaatcctatacctagtcccagttgatccaagcctcattatagtggttcaagccaaagaagatgcctatattccacgaacaggagttcgaagtttacaagaaatttggcctggttgtgaaatccgatacttagaagggggtcatattagtgcttatctttttaaacaaggactcttcaggtaagacggctggtctaaacatgtattcgttcatttgttgtttgttttctggattttttgcttcaacaaatgtaaaagatcacatatttttatagtctgtttcaatctttgaattccctcctcacctcccacaaatctcacagagttacttttccctctttcctagaatttgatcttcttattttcttctagagaactaagcatgatgcatattataggcatgctttatcgtgtggctttcccctcttcaaatattaatggccaggtattttaggatgtgagaaggaagatcatggcttgttaaagttgctttggtgcatcaagagttttttcactctattctgatgttttttcagaatggcctgaacatctgtggaataatttagcaatgtttttcagttagcaagtgaatattgaaccttaaataagaagtgcttttaatgtgaacaaccttatatgactccactattttagttagaacttataaaaacttttatgctggctgggcgcggtggcttacgcctgtaatcccagcactttgggaggcggaggcgggtgtatcacgaggtcaggagatcaaggccatcctggctaacacggtgaaaccccgtctctagtaaaaatacaaaaaaaaaaaaaaaaaagtagccgggcataggtggtgcatgtctgtagtcccagctacttgggaagctgaggcaggagaatggcataaaacccgggaggcggagcttgcagtgagccgagatcacgccactgcacttcagcctgggagacagagcgagactccgtctcaaaaaaaaaaatttttttatgctaaaactataattttctggtattctgcattattgaaacatattcctcatgttattattaatgattaagtaaattgattcacataaatggttagatcagtgccctgtacataagtgttaaaaaaaacttccaactggatagctatataatagaagaattgtatgtgatatgtttgacatgttttagctcttgttaacggaggaaataatttttctatgttgttacttatctagcccaacttataaatgtcaccctttttagaaataaaccaattgttcaagtctctcatgtcttgaaggatatagtaaacctttctttttatagtatgatcttttaagaagtattcatgcagcatttgagtccctattggtgagtgagcagactatccaatactcattggccctctggcacaacaaaattaaaacaaataaacaaaaatccgtgactacctagggttgctaggattgcttaagaagagtctaaagttctgttatacatgtgaacgcagaggacccacatgcttgcattagtaaattagtatcaaatttctttcactcttttgtgtatctaagtgggagtatagctaagacgtattaggaagagtagatttataatcaaagtcaaatataaaaacacaaaagtgctattatgaaggcttcatttgagagagataaatgttaactattatcatgtgccagatgctagggcaattgctctgttattatcccctttacacagaataaagggaacaaaaaagattaagtaacttgctcaagtggagtcactactaagctatttgacctcttccattccccatcagtcacttcaaaacttaacagaggttagatgacattggaatagtagaatttttaaaaattcagtcttttcacacaccaaacataaaaataaaagaagccgccaggtgcggtggctcacatctgtaatcccagcacttcaggaggccaaggcgggtggatcatgacatcaggagttcgagcccagcctggccaatatggtaaaaccccgtctctactaaaaatacaaaaattagctgggcgtggtgggcacgcacctatagtcccagctactcaggaggctgaggcaggagaaccgcttgaacctgggaggtggaggttgcagtgagctatcgcaccactgcattccccctggaggcagaggttgcagtgagctgagatcgcaccactacattccagcctgggtgacagtgagactctgtctcaaaaaatgaatgaatgaataaataaagccattcctttatgtgctctaatattttgtgttatttagagcttattgataatacaggtgaataagagactattcacatgattaaaaagggacatacattacatgtacacaagcccgtattgtaacttttggcaccaggaagtaaacaaattcagattcattccacaagagcaagtgcctggaactaactctgaggaaaaaaattatccagtgggtgggccgggcgtggtggctcacgcctgtaatcccagcactttgggaggccgaggcgggtggatcacgaggccaggagatcaagaccatcctggctaacatggtgaaaccctgtctctactaaaaatagaaaaaaattagctgggcgtggtggcgggtgcctgtagtcccagctactgcagaggctgaggcaggagaatggtgtgaacccagaggtcagagcttgcagtgagccgagatcgcaccactgcactccagcctgggtgacagagtgagactctgtctcaaaaaaaaaattatccagtgggcaataatttcaaagccctctttacttcttccctattgctgtcatatctgtcttcaaaacaaaatctctttatgtgtttacaccaacatgcaaatatccacctctaatttttttcccttcttatggttcattataattcacagggaacaagtacttgagccaaagaaagacaagcatgttgtaaaactatgacttcccaacatattggaaataataatctattagcaggctatcagtttcaaagatagtcttttttttttttttttttttgtcttttttgagacagagtctccctctgtcactcaggctggagtgcggtggcatgatcttggctcactgcaacctccacctcctgggttcacggcattctcatgcctcagcctctgcagtagctgggactacaggcgcccgccaccacgcccggctaatttttttctatttttagtagagacggggtttcaccatgttagccaggatggtctcgatctcctgacctcgtgatccgcctgtctcggcctcccaaagttctgggattacaggcgtgagccaccgcacccggctaaagacagtcttaatagctgtgtttggatgtgaggatatggttagttgaacaagtgggatacaaaattaatatctgatagttatttaaactgggtgaaaatatagacatgcattttcttttttcttttttttttttttttttgagctggagtcttgcttgtcacctaggctggagtgcagtggcgcgatcttggctcactgcatcctccgcctcccaggttcaagcaattctcctgcctcagcctctcgagtagctgggattacaggcacccaccaccacacccggctaatgtttgtattcttagtagagatggggtttcaccatgttggccaggctggtctcgaactcctgaccttgtgatccgccctccttggccttccaaagtgctgggattacaggcgtaagccaccgcgcctggcctagacatgcattttcttaaaagcctggaggaaagatatgaaaaggttaacagtagatgtgagtgatgggattatgatgttttccccttcctatgttttggattttctgaatattctgctataaaaatgtattatacaataggaaaaaaacagctttagaaaaaaatatgagtggggcagggtgtcgcaggactgtagttccagatactcaacaggctgaggtgggaagatagcttgaggccaagagtttgaggctgcagcgtgctatgattgcacctgagagtaaccactgcactcaagcctaggcaacatagtgagatcttgtctctaaaaaaaaagaaaaaagaaaagaaaaaatatcttatggaagataaaatttgtctattccttttctttttctttcttttttttttgaaacagagtttcgctcttgttgcccaggttggagtgcaatggtgtgatctcagctcacacaacctctgcctcccaggttcaagcaattctcctgcctcagcctcccgagtagctgggattataggcatgtgccaccacacccggctaattttttgtaattttagtagagacggggtttctccatgttgatcaggctggtctcaaactcccgacttcaggtgatccgcctgcctcggcctcccaaagtgctgggattacaggcttgagccatcgcgcccggcctgtctattccttttcaattgaaatattaaaatacttggtaaagttaatgtgagaaaccaaggcttttgattttaagtagctaggaacatgttcatagtaaatgaaaaacatctatatcataatctgtgaaacagaatcttacattctgaaaagttacataattaattttcaacgaagcgataagacaataaatcagttcctttttctttcataatttattttatacacattacacacatgtgcctctgtgtgcgtgcgtgtatgtatgaatatatatattctaaggcacaaaaagtgcttcagaaaaagataatgcttttagatccctcataaattggaagtatatttgaggttttccggtagtggtggtaaagttgcatgcatctgaggcaggcggatcacttgaggccaggagttcgagaccagcctagccaacatggtgataccccgtctctactaaaaatacaaaaaattagcagggtgaggtggtgcatgcctgtaattctagctacttgggaggctgaggcatgagaatcacttgaaccgggaggcagaggttgcagtgagcagagatcatgccactgcagtccagcctgggcgacagagcgagaccctgtctcaaaagaaaaaaaaaagttacatggattcaaacacccattctggggagggtaactgcctatttcatagctatttagagaggatgtcaagttgcaagccacagataaatttggaaataacttacagtaaaggcattgtttgtcccccctttttgttagttacttagagtttttctttcatatttaattttagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatataaaatcagtgttaactttgaattctaaaatatcctgatagcttcatagataagtgcttttctttttcttttttttttcttttaacatgtacctctacttgaatgtaagtgcttttaataatcaaagtgagtggcagggtgcggtggctcacgcctgtaatcccagcactgggatgctgaagcgggcagattacctgaggttgggagttcaagaccagcctgaccaatatagagaaaccccctctctactacaaatacaaaaaattagccaagcatggtggcgcatgcctataatcccagatactcaggaggcagaggcaggagaatcgcttgaacccgggaggcagaggttgcggtgatccgagatcacaccattgcactccagcctgggcaacaagagtgaaactccgtctcaaaataataataataaccaaaatgagtgttctgcagataaaatgcattagactttgctagactaaaactttactaaagattagggtttttaaaaaatgccaataggccgggtgcagtggctcatgcctgtaatcccagcactttgggacgctcaggcgggcggatcacaaggtcaggagtttaagaccagcctggccaacatggtgaaaccccatgtctactaaaagtacaaaaaaattagccgggcattgtggcgtgtgcctgtaatcccagctactcaggaggctgaggcaggagaattggttgaaccaaggaggcggaggttgcactgagctgagattgcgccactgcactccagcctgggcaacagagcaaaactccatctcaaaaaaaaaaaaaaaaaaaaaaaaaaattaagccgggcatggtggcaggcacctgtaatcccagctactcgggaggctgaggcaggagaattgcttgaacccgggaggcagaagttgcagtgagcggagatcgcaccactgcactccagcctaggagaaggagcaagactctgtctcaaaacaaaacaaaatgccaaacttatttctccctactaaaaagtttcaattcacaaaaatggaaacattggaagacctgttgcattaactgacggagtgcagtggcatgatcttggctcactgcgacctccgcctctcaggttcaagcggttctcctgcctccacctgagtagctgagattacaggtgcccgccaccatgcctggctaatttttgtatttttaatagacacgaggtttcaccatgttggccaagctggtctcgaattcctgacctcaagtgatatgcctgccttggcctcccaaagtgctgggattataggtttgagccaccacacccgacctgacattttatttttatttttttaattacatttttctatatgcttattctttggattgctaaccatctaactacccaaatacttaacagccttggcttttaatttcaaaatttaatagacacatatgcaattgatttgtcccatataaactttattttacagaaaatatttaaagttttatgtaatagctattaactctcttaaatggggtttatatggctcgatttggtgctttctttttatgttaaacttctctagctgtcagctaaaatgttaaaaaagtcgaaaatattttagggtattgtgtgaagttttacagtaggtatttttgagttttgtttgaaatctgtgttgtctgtgaattatttttaaatagggattcttagtctactaacgatatttgaattataatgtgcctttgcagtctttttaaaggagatttcatttgtcacctctatgcctctatcatcttaattttttacaaatatttaaaaattattaatgtgaagttattgatggtagacaaagtagtaacttctttcaaactactttggcataacaagccaacactgtacagctctttgagctataagcaattttacatgttcagatgagaacctttagttttaaccaaaagtataacatctactaaagttcttccacaaaatactttttaaaataaaacttgtcaactgaattacgattttcttatattatgtatatagtgaggttatatgattgaatgctttttgaacaatggttttagtaaaacaaatactttattattgttcacataaacatttcttactaagcaataatgtactatgttgtgtgaatttctattgttaaaaaaatgaaatgttgatttagttttaattcttaggcataactaacttttctcaaataaagtgtgaaagaaagtatttttaaaatttcatctcttaaccagatgttttaagaatatatccctaggccgggtgcagtggctcacacctgtaatcccagcactttgggaggccgaggtggggggaccacctgaggttgggagttcgagactagcctgaccaatatggagaaaccccatctctattaaaaatacaaaatttttaaaaaaaatacaaaattagccaggcgtggtggcacatgcctgtaatcccagctactcaggaggctgagccaggagaatcgcttgaacccgggagacggaggttgcagtaagccgagattgtgccattgcactccagcctgggcaacaagagcaaaactctgtctcaaaaaatatatatatatccctaaaactacctcagttgaagaattcaaagtgcaaaataacttttcttaggattttttaatctattccccccaaaatggtggcttaagtgttctcaaatacataaatatacacatatacgtatatgtatacgttttatatatatatacacacacacgtatgtgtgtatatatatgtatgtacgtatatatatgtattatatatacacacatatgcatatatatatatatatatatatatatatatatatatatataatctcaaagaagtgcggtctgccatttatctgccattttgaggatttaggtactacataaaatattagaaattcatttagaccagatctgtaaactggtagttcacataggccagtttgacccacagttattttattagatgtacataatgtttcaaaaatgtttgaatttgaaaagtcttttgattgggtgtgtgttccccagtttgccacagcctactggacttccctcttatatcagacaacttctctactttgtagttcctgctcagccctgaagacctctaagtttgagacccctgatttagatctgtaattagaaaaaggttctgaatttcatgatttgctaatgtaattactattaagtcattttagcatgtgcattttagagtccttctttgtatttttgtaatgtggtgctttctctcataaagataattgaattgttaacactgtaattgaaattttaaaaatcatttccaaatcttttattatatttcacagtaaaagtctatttaaaaagctaatcatttgtgctttttttcaagaggtattattgtaaatacggtagacacatgtcacatttgattaatgtacccaaacttgaactgagtgtatatgttccctctttgttattatgccctaaacaaggtaagacagaaataagcaagggaggctctagcagaacagtatcagtatctctataaaaataaccaaaattttccccaaatatgtgtgatctgagggaaataaacattcttacagaccatagttatctcaatgttgctcaatgttgaatgtgattacatttacactcatgaataaatatactgcaaacaaaatctaggttagactgggaatgggagtcttagatagagtctcctatatgttaataatagtaactgcgtttggaaaggtgaggaaagattatggtagattagacaaaggggaaaaaggtcatttggccactttgcagtaaaatagcctaattctatgaatattcttatagacaaaatcctaggaaaccaatgactgtatgaattataagccaggaattgaatcggccagcaccttggtggactccccagctccagaagtgtgagaaataaatatctgttgtctaagccaccaaattaaggtattcttttatagtagcccaaacagactgaggtaacaggtcatgtgagcaaccattaaataagagtataaaacagcactgtccaatataactttatacagtgacagaaaagtactccatccactctacccaacacagtagtcattagtcacatgtggctgttgatcatgtgaaatgaggcaatcataactgaggtactgaattttttttttgttttttgagacggagttctgctcttgttgcccaggctggagtgcaggggcacgatcttggctcaccacaacctatgcctcccaggttcaagtgattcttctgcctcagcctcccaagtagctgggattataggcatgcgccaccacgcccggctaattttgtattttttagtagagatgggctttcaccacgttggtcaggctggtcttgaactcctgacctcaggtgatccacccacctcggcctcccaaagtgctgggattatagtgtgagccaccgcgcctgacctgaattttttatttaacattcaagtgttaaaatttaatgtgaatagccacatgtaactagtaactattagatagcaccgatacaaaaaatctgaaaagtggcccggcgcagtggctcatgcctgtaatcccagcactttgggaggcggaggtggctgggtcacctgaggtcagaagttcaagaccagccaggccaacatgatgaaaccccatctctactaaaaatacaaaagttagccgggcgtggtggcggatgcctgtaatcccagctacttggaaggctgagggaagagaatcgaacctgggagatagaggttgcagtgagccaagatcgcaccactgcactccaacctgggcaacagagcaggactctgtctcaaaaagaaaaaagaaaaaaagttaggcatagcagggcacagtcttgtgtgcctgtactgccaaccactcaagaggctgatgcaggaggatcacttgcacccaggagttcaaggctgcagtgagctatggttgcactactgcatttcagccagggtgacagagcaaggccctctctaaaaaacaaataaaaatagctgggcgcggtggctcacgcctgtaatcctagagagaaccgttaagaaagtacataggctgtgcgcagtgtctcacgcctgtaatccaacactttgggaggctgaggcgggcggatcacaaggtcaggaattcgagaccagcctaaccaacatggtgaaaccccgtctctactaaaaatacaaaaattagctgggtgcggtagcatgcgcctgtaatcccagctactcaggaggctgaggcaggagaatcgcttgaaccctggagacagaggttgcagtgagccgagatcccaccactgcactccagcctgggcgagagagtgagactccatctctagataaataaaaataaactgatgttgactaaaaaatttatagatgcaccaaaatttgacaaaatttagatctgcaaatttgacctacaaaaatcagttaaaaaaaagattttcaaagaaaactcaaaatacaaaattaagagggatgagaattgatcccaagaaaattagttaacaattagtatgggccgggcttggtggctcacgcctgtaatcccagcactttgggaggccgaggcgggcagatcacgaggtcaggagatcgagaccagcctggccaacatggtgaaaccccgtctctactaaaaatacaaaaaattagccgggcgtggtggcaggcgcctgtagtcccagctacttgggaggctgaggcaggagaatcacttgaacccgggaggtggaggttgcagtgagctgagatcgcgccactgcactccagcctggcaatagagcgagactctgtctcaaaacaacaacaacaacaacaaaaaaaaaacaattagtatgaaagtggaaatgggcttaactgcatcatgaagaaattgatcagagtttaacttgtttagcaaaatttgttcctgaaaatactttgttaatgaagtgctataactagattatgcagggtcctgtaggattttagtctctatgcaaagagctacaggaagacattaaaggtttttctccattgatttaacatgtgtcttaaatacattttaagatgtatttgggacaaatttaggattaggacaaatacctaatgcatgcagggcttaaaacctagatgacaggttgatgggtgcagcaagccaccatggcacgtgtatacttatgtaacaaacctgcacgttctgcacatgtatcccagaacttaaaaaaaaaagattgtcaattgatcattagaaaaaatgtatctggaaaagctcattcactctggctgcaatgaggagaaccaattgaagggggcctatagttcatgcaaatgtttcaactagaaggtcatcaacgtggccaggtgaaacatgatgatagctaaaactaggatggtggcagtggatatgaagaaatctggatgtatttcagagataatacaggtgatgagatgatggtaggttgggggggtgagggtggtacttttcaaagagatagagaaccctggaagaaaactagtgtgagaatacagattaaaaatctagtctggcacataccttggttttttttggtttttatttgtttgtttgttttgttttgttttttgccagagtctcactctgtcacccaggctggagtgcagtggcacgatcctgtctcactgcaacctctgcctcttgggttcaagcgattctcctgcctcagcctcctgtgtagctgggactacaggggcctgccacccggccccgctaattatttgtattttttagtagagacagggtttcaccatgttaccccaggctggtgtggaactcctgagctcaggcgatctacccaccttggcttcccaaagtgctgggattacaggtgtgagccaccgcgcccggcccatacagatttttatatgtctaaaactagacagtaacatggcagttggaggctcaaagcagaggcctgaacaggagataaaaactcctaatcactagtatttagatggtaactgatgttacaggcatgggtgagattttgaggacagcctaggaaaggaagaggacattggacaatggttctcaaactttttcatctaagaaatcctttaactcttttttttattttttttgaagacggagttttgctcttgttgcccaggctagagtgcaatggcacgatctcacttcaacctccgcctcccgggttcaagcgattctcctggctcagcctcctgagtagctgggattacaggcacatgccaccacgcccagctaatttttttatagttttagtagggacggggtttcgccatgttggccaggctggtatcaaactcctgacctcaagttatccgtccgcctcggtctcccaaagtgctgggattacaggcgtgagccaccacacccagcctgaactatatctattttataaaaagaaaacacagtgaaaggcattcaggtacttgatgagatcctcactgttagtttaatggtagagccagaactcttccccttcccctccttttcaatcagccctccagagatttctcttagctggggctaaggcccctaattttgttatttctgtgacacttagtactttcctttatcacagcccttatttcattatatttaaataattagttaattgtgtcccaccccctccatacccagtctgtgaaggaagcagatcttactcatttttatgccctcagtgcctggcacggttggaggcattactaagtgttccatcaaagtttgcagaatgatttgaagtgtagtgttcttttcactgttccagcttgtagttttaaaccatattagaaaggaattttaagcaggaattttaagcagaaattttatgatcttctccagtggttttcaaactgggttccacatgcttctgagagttgttttttagaattaaaaaattacggccaggtgaggtggctcacgcctgtaatcccagcactttgggagggcaaggtgggtggatcacctgaggtcaggagtttgagaccagcctggccaacatggtaaaaacccgtttctactaaaaatacaaaaagttagccgggcgtggtggcgcacgcctgtaatcccagctactcgggaggctgaagtgggagaattgcttgaacctgggaggcggaagttccagtgagccgagatcacgccactgcactccagcctgggtgacagagtgagactccatctcattaaaaaaaaaaaaaaaagtacatgctttcgtcttaatgacattctaaaacaactagtatacaatcttctgcatcatttaggccaatagttctcaatcctggttacggatttgagtctcagcagaaagctgttaataaatattgatgtccaagctatactccaggctaattaaatcagaacctctgagaagggggccccctacaagggcattttttcctcaaaaaatcttgaggtgatttaaatgtacagtcaaggccaggcatggtagctcacgcctgtaatcccagcattttgggaggccaaggtgggtggatcacctgaggtcaggagttcgagaccagcctggccaacatggtgaaaccctgtctctactaaaaatacaaaaaattaggcaggcgtggtggtgggcacctgtaatcccagctactcaggaggctgaggcaggagactcacttaaacctaggaggcagaggttacagtgagccaagatcacgccattgcactccaccctgggtgacaaaagtgaaactccacctcaaaaaaataaaaaatgtagagtcaatgttgagatttaccatgatctagatcaagggttggcaaacttcacctataaagggccagatagtaaatattttaggctttgcaggccaacacccaaaattgaggctataatttaggtacttacatgaggatgaaaataaatgcccacaaatttttattgatgaaattcaaaatatgataataattattgtttctactatagctctactaatgagaagaatgggattctttttggaggagacaattcacttagttgaggatcaagatttgttttccctatcatcaaaatctgttggaaatattcatctgttaatactgatctgtaatgaaattttacatatttcagctttgaaaatgtctccacacagataggtactgtcaaatactgatatcaatctaaaagcaaatttttttttttcttttttggagacaagagtctcgctctgtcgcccaggctggagtgcagtggcatcatcttggctcactgcaacctccgcctcccaagttcaagcaattctcctgcctcagcttcctgagtagctggaattacagatgcctgccactatgcccagctagtttttgtatttttagtagagatggggtttcaccataatggccagcctggtctcaaactcctgacctcaggtgatctgcctgcctcggcctccaaaagtgctgggattacaagggtgagccagggcgcccagccaagaaattttttttttttttttttttttttgagacagagtctcgctctgtcgcccaggctggagtgcagtggcgcgatctcggctcactgcaagctccacctcccatgttcacgcctttctcctgcctcagcctcccgagtagctgagactacaggcgcccaccaccacacccagctaattttttgtatttttagtagagacagggtttcaccgtgttagccaagatggtctcgatctcctgacctcgtgatccgcccgcctcggcctcccaaagtgctgggattataggcatgagccaccgcgcccaaccaggaaatgcttttaattgaacatattcaccatttgaaaggcaatttatagaattctatttgattctgttcctgttatttgcccttctttatattgcctttttattgcctttttgcagcaatataaagtgacgatagcacaacataaagtctctgttaccactactcaactctgttgttgtagtgtgacaacagccatagacaatacataaatgaataagtatggtcttgttccaacatcatttaatttatggaattgaaatttgaattttgctgggtgcagtggctcatgcctgtaattgcagcagtttgagaggccaagggtagtggatcacctgaggtcaggagttcaagaccaaaccttgtctctactgaaaaaatacaaaaataagccagacgtggttgtgcacacctgtagtcccagctactcggaggctgaggcaggagacccgcttgagcctgggatgctgagattgcagtgagccaacatcgagccactacattggttgaattttaagactccatctcagaaaaaaaaaaaaaatttgaaatttatgtgtttttttacgcgtaacaaaatactgtgtctggaaatgagggttcttggtctcactgacttcaagaatgaagccgcggaccctcgcggtgagtgttacagctcttaaggtggcgcgtctggagtttgtttcttctgatgttctgagtttcttccttctggtgggttcgtagtctcactggctcaggagtgaagctgcagaccttcgcagtgttacagctcttaaagcagcacgtctggagttgcctgtttctcccggtgggctcttggtctcgctggcttcaggagtgaatctgcagaccttcccggtgagtgttagggctcataaaagcagtctggacccaaagagtgagcagtggcaagatttattgcaaagagcaaaaaaactaaagcttccacagtatagaaggggaccaaagcggcttgccacagttggctcgggcagcctgcttttattctcttatctggccccacccacatcctgctgattggtagagccgagtagcctgttttgacagggcgctgattggtgcgtttacaatccctgagctagacacaaaggttctccacgtccccatcagattagttagatacagagtatggacacaaaggttctccaaggccccaccagagcagctagatacagagcgtcgattggtgcactcacaaaccctgagctaaacacagggtgctgattggtgtatttacaattcctgagctagacataaaggttctccaaggccccaccagactcaggagcccaactggcttcacccagtggatcccgcagcggggctgcaggtggagctgcctgccagtgccacgccatgcgctcgcactcctcagcccgtgggtggtcgatgggactaggcgccggggagcagggggcggcgctcgtcggggaggctcgggctgcacaggagcccacggaggcaggggaaggctcaggcatggcgggctgcagtcccgaggcctgccccacgggaaggcagctcaggcccggcaagaaatcgagcacagcgccggtgggccggcactgctgggggacccagtacaccctctgcagccgctggcccgggtgccaagtccctcactgcccggggccggcagggccggccggctgctccgagtgcggggcccgccaagcccacgcccacccggaactccagttggcccgcaagcgctgcacacagccccggttcccgctcgcgcctctccctccacacctccctgtaagctgagggagccggctctggccttggccagcccagaaaggggttcccatagtgcagcggtgggctgaagggctcctccagtgccaccaaagtgggagcccaggcagaggaggcgccgagagcgagcgagggctgtgaggactgccagcacgctgtcacctctcaatactctttttttctttttcttttttttttttttttgagacagagtctcgctctgtcgcccaggctggctggagtgcagtggcacaatctcggctcactgtaacttctgcctcctgggttcgtgccattctcctgcctcagcctcccgagtagctgggactacaggtgcccgcaaccaagcccagctaatttttttttatttttttttagtagagatggggttttaccgtgttagccagaatggtttcggtctcctgacctcgtgatccgcccgcctcagcctgccaaaatgctgggattacaggcatgagccatcgtgcctggcccctctttttttattttcttaatcattaaaaaaagtaaaattcattcttagtttgttcctgtataaaaataggtggtaggctgggcgcagtggctcacgtctgtattcccagcactttgggaggccgaggtgggtggatcacgaggtcaggcgttcgagaccaaactgaccaacatagtgaaaccccttctctactaaaaatacagaaattagctgggcgtggtgacacatgcctataatcccagctacttgggaggctgaggcaggagaattgcttcaacctgggaggcggaggttgcagtgagccgagatcgcgccactgcactccagctcgggcaacagtgtgagactctatctcaaaaaaaaaaaaaaaaaaggtggtagacagatttggcccatgggccatagtttgccaaggcctgatccagacaatctatatgaccttgaattgttttctaagtagtatatttttactagtgcttatgattggaatcagttatatagtaataaatatggttgttcatatatgtgacatatagtaataaaaacattgtaagtcagaaaaaaagccagtagtcttcttacccttcatgttccctatgtatgattttgtaattagaaaaatattgggtcactgagttatgcagacctccaaaatgttgacacatttcattacacaacatcaaaaattaggttcattaaaatcactactgagctcatcagaaaatctttaagcactaggaagctgttgagttcatggtaatggttaaaagttttccaagcttctcattttctcttgaaaacttgaaggttatcactgacaacaaatattgtctagttgttgccactgatgtgacaggctcatttcattcattttttagaagatgtctgccaaattacctaagcacaagtaaacctattttgttatcaatagtttttttcttttttgtgtgtgtgacagagtctcgccctgttccctaggagtgtaggggcgtgatcccagctcactgcaacctctgcctcctgggttcgtgtgattctcctgtttcagcctccggagtagctgggattacaagcacccaccaccacacccagctaatttttgcattttttagtagagacggggtttcaccatgttggccaggttggtctcgaactcctgacctcaggtgatccgcccgcctcggcctcccaaagtgctaggattacaggtgtgagccaccgtgctcagccccatttgatcttatttctaggggatcatgacactgaaaccacagagaagggaatgcagtcctctcatactacattgttctgcagtaagagatagctataaactcaaaataacataaagctgtttgtggattcttaaattttcagaccaatctatgaacaaagcacaaaggtatattatggttactcaatagagtataagtgattactcctgacaatgtaaggaaaaggaagaaatgtccaggatgtggagacctctcatacgctgccagtgggtgtgtgaattggtacaagagtttggaaaatgacttggcaatatttggaacaaatgaagatatgcagatcctatgactcagaaattctattcctaaaatgataccctcaataaattggcacatgcacaccagaaaaaaaaatgttcataaaagccatgtttacagtagtcccaaattggaagccgaaaaattcatcaacaatagcataaaaaattgtgatatagtcattcaatgaaatacacatactataacagaataaatgacctacagctactctcaacttgtatgaatcttaaaaacataatattgaatgaaagaagcaagacggaaagtagcatatgattccatctacatatagttttaaaaataggcaaaactatgggatgcatgtttagtgacaaaccataaagaaaagcaagaaatttgaggaggccaaggcaggagtatagcttgagcccaggagtccaagacaagcctgggcaacggacacctcatcgctacaaaaattgaaacaaataaaaaatttgccacggccgggcacagtggctcacgcctgtaatcccagcactttgggaggctgaggcaggtggatcacgaggtcaagagatcgagaccacgctggccaacatggtgaaaccccgtctctactaaaaaaaaaatacaaaaattagctgggcatggtggcatgtgcctgtaatcccagctacttaggaggctgaggcaggagaattgcttgaacctgggaggtggaggttgcagtgagccgagattgcatcattgcattccagcctggtaacaaagtgagatttcgtctcaaaaaaaaaaaatttgccaggcttggcagctcatgcctctggtcccagctacttgagtggctgaggtgggaggatctcttgaacctgggaggtcaaggctgcagtgagccgtgatcgcagcactacactatagcctgaacaaaagagtgagatcttgtctcgaaaaaaaaaaaaaaaatggtgtgtgttggtgggggacacatgggagttctaataagagggttgaatgtaaaaataaagaaaagcagacaaccgttggaaggtagaacaaagggtaggatgatatattctcattttatagagtggcaatataagaagctctttctaaaattggtgaaatactaagtaaatgttcaaattacttaaattatttaaaatttccaagtaaacaacaaaaatatcagaaattgggaggagaatcgagcaggggcttatgtaagtgtgttaaatcctcatgttttatagtggcaaggcaaaagttgaaagatggtaactttggggattagtacctttgtgaagtagaactgtttttttattttcattataaacaatattgtaccatttggtgttaccatatgcataagctaattgcatttttttttttttgagacggagtttcgctcttgttgcccaggttggagtgcaatggcgccatctgcggctcactgcaacctctgcctcctgggttcaagcgattcttctgcctcagcctcctgagcagctgggattacaggccaccacacccagctaattttgtatttttagtagagacggggtttctccacgttggtcagggtggtctcgaactcccaacctcaggtgatccgcccacctcggcctcccaaagtgctgggattacaggtgtgagccaccacgcctggcggctgattgcattttaaaaaccacaagctattttgtagtattgttgaacaactttaaggggaaaaaaaggcaatatagtgtattgttatggttaagagtatgaactatggagaactatgaagccagattgcttgggctcaaatccttgctctggcactttctttttttttttttttttgagatgggagtctttttttttttttttgagatgggagtctagttagctctgtcgcccaggctggagtgcagtggcatgatcttggctcactgcagcctccacctcccaggttcaagcaattctcccgcctcagcctcccaagtagctgtgactacaggcatgtaccaccacacccggctaatttttgtatttttagcaaagatggggtttcaccatgttggccaggctgctcttgaactcctggcctcaggtgatccactggccttggcctcccaaagtgctgggattacaggcgtgagccaccacgcccggccctggcactttctaattgtatgattctaggcaagccatttatccattttgcctcagtttcctcatttaaaaatgggggcaataataatctgtattttatatagttgttcttaggattaaatgaattaacacatgtaaaacacttagtgtctagcatatgtgtgttaactattacctaccactaggtagttaattgtgaaaaataaagctgaaaggaaaagatgaagactgaaaattacccagtagacttattaacatgtaagtcatttgatattttagtgacacggttgagtgatagagccagaaactggactgaagagggagaagtgaagaaacagatgcatactcaattttccatgaatcattgatcatactccttacatttttttcttaactcctttgactttcccaaagataactactatctttttttttttttttttgagatggagtctcgttctgtcacccaggctggagtgcagtggcacaatctcggctcactgccaccccgcctccccggttcaagcaattatctgcctcagcctcccgagtagctgggattataggaacatgccaccacgcctggctaatttttgtatttttagtagagacagggtttcaccatcttggccagcctggtcttgaactcctgacctcgtgatccacccgcctcgccctcccaaagtactgggattacaggcgtgagccactgtgcccggcctgataactgctatctttacttctaacacaatagattaattttgctctttttgaactttaagtaaatttaactctatacaaatcacagtgtatttatgtgtgccatcttttatgtttaccagcctaacactatgcctttgagatgtatccatattgttgcctgtagatgtagttaatttttcaaagctgtatattatttcattatatactgtattagtcagggttctttagagggacagaactaataggatatgaaagggagtttattaaggagaattgactcacactatcacaaggtaaaatcccaggataggtggtctgcaagttgaggagcaaggaagtcagtggtagatcagtcccccaaaaccccaaaagtagggaagcagccttctgtttgtggccaaaggctcaagagcccctggcaaactactggtgtacatccaagagttcaaaagctgaaaagcttgtagtctgatgtttgagggcaggaaacatccagcatgggaaaaagatgaaggtcggaagactcagcaagtctagtccttccactttcttctgcctgctttattctagccatgctggcagctgattagatggtgcccacccagattgaggttgagtttccctctcccagtccaccaactcaaatgttaatctcttttggcaacaccctcacaggcacacccaggaacaattcttggattgaaggatttttattcttcaatccaatcaagttgacactcaatattaaccatcacatataccatgccactatttatgtattctactgctggtaggcatttaggctatttccagtttagggctagaagaatgataaagaatgctggggtttttctgttcatgtgttttggtgcacttgtgcacacattactgttggagcaaaatggctgggtcagagatatgctcatattcaactatactaagtactgccagtttcccacaatagttgtactaattttggtagtgtcacactgttttttttctttttttttttttttaatgtcatctggtaagttgtagtgtttgtttctttgtttctttttttatttttttgagatggagtcttgctctgtcgttcaggctggagtgcagtggcacaatctcggctcactgcaacttctgcctcctgggttcaagcaattctcctgcctcagcctcctgagtagctgggattacaggcatgagccaccacgcccggctaatttttatatttttagtagagacggggcttcaccatgttggtcaggctggtctcaaactcctgacctccttgatctgcccgccttggcctcccaaagtgttgggattacaggtgtgagacattgagcctggccaggttgtagtgttttctctttgtgattttaacttacatttccctgctttcttttttttttttttttctgagacagcatcttgctcttgctctgtggcccaggctggagtgcagtggtgtgatctcggctcactgcaacctctgcctcccaggttcaagcgattctcctgcctcagcctcctgagtagctgggattacaggcacatgccaccatgcctggctaatttttgcattctcagtagagatggggtttcaccacgttggctgggctggtctcaaactctttgacttcgtcatctgcctgtcttggcctcccaaagtgctgggattacaggtatgagccaccgtgccccgccccatttccctgctttctaatgaggttaaacatgattttgtttctttttttttttcttttttgagacagggtttcactttgttgcccaggctagagtgtagtggtatgatcgcagctcactgcagcctcaatctcccagactcaagtgatcctcccacctcagcctccctagtggctgagactgcaggcatgccacaataccgggtatccatgaaagtgtcaaattctgtaaaatatttgaagagatttattctgagccaaatatgagtgaccatggcctgtgacacaaccctcaggaggtcctgagaacatgtgcccaagatggtaggggtgcagcgtgattttatgcattttagggaggcatgagacatcaagtacatttaagaaatacgttggtttcacaggaaaggcaggataactgaaattggagttgcgggggtggggcttccaggctataggtaaatttaaaccttttctggttgacaattggttgagtttctttaaagacctgggaaagcagccaggcatagtggctcatgcctgtaataccagtactttgggaggcggggacgggcggatcacctgaggtcaggcgttcgagactagcctggccaacatggtaaaaccccaactctactaaaaatacaaaaattagccgggtgtggtggtgggtgcctgtaatcctagcatcttgggaggctgaggcaggaggatcacttgaacccgggaggtggaagttgtggtgagccaggaccgagccattcagcctgggcaacaagagggaaactccgcctcaaaaaaaaaaaaaaaaaaaaaaagacctgggaaagaaaggcattttcctttcgaaagaaagaaaatgttgaagttaagataaaagattacggagaccaagattatttttgaagccttatagtggctacgcttagagacaatagatgacaaatgtttcctattcagatctttaaaaggtgctacactcttagttaatctctttaggatttggagggcctggaagaaaatacctagctatgttaatatagattctttacagatgcaaatatccccccctacaaaggacagctttacagggccatttcaaaatatggcaaaggaaagaaaaaaaaaataggccgctcgcagtggctcaagcctgtaattccagcactttgggaagcccaggcgggcagatcacctgagatcactgagattgaagccagcctggccaacatggtgaaacaccaactcaactaaaaatacaaaaaactatccaggcgtggtgtcgtgcacttgtaatcccaagtactcaggaggctgagggaaaataatcgcctgaactcgggaggcagaggttgcattgagctgaaatcgtgccactgcactccagcctgggtgacagggtgagactccatctcaaaaataaataaataaataaataaataaataaataaataaaataaaacaaaatatggcaaagaaacatgttttggggtaaaatattttgactttcttctttgttatgccagagtcacactagaaagtaagtcacaatatatagggttaaataaaacccatctgatgagaatttatggtttgtagggcatgactccccagacccctcagataggaatttgggcaagatgaaaaaaatgagagcttagtcctcactggccatatatatatatatatatatatattttttttttttgtagagaccgggtttcatcatgttgcccaggctagtctcaaactcctgggttcagtctcctgggctcaatcaatccaccaacattggcctcccaaagtgctgggattacaggcttgagctactgtgcccagcctatgattttcatataaacatatgaagcattttgattctctcagattttacactcagaatacactatctacagttaattctgaactttttctcctacttaattatattataagaatactaagaagatgagctgagatagggtcttgctatgttgcccagtctggtctcaaactcctaagctcaagtgattctcctgcctcagcctctcaagtagctgggactacaggcagctgccactgtgcccagctttaggcagaaatttagaacttgatctctttatttcatttctcatatccattagattagcaattcctgttaatgagatcattcccaaaatgtatctcaaatcattccattgtcctatgcactgccacctcttaagtccagaccatcatcatatcattcttggaatactacaacaacttcatgtttttcacattttgcattttgtcactgcccattccacttcattttccgtattacagcaacaggggtattaactcttacatcttttcagtgtttttccattgctctgatagaattcaaattctgtcataatccagaagcccctgcaggctctgccttaggctatctctctaacctcatctttactcatgctttgtttttttttttgttttgtttttttgtttgtttgttttgagacagtcttgctttttcacctaggctggagtgcagtggggtgatcttggctcactgcaacctccgcctcatgggttcaagcaattctcctgcctcagcattcccagtagctgggattacaggcaccaccaccacacccggctaatttttgtatttttagtagagacggggtttcaccatgttggccaggctggtctcaaactcctgacctcaagtgatccgcccgccttggtctcccaaagcactgggattacaggcttgagccaccacgcctggctgttttctttttctttttctttttttttttttttttgagacagggtctcgcttgaacccgggaggcggaggttgcagtgagctgagacggcgtcactgcactacggtctgggcgatgcagcgagactgtctcaaaaaaaaaaaaaattaaattaaattaaaaagttaaatggaactgaatagatcatgtaagaatgtcttcatagcccagcgcagtggctcacgctgtaatcccagcactttgggaggccgaggcggatggatcacctgaggtcatgagttcgaaaccagcctggccaaaatggtgaaacccccatctctactaaaaatacaaaaattagctgggcgtggtggcgggcgcctgtagtcccaggtactcaggaggctgaggcaggagaatggcgtgaacccgggaggcggagcttgaagtgagctgagttcgggccactgcactccagcctgggtgacagagcaagacagaggcggtggctctcacctgtaatcccagcaccttgggaggctgaggctggcaggtcacctgaggtcaggagttcaagaccaggctggtaaacatggtgaaaccccgtctctattaaaaacacaaaaattagggacaggcgcggtggctcacgcctgtaatcccagcactttgggaggctgaggagggtggatcacttgaggtgaggagttcaagaccagcctggtcaatatggtgaaaccctgtctctactaaaaatacaaaaaattagctgggcatggtggtgcatgcctgtagtcccagctactagggaggctgaggcaggagaattgcttgaacctgggaggtggagcttgcagtgagctaagatcctgccaccgcactccagcctgggcaacagagtgagactacatctcaaaaaaagaaaaattagtcaggcatggtggcacatgccaggagaatcgcttgaacccaggaggaagaggctgtagtgagccaaaatcgtaccactgcactccagcctaggcaacagagtgaggcaacagaaagaggcctctttcaacaggccaggcgcggtggctcacgcctgtaattccagcactttgggaggccaagcgggggcagatcacctgagctcaggaggtcgacaccagcctgggcaacaaggtgaaactccgtctctactgaaaatacaaaaacttagctgggcatggcagcgcatgcctgtagtcccagctactcgggaggctgaggcaggagaatctcttgaacctgggaggcagaggttgcagttagccgaaatcatgccactgcactctagcctggactccagctcaaaaaaaaaaaaaaaaaaaccaacaaagaaacaaaaaaagaaagatatttatggctgggtgtgtggctcacgcctgtaatcccagcactttgggaggccgaggtgagtggatcacttgaggtcaggagtttgagagcagcctggccaagatggtgaaaaccccttctctactaaaaattcaaaaattagctgggtgtggtggcaggcacctgtaatcgcagcacgacaccacacccagctaaatttttgtatttttagtagagacggggtttcactgtgttggccaggctagtctggaactcctgacctcgtgatccgccagccttggcctcccaaagtgctgggattacaggcgtgagccacctcgcctggctgatggcagtgttttgaaccaaataatttgttcttccagaccaggtgaacaccctacccaagggcagataatccacagattggctaatgaattgtataatctggctggaaaaaataagtagggtcaagcagtcttttatccttaattttgaactatgaagcagaggaagagtctggcacgtagctgcagaggcagaatgaagtaacaagatagaggttaattacagcaaattgggtcagtcagatgaaactaaaatcagacggaacgctcaaattttggaattttaagtttattattaaaaggacactttacagaggtgtgaggctaggcgtggtggctcacgcctgtaatcccagcactttgagaggccaaggtggggggatgacttgaggccaggagttcgagaccagcctggccaacatggtgaaacaccgtctctaccaaaaatacaaaaattagccgggtgtggtggtgggcgcctgtaatctcagctactcgggaggctgaggcatgagaatcgcttgaacccgggaggcagaggttgcagtgagccgcgatcgcgccactgcactctagcttgggcgacagagagagactacctcttaaaaaaaaaaaaatgccgggcgcggtggctcatgcctgtaatcccagcactttgggaagccgaggcgggtggatcatttgaggtcaggagttcaagaccagcctggccaacctgatgaaaccccgtctctactaaaaatacaaaaattagccgggtggtagtggcgcgcctgtaatcccagctactcaggaagctaaggcaggagcatctcttgagcctgggaggcagaggttgcagttagccgagatcacgccactgtactccagcctgggcaatagagtgagactctgtctcaaaccaccaccaccaccaccatcaccaccaccaataaaaaatacaaagcgccactaataacagagctagtaaagatggatgggaatataggtggaagtacaatccccttttaattgcaacaaggttcgccaggttgcttagggttgggcaaactggagatcactgacacggaaaacaagaaaacccttattgtttatagctgttatgtatgaataggttattagccttaggaaaattatttgtgccgaatacggcttttgagtaagcaaaaaatattaacgtcaagttgaatgtaattgaagcgacttattgggcgtggggtggggggtgggggttgaaagcccaaacataaggcgagcacagataatttatttaacaaggctatggggttggtggggggctcggaaaaaaatcagcggcggaacctgctctcagccaccttgcaccaggacacaaacactgactcaaaaatgaaacgagtatcatctctaagtgaatgtgagtgccaagtagaaagctcgtatccgatttattatcaaaacgtctttgtaccattttaacatccattccaggaagaaaaaacctattgggaatatggttaatttgtaattaagtgctatttacccaaattaaagaaacaggtaacaaaaaattttaaaagccggcgaaatactatttaatttactcaggaacgctttagaactcttttagttggtgggtgggaatgcgggcggggaagcgcactaagccgaacgctggggcaaaggtttcctaaacagttaccgagaggtaactcccccttcatctgggacgtggctcaagattacaggtgatcgcggtgccccgaggcgccaggaggcaactttcacctgggggaggcgccgggcgccagcgggccaagcggccgggccgcggagcccacttcacttgggagctgccccaggccgggggtcgacaccgcgtcccctcccttagcctagctgcgacccagctttagggcctaagggcaaatcgagcgctcggtcctcccagcgccatgtgcgcggcccgcccaggcccttggccgccgtcgccgcgggggcaggccgcgagccagccgcgagccacagaggcctggtgcgcgctccgcccctgagcctgcagtcggggcggcctcagccagtgagccgggagtcgtccccttcgtcctccctcgcactcggagggcagctggggcggggcagaccctcgggccgggcggcacccgggcgggcgaatccgtcagctcccgcgggaggcccggcgagagaaggacccggtgagtagccacgtcacgctcctcagggaggccccgccccgtgctctcgggccgcccctcttcgccgtctccacgcctccgcgggcagttaccagctttggctgctcgcgcctccccaactcgggtaaagctcctcggcctcggcgtgctgcgcctccgcggctgccctgcgccaggtgagggctcgcggctcccggctgcggctcccggcgcgtggtggcgggctcggggcgtgcgtcgcggagaggacggggccggcgggcggttggcgctccgttcggtgcggggaggggcgtcacgccgggcgctgcgcggcctcggcgggcggcggcagcggcggccacggccgccgggctctcgggttgtctgtccccagttggagccggccggtgtcccggcggagagacgggcagtcgggttccctggcctcggggccaccccggctggggcggctggggcagagggacgatgtctactcgcgccccgatgcccgccgcccattctcgggaggatccgcccgcggtgactgctgagagggagtcgctgttggccgcggcgaaccggccggccgagcagccgcccccgcccgaatgtgagggcaaagaggcggcgagggaggagagggccgcggccgccactagcgctggggcgcggggagagccgtcgccggcgctggtgctgggacgcagcgtgccccaggcggctgtccccgtgaggcccctggcgctgcacctggcgcacaaggcgcgtgggcccgggggccctttcggcggggagccgccaccgccaccgccgccgccgtcgccgttgccgccgttgctgcgggatccgccggccgaggacgcccgggaagaggtggcagctggccctgcggaaaagcggcagccgccgctgctgccgcctaagggaaatccctggaccaaaaagcctccccagcacctgtccccagacacgacaggtccgccaccgcccccgctggaaaccctggaggcaggtctgtggttgctctgcgttgggcactggcagggtgcgggcaggggcgacttgcgggacttgccggcgcgtggcggcggtagcgggcaccaggcccgggtaacggcaggcctcccctccctgtcagtcggaggtaatttgttccaaggtgtcattcactctgcctatttacagacatgggcatctgggaagggagcggcaggaagaggtgggacctcaggttctccttgcctgatgggggcacggaggtggtagcttggcggcgcatccctgctggcgcggttgcgattgtgttttgtccccagtgttagtgacttgggaaagtagctaactttagatactgcagtgcttcgtatgggaaagttttggtagacttttttttttttttttttacataaaaggattgaagcaagtcagagcaaggggatttattcgtaagtggaagcgcgattgtagtcttttgtgaaataagatgaaaaaaggttttcaaaacactgctgagcagtcatattaaaaatgagactttaaatgtggtttttaaagtgctttatggggggaggggggagggatagcattaggagatatacctaatgttaaatgacgagttgatgggtgcagcacaccaacatggctgcacatgtatacatgtgtaacctgcacgttgtgcacatgtaccctaaaactttaagtataattaaaaaaaataaagtgctttaagttataagtgtgctggaaaataattgaaataggatagttgacatgcgagcgtggattgcacgttaggtaaatggttttctaacattgtcagctctccttccctttagaggagataagattatgccactatatttgaatgctgaccaatgctgtatggccgtcggtgctttattttgattgtagtaactgcaacttaagaaagtaaaaatgggccggcgcggtggctcacgcctgtaatcccagcactttgggaggccgaggcgggcggatcacctgaggtgaggagttcgagaccaggctggccaatatggcgaaaccccgtctctactagaaatacgatcattagccaggcgtggtggcgggcgcctgtaatctcacctacttgagaggctgaggcagggagaatcgcttgaacccgggaggtggaggttgcagtgagccgagatcgcgccactgcactccagcctggtcggcagagtgagacccactctcaaaaaaaaaaaaaaaaaaaaaaaaaaaaaagttaaaatggaaataaaaaccatgacaaaaagcagtatctggccgggcgcggtggctcacgcctgtaatcccagcactttgggaggccgaggcaggtggatcacctgaggtcaggagttcaagaccatcctgactaacatggagaaaccttgtctgtactataaatacaaaattaacctggcgtggtggcgcatgcctgtaatcccggctactggggaggctgaggcaggagaatcgcttgaacccgggaggcagaggttgcagtgagccgagatcgcgccactgcactccagcctgggcaacaggagcgaaactccgtctcaaaaaaaaacacaaaaaaacaaaaccgtatctttctaaattaagttgtaaatgacttgaactttttatatgcaaatgacagctgtttacttgcaagtcttcatttttatttaaaattaaaggttagcagcagaacaagaaatatttgagcgtgtttactggcttgtgaggatcaaatgcgatgaagaggtggtataaatgtaaggcgattggctgtgcgcggtggcacacgcctgtaatcccagcactttgggaggccgaggcgggtggatcacctgaggtcaggagttcgagatcagcctggccaacatggcgaaaccccgtctctactaaaaatacaaaaattagccggatatggtggtgcgtgcctgtaataccagctactcaggaggttgaggcaggagaatcgcttgaacccgggagacggaggttgcagtgagccaagactgagccactgtattccagcctgggtgacagagcaagactcagtctcaaaaaaaaaaaaaaaaaaagtacggtgattgttacaagcacccattatgttatgttaacatttcttcagaggaactctccaaagagggagatatgtgttgagttaattcattcatttgcctttgcacagaaatactcctcattaattgttgataaattttgacacttgcagaaaaaaagtttgctctggatttaatattggcataattccttcctcgctataaagagctgtttgtttactcctattactaactaaagagaacatggttaagtgaagacctcataaagtttttcttttttttcttttttaaagcccagtggcaagcactctaaaatttagcaaagaaagaaaaccctagtgaatcatcttatttgctgtttcacctctctacttctagacttacagacaattaagtgaattaccaagtaggaactctttgttgatcataaaaccagtatcatagattttaaaacttcgaagccatacatggtagtgtgtgcctgtagttttagctccctgggaggctgaggcaggaaaaatcagttttgcccaggagtttgaggctgtagtgtcctgtcatagtgcctgtgaatagccactgcattctagcctgggcaatatagcaagaccacgtttaaaataataatattaataataataataatgataatagaactttaaaaactgtcaaggtaagccttgggaactttaattgcaaatgacctgtgaaaaatatttaacagttaagctattggtgccttcattctccagtcttcactggagattaagaacactgtgatactagttgtatggtatggttcatggaaatttcagttttgctgttgtcttgtgtaggcaactctttctgtctttggatggaatccattctgcactggcaggaagaccatctttcagacctggcatagtgtagtaaccatggtctcttcccaacactgactctgcactgttctcccacaattaatttctttctttctttctttctttctttctttctttctttctttctttctttctttctttctttctctctctctctctctttcctttcttttcttttcttttcttttcttttcttttcttttcttttctttcttttttcaagagatggagtctctctgtgtttcccaggctggtcttgaactgctggcctcaggcgatcctcctgcttcccaaagtgcagggattacagacataatcaggctttctattttcttaagcaaatttacaacttcaggagtaaagaaacaggaccacagtctatttgcagttaaataacttaggtaacttagataaaagagattgtggtgtagaaacatactgttttgagagacttgggttctagtgcaggtattgttactaactggctagttgacttctggcaagatttctgggcattataaatgaataacatggatagactcatttcctctggttcataataccagagtgccacttataacctggctgccttggcttccatttatatatttatttaatattatttaattcatttaaataaatacattttacattagtttatttaaataggtagatagattgtcagtcttgctctattgcagtggtgagatcatagctcactgcagccttgacctcctggactcaagcaattcccctgccttggcatcccaagtagttgggatgacaggcacgcatgtcattccatggaattagccatgcccggctagttatttttaatttttttttgtagagacaggggccccctttgttgtccaggctggtcttgagctcttggggtcaagctatcctgcctcagcccccacaaagtgctgggactacaggtgtaagccaccctgcctggcggctttctattgtctattttctttctttcttctttttttttttttttttttttgttatattgagacagagtctcgctctgtcgcccaggctggagtgcagtggtgcaatctctgctcactgcaagctccgcctcccgggttcacactgttctcctgcctcaacctcctgagtagctgggactacaggcgcctgccaccatgcccggctgattttttgtattattttagtagagacgggatttcaccatcttagccaggatggtctcgatctgctgacctcgtgatccgccggcctcggcctcccaaagtgctaggattacaagcgtgagccactgcgcccggcctttttttttttttttttgagatggagtttcattcttgttgcccaggccggagtgcaatggtgtgatctctgctcaccgcaacctccacctcctgggttcccccgattctcctgcctcagccagccaagtagctgggataacaggcaagcggcaccatgcctggctaatttttatatttttagtacaggcagggtttctctatgttggtcaggctggtctcgacttcctgacctcaggtgatcctcccacctccacctcccaaagtgctgggatacaggtgtgaaccaccgtgcctggccgggctttctattttcttgccatttttttttttttttttgagacagagtcttgctctgtcacccaggcaggagtgcaatggcgcgatcttggctcactgcaaccccccacctcccaggttcgagcaattctcctgcctcagtctcctgagtagctgggactacaggcgcgcgcaaccatggttgcccggctaattatttttttttaatttttactagagatggggttttaccacgttggccaggctggtctcgagctcctgacctcagttgatgcgcccgcttcggcctcccaaagtgctgggattacaggggtgagccaccatggttgacctcaggctattttcttaagcaaatttgcaacttaagaagtaaagaaataggaccagaagttgtttaaagttcacagtgggtacctctaaatctattagttatctattagtgattgtataatttatactatataaattgtataattctacaaaacaggatgctctttgagagagagaattgtattgaaataacagacttaaatcaggtctatcctgctcaaacttggatttactgttactctgttaatgaggtaaaggaattccatccacagaattttgccaggaagtttattactacagttagaaacataggaaacacaggggagaatatttcaggacagaaattatgaattttctctacattacaacctgcacatctaagtgaaccagattcttgatgcctcggcccttgtgagaaattttcttccacttttaggatgattttgatcatgtgttgctgtttctagaaatccagatgaggcactcttcagccaaagttgctgcccacccaagaggccttttatcttgaaatttagtcatgagaccagaaggaacttctcccatctgtgtcctgacttggtattagttttattttggatacctcctttttttttttttctttttttgagatggcgccttgctctcgtcgctcaagctggagtgcaatggagcaatctcattgcaacctccatctcccgtgttcaagcgattcttctgcttcagccttccgagtagctaggattacaggcgctcgccaccatgcctgcataatttttgtttttgtttttgttttgagatggagtctcgctttgccacccaggctggactgcagtggcacaatctcggctcactgcaagctccgcctcccgggttcacgccattctcctgcctcagcctcccgagtagctgggactacaggcgcccgccaccttgcccggctaattttttgcatttttagtagagacggggtttcaccacgttagccaggatggtctcgatctcctgacctcgtgatccacccgcctcggcctcccaaagtgctgggattataggcgtgagccactgcgcccggccaataatttttgtatatttagtagagatggggtgtcaccatgttggccaggctgatcttgaattctggacctcagatgattgacccaccttggcctcccaaagtgatgggattgcagacatgagccaccacacccggcttttttttttttttaagagaccgagtctcactttgtcacccaggctagcgtaggagtacagtgacacaatcatagctcactgcagcctagaactcctgggcccaagggatcctcctgcctcagcttctcaagtagctaggactacaggcatgtgccaccatgcctggcaaattattttatttttgttttttaaatttaaaaatagagacagtatcttgccatgttgcctaggctggtctcagaactcttgaactcaagctatttttattttttttttgagacagggtctcactatattgcccaggcccagtcttgaattcttggcggcctcaaaggattccctgcctcagcctcccaaagtgctgctattacaggtgtgagcctggcctggcagattcctttttttccctcttttaaataatttattttaaacctattatatcacacagtatgttttatacactgacatataaccccctaacaagataaagcaaagacaaaaaagtttatcttattagaaggaagatacaccatcacttattctcttcaagcattattgcactttaacttttcttaacttgacaaagcattcatgaagcagtctgcagactagttttaacagataaataatacctgtaagcagacatgattgtcctaaattgtttattaggtatgaattttacaaactttacttatattggctgtaacggtggagctggagagtattgcgccttctccaagctccctggtgagaaccaccaatagtgtggtggcacttaaggccctttccaaggctatggctctttcggcctgcagatggcagcccatgcatcttcctatgcttgtggactggtttggtgatccattgggtgtcaggatttcttctgatagctttatggaatggatcaatgaggataacctcaaaaaacttgtatgtggaatcttcaccaacccagtgagaattcaggacttttagagccccacagtggcatccagcttgccgctttgcaatggactgaagactttgagcaaactttagctggttaacaccatgatggacaggcttgccataagttgcacccttaggaactgggtgctttcggccaccatggcgaacacgaatcctatatataacataaacttggttggccttgtagcccagctggtgcgctttatcaagccagatggggtggggagccctgtggagagcagagagctggtggtactgccagcaaccaactctcagaagaaagtgcattttctccatagctcctggatttacttgtatgcccccatcttggcttacctgatggctgctgctagacagaaggggcacggattcttttattaaaatcacaatatgggtttattaatcccttacttgtatttatggttgttttttgcctattaaacatcagcattctagtataatttccattcttttactcataacaatatgatgtttaaaaaatactgatttttttctgtcttttttattcttatttttctcgaaccctatgttcatcatcaacctcttttctcctactatttggttcatcaaccttattttctcctgtttggttcctagaaacctcaagtaagcttactgttgttaccctaatgaaataccattttaagtaagttatatagaaaaaatgcataaatatattctccttacaaaaatgaaaaactttgatgtcatcttaagataatttactgaggccgagcgcagtggctcacacccgtaatcccagcactttgggaggctgaggtgggcggatcatgaggtcgggaaatcgagaccatcctgtctaacacggtgaaaccctgtctctactaaaaatacaaaaaaaattagctgggcgtggtggcaggcacctgtagtcccagctacttgggaggctgaggcagcagaatggggtgaagccgggaggcggagcttgcagtgagcagagattgcaccactgcactccagcctgggtgacagagtgagactccgtctcaaaaaaaaaaagaagataatttactaaatctaaactccttttaaaaattgctgaggactgcccgggcacggtggctcatgcctgcaatccgagcactttgggaggctgaagtaggcagatcacctgaggtcaggagttcgagaccagcctggccaacatggtgaaaccctctctctactaaaaatacaaaaatcagctgagtgtggtggctggcacctgtaatcccagctacttgggaggctgaggtgggagaattgcttgaacccgggaggcggaggttgcactgagccaagatggtgccattgcatttcagcctgggcaacgagtgaaattccgtctcaaaaagaaaaaaggcttaggatgaccggctgtagtggctcatacctgtaatcctaacactctgggagaccaaggtgaccggggtttgaggacaggaatttgagatcagcctgggcaacatagtgaaaccctatctcaattaaaaaaaaaaatagctaaggagtggtcctaaatatggctgacatagttgatttagagatttacctgttgattatcttgatttttttcatttttgtatctagaagaaactgaacatttttatacatatgtcttatatccatgtgtgcctttctctagggtagatgctgagaagtagaattgttaggttatagggcattttttaagtttatgagtcactttttatttatttattttttaatgtttttatttttattttttattttttgagacagagtctcgctctgtcgcccaggctggagtgcagtggcgtgatcttggctcactgcaagctccacctcctgggttcatgccattctcctgccttagcctcctgagtagctgggactacaggcgcccgccaccacacccagctaattttttgtatttttaatggagacggagtttcactgtgttagccaggatggtctcgatctcctgacctcgtgatccgccacctcggcctcccaaagtgctgggattacaggcgtgagccaccgcactggcctttacaagttgctttttaaagtaactgtataaactgatactcccactattagagtttgagaattgtcttctttcacaattttttttttttttttttttgagacagtctcactctgtcgccaaggctggagggcagtggcactgtgtcggctcactgcaacctccgtctcctgggttcaagcaattcttctgcctcagcctcccgagtagctgggattacaggcgtctaccaccacgcccagttagtttttatatttttagtagagatggggtttcaccatgttggccaggctggtcttgaactcctgacctcaggtgatccacctgcctcagcctcccaaagtgctgggattacaggcatgagccaccgcgcctggccattctttcacattttaaaaagcactaatttttaccacattttcccttaaatatgataagatgtgaaatattgatatcatcagtgcattttcttaattaaaattttgccaaaagattatggtcataagaattaagctgagtgaaataggctctgctgtgttgtagcttttgtttaaagtatcctagcccttaaaaatatattattttctttaactatttacagttatttccttgtaggtcccagggtttaaggataacgttttattatttatttatttttactttatttatttatttgagatggagtctcgctctgttcctcaggctggagtgtggtggtgcgatctcggctcactgcaacctctacctcctgggttcaagcgattctcgtgcctcagcctccagagtagctaggataacaggcacccgctgctatgcctggctaatttttgtgttttttagtagagacggggttttgccatgttggccaggctgctctcaaactcctgacctcaggtaatctgcctgcgttggcctcccaaagtggtgggattataggcgtgagccactgtgcccggcctaagagtaacattttaaagatagtgaaataatgctcaaaaaagatgtactggtatatagtgtctgtcttactaatgatgtttgaaaaatggagatatgttttaaatttttaaatttaaaacaatttcctcaactggcttgctatttcagtcttaggtgttctctaatgacatgcagcatgatttcctccatgttaaaacatgagaaaatgaaaaatttcctttcttaggcttcttttacttgtaatctgtacgtatatataatttttttttttttaatcagagtctcactctgttgcccaggctggagtgcagtggtgcagtctcggctcactgcaactttcacctcctggattcaagtgattctcctgcctcagcctcctaagtagctgggattacaggcatgcgccaccacacctggttaatttttgtttttttagtagagatggggtttcgtcattttggccaggctggtcttgaactcctggcctcaagagatctgcctgccttggcctcccaaagctgtttggattacaggtgtgagccactgagcctggcctgtatatataaaattatatttaaaacctggtggacttctttccatgtcaatacatatacagctttgtctgatttctaaaagttatatagtattctgtgtattattacgtagagactgtttaaataggattatcaacaaagttgcactgaacatcctatatggacatctttgtaccttttcttgattcctagataatttcctgaaaatggaattcttttattaaaagttatatacattttagatgacagattacccttgaaagatatactaccttggctgggcgccgtggctcatgcctgtaatcctggcactttgggaggccgaggtgggcggattacttgaggtcaggagtttgagaccagcctggctaaaatggtgaaaccctgtctctcctaaaaatacaaaaaaattagccaggcatggtggcaggcgcctgtaatcccagctgcttgggaggctgaggcaggagaatggcttgaaccccggagggggaggttgcagtgagccaagattgcgccactgcactccagcctgggcgacagagtgagaagattccgtctcaaaaaaaaaaaaaaaaaaaaaaaaaaaaagaaagaaagaaagaaatactacctcatactcttaccaacagcaaacagcatgagagaaataaagagactctgtctcaaaaaaaaaaaagttgtatttgtaattttctcctgttatattgttgtcgtttttttttttttttttttttttttttttttttttttggacagagtctagctctgtcgccccagctggagtgcagtggtgcaatctaggctcactgcaacctccacctcccaggttcaagcgattctcctgcctcagccttctgagtagctgggactatgggcatgtgctaccacactgggctaatttttctatttttagtagagatggggtttcaccatgttggccaggctggtctcaaactcctgactccagtgatccgcccatcttggcctcccgaagtgctgggattacaggtgtgagccaccaggcccagcctatattctgttaatgagaggattgttctgtcagttcagtgtaatacgctgtgtttttttttgttttttgtggtggagttttgctcttgttgcccaggctggagtggaatggcaagatctcagcttaccgcatcctctgcctcccaggttcaagcgattctcctgcctcagcctcctgagtatctgggattacaggcatgtgccactgtgcccggctgattttgtatttttagtagagacggggtttctccatgttggtcaggccggtctcgaactcctgacctcaggtgatccacccacctcggcctcccaaagtgctgggattacaggcgtgagccaccccgcccggcaacactgttaatatttcttacttcttgatttggagactgaagatcaccttgaatctatgtgtcaaatggggttgattttttgctaggaatttaagtctcagaaccttggattttggttggaaatgatgattatactgatttactgaaattgacataatagttattttgttgaatttattgaatgaagtagttgtaaaaacaattctatatattttctttagaattcggttccctcaaaattataaaggcaggaaagctcaagacaaagaaatccaacaaggtatgtcttcataggaaatagttcttaactgtattgatttttgaaaattgaggctaagaactcttaggttattataagtgtatttttcttctaattgtattattggtattagattaaagttaatattatggaaaatcataacctttatccaaatctctatatatgcctttgttatcatgtataactcaatttaatgttattaaatagtggtgaaagttttatcataagattaagccattcttatttcaaaatgttctattgtttgcagaaactttttgattaatttggcagatgcctgcatataactgaatataaatgattatttaaaactcctttcacttttagaaaatgtttttttcctgcttaaaatttctaaaagtaatttcagacctaacacttatttgttacttcttaggctagtgatttcagtgatatggagaattggccaacaccaagtgaattagtgaacactggagtgagtattgttttaaagtttttttttttaaagaaaggaaaatgtattcatttcgacatgcagaattttattttacttaaaatgtaaagaattgtcatactgggggacagattttttttatttttttgagacagggtcttgctctgtctccaggctggagtgcagtggtgtgatcacagctcattgtagcctcaaactgctaggctcaggtgatcttcctacctcgacctccagagtagctgggactacaggcacgcaccactgtgcacagctaatttttgtatttttcatagagacaggattttgctggtctccaactcctgagctcaagtgatcctcctgcctcagcctcccaaaatgttgagattacagtatgagctaccattctggctgaggaacagatttaaaaacttgattcatcaagaagattacattttgttactttaatttgcagttattcttcgatgctgccagtaacattggtaatgaacttgttgtcttaagctttactcatgggaagcttaacctaacctattatttctttctttcttttctttttttttttttcctttgagatagggtctcactccattacccaggctggagtgcagtgatgtgatcacagctcactgcagccttggccttccaggctcaggtgatcctccacctttgcctcccaagtgactgggactacaggtgtgtgccaccacactgggagatttttaaactttttgtagagatgggggtttggtcatgttgcccaggctggtatcaaactcctgagctcaagcaattggctcgcctcagcctcccaaagtgctgggattataggcgttagccaccatacctcgcctattatttctttaataatgaagacatattataaattgtaatcaaatttttatatttgtataaaatcacatacattgataaagaggtgctgaaaacgtggcagctatccttttgatagtttacccgcttttcagataacctaatttaattcatcacatttccctcatctggttatattctttttttgagacagagtcttggtctgtcgcccaggctggagtacagtggtgggatttcagctcactgcaacctccgcctcccgggtttaagtgattctcctgcctcagcctcctgagtagctggtattacaggcacgcaccaccacatctggctaatttttgtatttttagtagagacagggtttcgccatgttggtctcgaactcctgacctcaggtgatccacccaccttggcctcccaaagtgctgggattacaggcgtgagccactgcgcccagcctcatctcgttgtattcttaagaggtaatcttatatttgagatttgcattttctagaattttatatatgtggaagcattgagtaggtactcttttttttcctggcttgtactcagcattattttgagatttacttgtgtgtcagcagttcattcttttttcttactgagtagtatggatgtaacacagtttgtccattcacctattgttaatggacatttggattaattttacgttttggttgatacaaataaaactgctatatgaacgtttgtgtagaaaatttttcattttttcttggatatgtaactaggttggatcacttagtagctacctgttttagctttttaagaaactgctgagtttgcacttctatcagcagtgtacatgaattccagttactccacatcttcactcactctcttttttgtgtgtgtgtgtgagaccgggtctcactttgtcacccaggctggagtacagtggcatgatctcagctcattgcagtcttgacctcctgggctcaagtgacccccccacctcagccccataagtagctgcgactataggcatgcaccaccacgcctggctaatttttttgtattttttgtagagatggggtttcgtcatgtgcccaggctggtctcaaactcctgagctcaagtgatctacctgccttggcttcccaaagtgctaggattacaggtgtgagccaccgaacccatctttactcaccgataatatggtcaagtttcaaaaaatattttagccattctaataaatgaggagtggtatcccattgcagttttaatttgcatttttctgatgaatgaatgcaataatcttttcatagatttgccatcagtgtatctttttgatgaagtatgtgatcaatctgcccatttaaaaaaatggaaggctgggtgcaatgggtcatgcgtgtatcgcagcactttgggaggctgaggacggtgaatcatttggggttaggagttcgagaccagcctgaccaacatggcgaaaccccctctctacttaaaaaaaaaaaagagttagccaggtgtggtgacatgtgcctgtaataccagctactagggaggctgaggcaggataattgcttgaacccaggaggtggaggctgcagtgagccgagatcgtgccactgcactccagcctgggcaacaaagtgagactctgtcctcccgcccccgcccctgcaaaaaaaaaaagtggtattgatttgttgttactgagttttgaaagttcatatgtatttgaggtaaaagttctttatcaaatacttagcaaatactttctcctagtctgcagctttacttttaactgtcttttgaaaagtaattttttgcctttgataacagtttttgtcatttgttttgcaattttaggttaggtatattgccacaaatttttgggtatgttagtgaaaatattaatggaaatcatttcattctgaaaacctttttgcagtttcagagcgtcctcagccaaggaaataaaaagccacaaaatagaaaagaaaaagaagagaaggttgaaaagagaagtaacagtgacagcaaagaaaaccgggaaacaaaattaaatggtcctggtgaaaacgtcagtgaggatgaggctcagtcaagtaatcaacgtaagagaggtcagtttgtccatatctttattttgattttagtttttgaagaaagttgtaatgaggaattacatttcattaactgatctctggtagtcaaaaatgtatagtttgtatttcttcaggataaacaatctgcagaggtaactcatttgcttttgtaacatttctgaactattagactttcctttttgtatgtaacttgtattctatgcaagaaaatggaatggagttccacttagaggtacagttgtagatacattcttggaaagttgtgtgataattattgttcttttagatctgcattggaactgctccctatatttagggagtactgtgaaaattaaatacatttttttcctaagagaaaagtgagaataggctgggcgcagtggctcacacctgtaatcctagcactctgggaggctgaggcaggcggaccacttgaggtcaggagacatggtgaaaccctgtctccactaaaaatacacaaaaaaattagccgaacatcgtgttgcgcacttgtagtcccagctactcgggaggctgaggcaggagaattgcttgaacccaggaggtggaggttgcagtgagccgaggtcgcgccattgcactccagcctgggcggcagtgcaagactgtctcaaaaaaaaaaaaaagtgagaataattttagtcaatcttttccctcatagcattcccctgtcaaaattacactttgaaggaatgaaaatattgtcttcatatccttttccattttcttttctgaacttttcgtgtgtctagggacagtttatgatttacatgctttgtaaatcagtgctcggagtcttcgtaaaagtgtcttcaggcgcttctaggcagaaaagggctttaaactgttaagttgtcagtgactgaagcaaggtgattttctgggagagtagcaggaggtgaggttagagacatagatagacaacgtccatggtatacagggccttggagttatgattccattttgaataccatgggaaaccattgaaccaagattctctggaggtgatatggcatgggagggaacatttaatggtaaagttgttgccaacttctttaacactttaacttttaccgtagactgatcacttacttgaatagtttgtcttttttttttttttttttaagagacagagtcttgctctgtcacccaggctggagtgcagtggcccagtcttgactcactgcaacctctgcctcccgggttctaggaattcttctgcctcagcctcctgagtagctgggattacaggcccatgctaccatgcccagctaactttttgtattttagtagagacggggtttcactgtgttgcccaggctggtcttgaaatcctgagctcaggcgatccacctgcctcggcctcccaaagtgctaggattacaggcatgagccaccgggcctggccgaatagtttgtctttttaataaataactaatccttagtgcaggatgagcattatattcacttgatacaatgaataaaggctaattgctcaaaaacagtgacaacaagacaaacaagtggttgttagaaaaatttcttcctgtttctttttttttaatttttaaatttaaaaatgtttttaaaattttgaaacagggtcttgctctgtcacccaggctggagttcagtggcatgctcgtggcccactgcagcctcgatgacctgggctcaagtgatcctcccacctcagcctcctgagtagctgggactacaggcatgtgccaccatgcctggctaatttttgtatttttttgtagagacagggttttgccatgttggccaggctggtcttgaactcctgggctcaagcgatccatctgcctcagcctcccaaagtgctgggattagaagtgtgcgccaccatgcctggcctcctcatttcttaactacttcgtcacttaactgttccctgcttcctacatacgtaagtagtgttcttgactgtctagaatccatacagatgacagatttgttatcctgatctaaaatttgtctttttttttttttttgagatggagtttcgctcttgttgccacgctggagtgcaatggcgcgatctccagctcactgcaacctctgcctcctgggttgaagcgattctcctgcctcagcctcccaagcagctgggattacaggcaccacacccagctaattttgtattttttttttttagtagagacgggtttctccatgttggtcagggtggtctcgagctcccaacctcaggtgatctgcccgccttggcttcccaaagtgctgggattacaggcgtgagccaccacgcctggcaatttgtctttaattgcttcaattaaaactggtcagtcaacagtaaaacccaggtgttttgtagttagaacaattggtataatcaagcttttaattgatctagagtacagatttttgactttaaaagaagggcttctttgtgtcaaggaatctcgttgacataatttatagtataagattaaaagcctttttagatgcatttatattcacttttcctcatttgatccatagtttgcaggatttataggatatcaatattgtagttgcacactaatatttatttttaaattgccttggcagttttttcattgccatgagtctttattttggtagaaaatttagattgggcagaatactgaacattttgaaacctgagctatggcattcatgaatagatgatcttcagaatttcactatagaataaccataaataattagttacattgtcatttagtcatcaagaaaagttaaactgcttgtgtttttttttccttaggaagatgcataatagctgtaaaatgttctgtcaagttaaacaaattttatacttatccctcttccctcttatattttgagaaacctcattcatttgtaaaaatcctgggtaaattaatattttaggcagtgatgtggaactaaaagtgctgcaaacctaaagcctaactttccaaagtatacattatagcgttttatcagatatatcccattctaaagcctaagaattttaaattaaacagatttttttttaaaaaagcctaagaatcaagtactaaacaggaatgttatgtatatatacttttttttttttttttttgagacagactctcgtctctgtcacccaggctagagtgcagtggcacgatctcggctcactgcaacctctgcctcccgggtttaaggaattctcctgtctcagcttcccgagtagctgggactacaggcatgtgccaccatgcctggctgatttttgtatttttagtagagatggggtttcaccatgtttgccaggctggttttgaactcctgaccttaggttatctgcccgcttcagcctcccaaagtgctaggattacaggcatgagccactgcgcccggccttttttttttttttttttttgagatatagatattggactgttaattgtcattgaagtattttggtctgaggtaggcttatgcagaggagaatgttttcatgttacttatattaacattgtttcttctacgaaatgacagattggtccaatgtgatgtaaggagttcagttgtgtgtttgggatttttgggcggctgggcgtcgagcttgaacgctttgatggctgcttttaggccaactatggggattgtactttttactctctttacaaggttttttcctagtgtctaaagagctgtccttctttagactaacagttaaatttacaaggggattgggggttctgtaggcaaatttaaagttgaactaagattctatcttggacaaccagctatcacccaggctggagtgcaatggcacgatctcggctcactgcaagctccgcttcccaggctcaagctattctcgtgcctcagcctcccgagtagctgggattactggcgtgtgccaccacacctggctaatttttgtgttttttagtagagacagggtttctccatgttggtcaggctggtcttgaactcctggcctcaagtcatccgcccaccgcggcctcccaaagtgctgggattacaggcatgagccaccgtgtctggcctctttacaaataatcttaaaatacacattaagtgtttcacttatttgattaaagttcagagtgctttcaaattgcaagggtttagtgaaaattgtacatttgtccttaaatgattttgttttcttcaagctaataagcacaagtgggtaccactccacttagatgttgtaagatcagagagtcaagaaagacctggatcccggaacagctcaagatgtcaacctgaagcaaataaaccaacacataacaataggagaaatgatacacgaagtaagttaccattctaagacaaaaatgactaaggaaagacttagtcttaatgctcgttattttagtaaccacatgtataaaccatttgagaataagttgaagacatcatgtccctttaaccccaaataccttcagggtatatttcataagaacaatataaccgtaatgcaattaacaacaatgaaacttaacattaatacaatgtgattgtccacaggcagatttttctcaataaagtcctttatagtcgtcccctcccctgctccaaggatccattctgggatcacccatttaatttaattttttttttctctttaggctccattaatctgtaacagttcttgcttttgtctttcatgacattgatttttttgaagattgtaggataatcgtattgtagatatcccttactttgggttttctaatgtttccttatgattggattggggttgtgaatttttggcaggagtactgtataagaaaatatatcattttcttctttttttttttttttaatttttattttttttattgatcattcttgggtgtttctcgcagagggggatttggcagggtcataggacaatagtggagggaaggtcggcagataaacaagtgaacaaaggtctctggttttcctaggcagaggaccctgcggccttccgcagtgtttgtgtccctgggtacttgagattagggagtggtgatgattcttaacgagcatgctgccttcaagcatctgtttaacaaaacacatcttgcaccgcccttaatccatttaaccctgagtggacacagcacatgtttcagagagcacagggttgggggtaaggtcatagatcaacaggatcccaaggcagaagaatttatcttagtacagaacaaaatgaaaagtctcccatgtctactactttccacacagacacggcaaccatccgatttctcaatcttttccccacctttcccccctttctattccacaaaaccgccattgtcatcctggcccgttctcaatgagctgttgggtacacctcccagacggggtggtggccgggcagaggggctcctcacctcccagtaggggcggctgggcagaggcgcccctcacctcccggacggggcggctggccgggcagggggctgaccccccccacctccctcccggacggagaggctggccaggcagaggggcgcctcacttcccagtaggggcggccgggcagaggcgcccctcacctcccggacggggcggctggcgggcagggggctgacccccccacctccctcccagacggggcggctggccgggcggggtgctgacccccccacctccctcccggacggggcggctggccaggtgggggggctgagcccccccacctccctcccggacagggtggctggcccggcagaggggctcctcacttcccagtaggggcggctgggcagaggcgcccctcacctcctggacggggcggctggccgggcggggggctgacccccccacctccctcccggacggggcggctgccgggcggagacgctcctcacttcccagacggggtggctgccgggcagaggggctcctcacttctcagacggggcggctgccgggtggaggggctcctcacttctcagacggggcggttgctgggcggagggtctcctcacttctcagacggggtggctgggcagaggtgctccccacatctcagacgatgggcggccgggcagagacgctcctcacttcccagatgggatggttgccgggaagaggcgctcctcacttcctagatgggatggcggccggcagagacgcttctcactttccagactgggcagccaggcagaggggctcctcacgtcccagacaatgggcggccaggcagagatgctcctcacttcccagacggggtggcggccgggcagaggctgcaatctcggcactttgggaggccaaggcaggcggctgggagatggaggttgtagcgagctgagatcacgccactgcactccagcctgggcaccattgagcactgagtgaaccagactccgtctgcaatcccggcacctccgggaggccgaggctggcggatcactcgcggttaggagctggagaccagcccggccagcacagcgaaaccccgtctccaccaaaaaagtacgaaaaccagtcaggcgtggtggcgcgcgcctgcaatcgcaggcactcggcaggctgaggcaggagaatcaggcagggaggttgcagtgagccgagatggcagcagtacagtccagcttcggctcggcatcagagggagaccgagagggagaggggagaggggagggggagagggagagggagagggagagcggaatttattctatcattttcttcttagcgaatcacatgggagtatgaccttgatttgtcccattattgaagatactaactttgattacccctgtaactttgattattagtttgattacaacattgattaatattaactttgattacccctgtaactttatttgattattagtttgattacaacattgattattattattattatttgttttttgtttgagatggagtctcgttctgttgcccaggttggagtgcagtggcgtgtgatctgggctcactgcaacctctgcctcccgggttcaagcaattcttctgtttcagcctcccaagtagctgggactacaggcacatgccaccacacccggctaatttttaaatttttagtagagatggggtttcaccatattggtcaggctgggctcgaactcttgacctcaggtgatccacccacctcgatgtcccaaagtgctgggttataggcttgagccactgcgactggccacaatgattattaaccttgattacttggttgaggtagtgtactctagacttttaaaaaatttttaagtttcttcagcttttttgtttaatttcttttctccctttgtaattactgtgtaatttgtggagagaggctttgagactgtggagataataattttctcagacttttcaaacaagccttagcttccttttttttttttttttttttttttaaataagtgatggggtctcattctgttgcccaggctggagtgcagtgggacagtcatagctcactgcagtcttgaactcttgggctcaagcgatcctcccacctcagcttcccaagtagctatgatgacaggtgcgtgccaccatgcccggctaattaaaaaaaaagttttctttagagacagtcttgcttcgttgcccgggctggtcttgaactcctagcctcaagcgattctcctgcctcggcctcccgaagtgttgggattacaagcatgagccaccgcacttagcttctccctctttattgccaaataatattctgttgaatgcatatagccctttgtcttttcatctgttgatggataagtggcttgtttatagtttttggtcttcatgaataacgctgatgaatagttgtttacaagtctttgtgtggaatgtatgtatttctcaaatgcctgtgagtgaattgattggtcatatagtagctgtatatttaacattataagaaactgctacttgtagcattttacatttccatcagcaactttttttctttttgctatgtgttaagtcccatgtctagtggaattcctgtattttggatttggctgattgctttgtcatggtattcttttttttttttttttttttttgagactgagtctcgctctgtcgcccaggctggagtgcagtggcgcgatctcggctcgctgcaagttccgcctccctggttcacgccattcacccactgagtagctgggactacaagcacctgccagcacgcccggctattttttttgtagtttttagtagagagggagtttcaccacattagccaggatggtcttgatctcctgacctcatgatccaccctctttggcctcccaaagtgctaggattacaggcgtgagccacctcgcccagccgctttgtcatagtattctttggcatttgcatgttcctttttttgagacagggtctcactctgtcttccaggctaagtgcaatggcatgatctcggctcactgcaaccttcacttcctaggctcaagcgattctcctgtcttagcctcctcagtagctgggactacaggcatgcacaacagtacctggctaattttgtatttttttgtagagatggggtttccccatgttgcccaggctggtctcaaactcttgggcccaagcgatcttccagcatcagcctcccaaagtgctgggattagaggtgtgagagccactgtacctggcctgcctgttccttttgtcttttctttttataactggcaataagaaggagctaggttgattagattcaggcttatttttttgcttggaatactgctgtgtgtatttcactttcagttgtgttaatattgagttagctcaggtgttaggttgatcagtccattataaattattccattagtctttttttttgagacaaagcctcactctgtcacccaggctggagtgcagtggcgcgattttggctcactgccttccaaagtgctgggattacaggtatgagccactgcaccctggcccattagtctttactgaatggttttactttcattaaaatcattggccagatactttttttttgtcttgagacagagtctcgcactattgcccaggctgggttctcctgcctcagcctcccgagtagctgggattacagacatgggccaccatgtctggctaatttttgtggttttagtagaggcagggtttcaccattttgggccaggctggtcacgaactcctgacctcaagtgatctgcctcccttggcctcccaaagtgctaggattacaggtgcgatccaccgcatccggcccagatacattttttcacagggattgctcagattttcagaaagcagaggataggatatgtggaaacaataggatgagcatttgtttttatagttttctgctgaaatctgataagtcatgtcctgtgaatggataagaaggcctaaggaaattttacagacttaatattagcattcaaaaattttaaatatacctatgtagaggtaaatgtattttgattaaaaaaatttccaatatattatgaaaaactttaaacatacaaaaaattgaaagaattgttcagtgaatacctgtctagccaccatctagattaataatttctctgtatttaattcattcatctgctgaatcccttgaaagtaacttggagatgttgacgctttatcactaatgtcctaagaaaatgcatcatctaagaaaatcacactagtttcctagtaccatctaaaatctagtcaatagttaatttttctcaattgtccacaaaatatgacttttaaattataaaactttagctaaatgcagtggtgcaagcctgtagtcccagctacttgggaggttgaggcaggaggattgcttgagcctgcgaatttggggctgtagtgcacaatgatcatacatgtgtgggggggagcatatatatatatatgcatatgtataaaacttgtctatagaaaaattgactttttttctattgtttttcaaaatgtcattttaagtttttattctaaaagtaatggattctcataatttcattaatttttttcttattaaatattgaatatataagaaaatagacaaagttatacagaacaacaatataatgagctgagtatggtggcactcacctgtagtcccagctacttggtaggctgaggtaaggaggattgcttgagagcccaagagttccaggctgcagtgagctatgatcatgccactgcagcctgggtgacagagtgagaccccatctctaaaatcaataataatgatgatgatgatgatgaacagtggaaactcaccctgtttaagaaatgtatgttactattacttttaaacttcgctttgtgcactctgcaatttcatcccattgtctcggaaaaaatgagcttaagtgcattggtttctttcatgttttgaaatcgccatgcaatgtgactttatcaacattctttggcaggaatttttgtttttttaattcagcctacttttctttagattaatgcatgttggttgtattactgtaagtcttttcctgctgaaaggctgtttcactatttgataaaatctgtactaacggtgggtatttggattgtttccagtttttttgatattaaggtactaccacgaacattttaatgcatgttttccagcacacaagtacaagaggctctctatggtaattttttcagactgcagactacactctgtgagtgggttatgaaatcagtatattggttcatgatcaggtttttaaaaacctagagtgcttcacatagtaaatttttaaatgatatgtgtttataaaattttttgtaagtgtacttgtatgtaaaataaataaggcttacttacagattaaggcagaaatgtttgaaaaagtggctggacgcagtggtgcacacctgtaatcccaacactttgggagcgggaggtggcttgatctgggagggggaggtgggtggatcgcttgagctcaggagtttgagaccagcctgggcaacatagtgagaactcatctctgttaaaaaaaaggaaatgtttgaaaaagactgttttaggtctaagcattgaggatggaactatgggatctagggtaatgttctcagtgagggtgatttttttttccccaaagagtcatttggcattgtctggagatatttgttactggttgtcacaactgagggagtgagtgggtgctactggcatctagtgggtggtggtcatggatgatgccaaacatcctgtagtccacagaacaggcccccacaccagagtctaaagtgctaaggttgtaaaaccttgtctctaggatttgcatatcttcacattaattagattattccaagttgattttcaaagtagatatacctattttcaacctcattagcaatatatgaatgttctacctgttttttgagacagaatctcactctgttacctaggctagagtgcagtggcgaggtctcggctcactgcaacctctgcctcccaggttcaggtgattctcctgccctagcctcccgagtagctgggattaccggcgcccaccactatgtctggctaatttttgtatttttagtagagatggggttttgccatgtcggccaggctggtctcgaactcctgacctcaagtgatccacccacctcagcctcccaaagtgctgggattacaggtgtgagccaccgcacccggctaatgttctacctttttaaactttgtcaacatttcatattagagacattaaaatatttgttgtactggggtaaagagcctttcattgtcttaatttgcatttcttacagtccataaggctgaacactgttttcgtttttcttttttttttattctgagacggagtcttgttctatgcccaggctggagtgcagtggcagggtcttggctcactgcaacctccgcctcccaggttcaaacaatttttctgcctcagcctactgagtagctgggattacaggcactccaccaccacgcctggctaattttttgtatttttggtagaggcagggtttcgccatgtttcccaggctggtcttgaactcctgagttcaagcaatttgcctgtctcagcctaccaaagtgctggtattacaagtgtgagccaccacaccgggcctctttttttttttttttggagagggaatctcgctctgtagcccaggctggagtgcagtggtgcaatcttggctcaatgcaacccctgcctcccgagttcaagtgattctcctccttcagcctcccgagtagctgggattacaggtgtgtgctatggcacccggataatttttgtatttttagtagaggcggtatttcagtatgtcagccaggctggtctccagcttctgacctcagttgatccgccccccttggcctcccaaagtgctgggattgccggcctgagccaccgcgcccggccttgtatgattattgacccattggtaggcaccgttttctgtatttattgtccacttgcatttttttaccttgcttgtattttagatatttttcccattgagtggttgtgtctgtgtgtgttgcatgagagagagtcgtatgagttcttacatgtactctagatagaatttctatatttcgcttcagatatcttttctcaatttgttttgtgttttcatttcctttttactttataaggaatgtcatttacttaaatagaaccatccttaaatatttcgtgagaaatgttttttagcagttttatgtagtacaaacttagtagtcttggaacttcttgaatctttaacagcacaatcttaataaaactatctctttacctttctagtatgttattttacttgttagaatgtattcttcatgtgtcagtaccttttaggctctgttttatgctagagatatttttgataaattcttattggatctcttcagtttgtatccatctgaaaaatgcctggctactgttcattagttacaaagtggaagaaggtggctattatgttttcataaagacaatcatgttattttacttggcaaatcgaagtatataaaaatatttttatttttaaaaggttggaagcgagatagagaaaaaagggatgatcaagatgacgtttccagtgtgagaagtgagggtggtaatatccgaggttcctttagaggtcgaggaagaggccgaggacggggaagaggacgaggcagaggaaatcctcgatgtatgacataatttttgtttcgttaaattagataaactttgaaaaaaatagagcaactatcctctattatgttttaactaattttctttgtctgataatagatggttttatgtttgttaacctttgaagttcttcactttatccgtagtaactatttttttctaatatgtgattacctttctttttctttattcacatcaagtgaactttgattattcatatggttatcaagaacatggtgaaaggactgatcaaccatttcaaacagaacttaataccagtatgatgtattactatgatgatggtacaggtgtacaggtgtatcctgtggaagaagcattgcttaaagagtatattaagcgtcaaatgtaagtggatgtttgatgtaagcagacgggatagcaaaatctgttgcaatatgaactttaatgtcattgataatgaatatgctataatttttttttttttttgagacagagtctcactctgttgcccaggctggagtgtagtggtacgatcttggctcactgcaacctctgcctcctgggttcaagtgattgttccgcctcagcctcctgggtagttgggattacaggcacatgccaccacacctggctaatttttgtagttctggtagagaacgggttttgccatgttgaccaggctggtattgaactcccggcctcagctgatctgcccaccttggcctctcaaagtgctgggattataggcgtgagccaccatgcctggctgtttataacatttttaaagctacttatttgtaaaggttggaaaatgttaaaaattattttgattatatatttttagggaatgtgattaaagtaggtgtttttaaaattttatatttggtttatgttgtttatataagtctcctggcttctatagtatttagatatttttctccttaaaggagattaggtaaaatgttattgcataatatgaataaatataagactgtaaagcttctctatatatacttgaaactgaacaagtaaaatttggcttattatttgccaataggtgtttatattagaatttgcaaattaacataaataaaaaatggtggtatcttttgattttcttcttagcaattgacttctgaattcttaagttttttttatcttctaagtttttctttgtgacacaattaaatggggactaccttatattttagttcagatttcttactctagttctcatagtagttgctttctgggtactgaatgtgaagtcaggagaatattagttctattttctgaaagaaaaaacaaaccctatgcatattagtattgtataggatattttgcttatttatatagtatgtttttatagaggcaagagaaaaatgttgccaagtaatttgcataaccaatttgttaaaacttgaaatttttctctccttacaaggtgaaggaaaagggctatttttgaaagggcataggcatttaaaaatcatctgtttttccaaaataaaatagactctactctgttactagaaaatttctttatcatcatcagccaggcaccttcctgggttgccttcatggtggatccaatttgcttacagtgtggagcaacttgtttatattgttcttgcttcttttgttacagttgatgcaaacactgaagaaaagggcctttttgtgggcagaaagtgcttgacatgtggctgtcaacttcataccactattactgtcttttttgtaacttttgctgccaagtcccttctgagacctgacagtggacatgcaactccatgtcaggataatcggcctccagtgtgctcatacaagtgagggaggagcagagctacttcagtgttgacaaaatttctgatcatgcagtgtagaatccagagcctctaaggtaggacttgatgatgtccctaggacactgagcaaaatgtcagacatggcattggtcatgcctctttttttgttgttgttctagcagtagggattttggcaaatgttagtagagcactaggtttagtgtggcttgttattattattaccattctttgattagtggagatgtggctttgaaggagtcgtgctttttactttgtattatttggtttctaatatatagataggctgattgattgaggttttgattttctttttgagaagtcactaaaagttttcctggccaggtgcggtggctcacgcctgtaatcctagcactttgggaggccgaggcgggcggatcacgaggtcaggagatcgagaccatcttggctaacacagtgaaaccccgtctctactaaaaatacaaaaaattagccgggcgcggtggcgggcgcctgtagtcccagctactctggaggctgaggcaggagaatggtgtgaacctgggaggcagagcgtgcagtgagccgagatagtgccactgcagtccggcctgggcaaaagagccagactctgtctcaaaaaagaaagaaaaaaaaatgttttcctgacacctgtggaaaaatgatgcaaaatgtatcgtacagtatgaggcctaaacgtattcaaaatggttgaggggttttttttaaacttttttttttttttttttgaaatggagttttgctctcgttgtgcaggctggagtgcaatggcacgatctcggctcactgcaacgtccgcctcccaggttcaagcaattctcctgcctcagcctcccgagtggctgtgattacaggcatatgccaccacgcccagctaatttttgtagttttagtagagacggggtttcatcttgttggtcaggctggtctcaaactcctgtcctcaggtgatccacccacatcagcttcccagagtgctgggattacaggcgtgaaccaccgtgcctgacctttttttttttaaaaacattttaaaaactttttattgcagtctacttttttttaactttttaaaaatttttttgagatgctaatttttgtatttttattagagacaaggtttcaccacgttggtcaggctggtctcgaactcctgaccttgtgatccgccgtcctcggcctcccaaagtgctgggattacaggcgtgagccaccacacctggcctacttgtttttaacattttaagtgaaaacttgtattaattgtttgtgatgtcagcattaaaatgtaaagatcttgattatttctagctgtgataatctctcttggcactcagatgacagcactctgatagatttgtagatctttagaggttttttccttttttctttttctttttcttttttttttttttttttgagacattgtctcactctgtcgcccaggatggagtacagtggcgcaatctcggctcacctcaacctctgcctcccgggttcaagttcaagcaattctcctgccttagcctctcgaatagctgggattagaggcacgtgacactgcgcccagctaatttttgtatttttagtagagacagggttttgccatgttgccccatctggtctcgaatgcctgagctcaaagtgcctggccaggacagtttgttattgatttagggaagttcacatctcacagctaagaacagttgtaacttgtgactaaattaaatgtcttaatgtctgaaattttagaattttttttttcttttgaaatggagttttgctgttgtcacccaggctgcagtgcaatggtgcaatcttggctcactgcaacctccgcctcccgagtccaagcgattctcctgcctcagcctccccagtagctgggattacaggcacgcaacaccatggccgactaattttgtatttttagtaaagtcggggttccaccatgttggtcaggctggtctcggattcctgacctcaggtgatctgcctgccatggcctctcaaagtgtggaaatgacagacgtgagccaccgtgccctgcatgaaattttagaattttaacacatgtattatgtatctgccacatgccagacactatgaataaggcttttgaggtgtaacaaccatcagaatcttcattgctttaagacttcagtgtttaaaattttttcctttagtgtttaaaaagagtaaatgaggccagggcatggtggctcactcctgtaatcccagcactttgagaggctgaggcaggtggatcatctgaggtcaggagttcgagaccaggctggccaacatagtgaaaccccgtctctactaagaatacaaaaattagccgggcatggtggcacacacctgtagtcccagctactcaggagggtgaggcaggagaatcgcttgaacctgtgaggcggaggtcgcagtgagccgagatcatgccatcccactccagcctgggcaataagagtgaaactccatctcaaaaaaaaaaaaaaaaaaaaaagtaaatgatttactagtgttactgagtgagatgtcagtagtatttcagtagtctttgagagagctttgcactctgacaattgggtaaatatcaaactattaaaggaaaatttggatatttacattcttaaaataagttgatttattttcttccccttcagtaaaaggtagctgaaaacaagtttccagttatagatgcctttttttcaaagatagaatttggcccatatacttcaagggcatctttagtcactgagttttataccccaaaatgtgagctggtttgttttctcataacttgtattccatgtttgaaaactttctctgtgatttggaaatagtgtgggattattaaactgtaggccccatcatcattgatgttatgtatttcttttgtatcattcttctctatattttcccgtttgtcttcttctctgtctttaaaatcctcatactctcatttacatatatggaggctataatttttttttttttttttttgagacggagtctcgctctgttgcccaggctggagtgcagtggcacgatctcagctcactgcaagctccgcctcccgggttcacaccattctcctgcctcagcctcccacgtagctggcactacaggcgcccgccaccttgcccggctaattttttgtatttttagtagagacagggtttcaccgtgttagccaggatggtctcgatcttctgacctcgtgatccgcccgcctcggcctcccaaagtgctgggattacaggcgtgagccaccgcgcccggcctatggaggctataatttaaacatgtatttctctctctttaacctttcctatggtgtggataaacatgtatttctcaaaggctattattaaatgtattgtgaatattatctttatatcttgggatttgtagttactgatcatactgacagttcatccatttacatttctctcggaaaggttaagtgggtttgtgtttttcaagagaagataaaacatctaatcatcttctatatttttgcttccatgtgcctcatggtgtcaaggatattccttctttagctatattctgttcacccttaatgtctttcttttttttttttctgtttgagatggagtctcgctctgtcgcccaggctggagtgcagtggtgtaatcttggctcactgaaagctccgcctcccaggttcacgccattctcctgcctcaacctcccgagtagctgggactacaggcgcctgccaccacacccggctaattttttgtatttttagtagagacggagtttcaccatgttagccaggatggtctcgatctcctgaccttgtgatctgcccgcctcagcctcccaaagtgctgggattacaggcgtgagccaccatgcctggctaacgtcttttattattgtttttagacagtcttgctctcgcccaggctggagtatagtggcaccatccctgttcactgcaacctctgcctcctgggtgcaattgattctcctgcctcagcttcccgagtagctgggattacaggcacccgccaccatgcccagctagtttttgtattttagtagagatggggtttccccatattggttacgctggtcttaaactcctgacctcaagcgatccacccacctcagcctccgaaggtgctggggttacaggcgtgagccacctcaccgggccacccttaatgtcttatggtctgtctatcaaagaaagaagcatggagaacttgaatcgttcaaaatatatatgtgcacatatgcctgtgtgttcactaagttttttttgttttgttttgtttttttttgagatggagttttgctcttgttgcccaggctggagtgcaatgacgcgatcttggctcactgcaatgtttgctgcccgggttcaagggattctcctgcctcagcctcctgagtagctgggattacaggcatgcgctaccacacccggataattttgtgtttttagtagagacaggttttctgcatgttggtcaggctgatcttgaactgccgacctcaggggatccacccatctcagcctccccaagtgctgggattacaggcatcagccaccgcgcctggccatgttcactgagtttttaactaagaattgtgctggttactaggcttcagaagtattaaacatggcagtactttgtcaacttagaaaacaaaatgaactacttttctgtatgtgaatttgacaaaggatatttccagtataccactcttctcagcgactgggaaaaaggtggaaggcattatgctaacatgggattagctttgttatctaatgcttaaatgaaacaagtagaagtggctttgtaaagattttcatctaattaactcattaaaaaaaattattgaactattttaaggtaaaatgagcagcttaattctttatatttagtgaaactgatctaaatagaagttattaattttttggaaaataatattttaagtttaagagaaattattaattcagtagagttttttgctatcttatatgtttaccctatctgtgttgtattagagctatacatattgttaaccaaattacaatattttcatgttaatgattggttttcacagttaatgtgggagcaatagaaatatttatttcctactaaataaatggatgaaattctgatttctcttttcagtgaatattacttcagtgtagaaaatttggaacgagacttctttcttcggggaaagatggatgaacaaggtttcttgcctatttccctgattgctggttttcagcgtgttcaggctctcactacaaaccttaatctcatcttagaggtaattgctcatttgatgaacaatttgtactttctgctcaaatttcctttgtacctaaaacttctctgaaaaacagagtactaaaaacagacaatctgtagttgcttgaggctcagacagcattccatgatgtttttctattttgtaaaaccttcataaatgtctaaccttggaaacccctgaaagtattgctaacgatgttactgtgtattttctccttcccctccccctcaattagtcaacctattttaaacctgatccttcaaactttaacccttttgaacacccttggtccttaaaacttcttcagggctgggcgtggcggctcgcacctgggtgatagagtacaacggcgcaatcaaacacaaatttcttcaggttactgtaaaaaagcatgtgttcctgtatatgtatgtgtatatatatatatatatatattttttttttttttttttttttttttttaagacagtgtctcactctgttgcccaggctggagtgcagtggcatgatatcggctcaccacaacatctgcctcttgggttcaagcgattctcctgcctcagccttctgagtagctgggactacaagcacgcaccatcatgcccggctaatttttgtatttttattagagacttggcttcactatcttggccaggctggtctcgaactcctgaccttgtgatccgcccaccttcgcctcccaaaatgctaggattacaggtgtgagccagcactcccagccgttcccacttattgaaaggctaatttcaaatagtccttctggctgggcatggtggctcatgcctgtaatcccagcactttggggaaaaaaaaaatctctcatctggtctgtttctagaaatgctttcaacatctttttttttctagccaatttctttccctacacacaacccttggtaaccacaatcactaatctgctttttctttttttctttctttttttttttttttgagacagagtctcattctgttgcccagtatggagtgcagtggcacaatcttggctcactgcaacttctgcctcccaggttcaaggattttcctgcctcagcctcccaagtagctgggataactggagtgtgccaccatacccagctaatttttgtatttttagtagagacagggtttcccaatgttggccaggttgtagccttttgtttctgatttttcacttagtattgtgcttttgagattcacctatgttgcatgtagcagtagtttgttctttcatattgctgactagtattccatggtatggatataccacagtttatccattcacttgttggtggacattcagattatttatggttttggagagtgtgagtaaagcatgaagatctttatagggatatatatatacacacacacacacacacacatatatatttctgttggataaatatctagtattgtgattgctggaaagtatagtaagtatatgcctatctttataagaaaatgccaacctattgtccaaagtggctttaccattttgcattcccacgattatctataggacttgttcctcagccttatcattgcatatattgtcagttttttgaataatagatatatagtggtttctcattgtgggttttttatttttttgggacaaagtttcagttttgctcttgttgcccaggctggagtggagtgcaatgccatgatcttggctcactgcaacctccacctcccggattcaagcaattctcctgcctcagcctcccaagtatctgggattacaggcgcctgccaccacactcagctaatttttaaatatttttaatagagacgagatttcaccatgttggccaggctggtctcgaactcctgactttcaggcgatccatccgccttggcctcccaaagtgccgggattacaggcatgagctaccgcgcgcctggcctgattgtgtttttttgtttgttttttgagacagagtctctctctgtcgcccatgctggagtgttctggtgcgatcttggctcactgcaacctccacctcctgggttcaagtgattctcctgcctcagcctcccaagtagctggtactacaggcgcacgccaccaagcctatctaacttttgtgtttttagtagggatgggggtttcaccatgttggccaggatggtcttgatcttttgaccttatgatctgcccgcctcagcctcccaaagtgctgggattacaggcgtgagccaccacgcctggactcattgtggttttaatttgcatttcactaatgattaaagttgttagcagtttttcatgtgcttttttgtctgcataccttattagtggaaatgtctgttcagattttttattcattattattgaagtgttttttaaaagataattgtatgagttcttcattctggatacaagtccattatgtattttgcaaatattttttcctagtttttgtcttttcattttcttttcttttctttttttttttgttttttgtttttgtttttgagacagagtcttgctctgtcacccaggttggagtgtaatggtgtgatctcagctcactgcaacctgcgtttcctgggttcaagcgagtctcctgcctcagcctcccgagtagctgggattacaggcgcctgccaccatgcctggctaatttttgtattttttagtagagacagggtttcaccatgttggtcaggctggtctcgaacttctatctcaggtgatccacctgcctcggcctcccaaagtgctgggattacaggaatgagccaccgcgcctggcttcatttcttaacaggcttctttgaatagcaagtttttgaacacgtgtgcttcgtgttttaaaaatcaactacagggctgggcgcggtggctcatgcctgtaatcccagcactttgggaggccaaggccgatggatcacttgaggtcaggagtttgacaccagcttggtcaacatggtcaaactctgtctctactaaaatacaaaaattagctggacatggtgacgtgcctgtaatcccagctatttgggaggctgagacaggagaattgattttactatagtaaagtccatgttttgaaaataacataaaataatgatttgttggtgtataattaatgattcttggtttcatgaaaataattactgtaagcaatgtcattattgcatttgtttatagataagtatataaggtttctatatattgtaattaacagagaaaattagtttttttttttttttgcaaaatttgctcttagagcaaatattatgattcatagtagaatgagtttatttatttacttatttatttattttcattttttagtagagatggagtttcaccacgttggccaggttggtctcgaactcctggcctcaagtgatcttcctgcctcagcttcccaaagtgctgggattacaggcatgagctaccgccgccggcattagaatgagtttattaactgctgccattgtgctatagcaaagtgctgtagccaactcagctgccgttttttatgaagttgttgccattttttccctgtctacttctgtacgaatgtagttgtaattttattattgtatgcctttttggtctgtttgtagtcccattaaatcctcaagcacaattttaagatcattgacattttgtttttacaacctacagcagtaaggaaggatttttaaaaggaagctttgagctactgttatggttagcactgatacagtagctaatgatacagtaaaaaataataccactattgaaaagcagaaacacataagcatagcaatttagaagaacataagtctgcattcacttaacattcattatgcacctaccatttgtaatagtaggaaaggtgttctttttctgttgagaaagtaaggcttcattaggcattgtagtgttaacatatcaagatcatggacctatgaatatgtcccttgtagctctgtgactattgtcagtgtcctgagacagtaatatatatttcctagggttgtcatgaggatgaattgtgttaatgaaagtatctggcaaatgtagtaagctctaaataagtaagcatttgctattattgttagtcttaaacgatgtcgttctgttgataactcctttatcttcatgcatttcattttaaccagcttcttcccatatgtatttgaatatgctcaagtttttcctttcttgaaaaactctcaagagaagcaaaataatttagctgatacccgtatctgccctggttgagtatgcaaacgcaaaccaaacttgttgaatctgattcttctccgctcatttattttttagcttactgcattctcgatgtcttccccataattgaaagctttttgtgtcttccatttgttagagcaaattgatcttggttctatagcttaccagttgtataactaagcaattaacgtaatatcttcatgcttcaattttcttgttaaaatatagcaaataatacttaagctataatagagtatgaggatttagaggaataattaatataatatcagcctcagaactgtgcctgctactttcatctcaaaccttgttttctaaattgtctgaacttgtggttcctcaaaacttgtgctcttttctttttatctccaggtctttgcacattcaagtctttctcttactaccaggcagtaagaatgcaacatctatgtattccggcattggtagttattcatagtagtaggtctgtatcattaagaaaagaaccaaaattaatagctaagtcagttaaaacctcagatactggaaaatactgatgtacccagtaactcattgtttaggagttcaggattaccaaggcttggttttataactcgatgtttcttctaggtctttaccttaattttgtgcatggtgtaatttttatatgatccttttatggcctgagtgatgaatgtttcactttatgtgttcttcatttcccttttaaatttattatttctaaataggaaataaattacacaaaattcaaaactcaaaagggtatatggttatcttccagtgattgtccaaggaaaaaaaaggtatatggtaaaaatttttttttccccatttttccaccaacaatgaatgaattacctgccttggtagtggtcagtgttacttctttcttgtgtcttcctcctgagatagtttgtttatgtaagagaatactatgataccttactacatacaatgtttgttatgccccttcctctttttttttttttttttttgagacagagtctcactctgtcacccaggttggagtgcggtggcatgatcttggctcactacaacctctgcctcctaggttcaagcgattcttccgcctcagcctcctgagtagctgggattacaagcgcctgccaccacgcctggctaatttttgtattttagtagagacgggtttttgccatgttggccaggctggtctggaactcctgacctcaggtgatccgcccgtctcggcctcccaaagtgctgggattacaggtgtgagccaccatgcctggcctcctctttttttattttttataaaaaacatgtgttggaagaggctttagtagctgtacataaagaactttgagcttttcatcccacaagtttttctttaaatattttcttttaaattgaggcataatttatacattattattattttatttatttatttatttagagatggagtctcatgatctgcctgcctcagcctcccaaagtgctgggattacaggtgtgagccaccgtgcctggcctttatacattatatattgtaactcataagattagagatgattttttttcctatgtatacggtcaggtaactgccatccagattaagatacagaacattttcaagacccaggcaagctgctttctgtaccctcctagtcagtaccactgctttcccttttaagaggcctctctcctgtttttgaacttcacataaatggtgttatgacttttatatctgattttatttctgaagttatttctgtgagatttattcatattggtgtatagcagttgtttactttctgttttttggtagtttttccattgtatgaatataacagttaatcaatctttcttttcttgctttcttccttttttttgagaccgctctcactctatggcccaggctggagttgtactgacctgatctcagctcactgcaacttccacctcccagtttcaagcgattctcctgcctcagcctcccgagtagctgggattacaggcacccaccaccaagcctggctaagtttttgtatttttggtagagacagggtttcaccatgttggccaggctggtcttgaactcctgatctcaggtgatccactcacctcggcctcccaaagtgctgggattacaggcttgagccaccgtgcccggcaacagttaatttttctatgctcctattgatagacatatttgggttctttccactttgggtctttgatgctactgtgaacgttgtcatagatatttctgggtgaacataagcatttattttcctgggaaactggtgggtaacagggcataaatgtgtgattaccttttgtagatactgctaagcatttttttaaagtatcaaaccaatcaaaaccaccactattgggagtttgacttgcttcacattctaaccaacactactagcagtctttttccacaactttactttggaaaatttaaacatatgggaaagtttcaaggagttttttttttgttttttttttacattcagggatagataatacatggtaaaatacagcgatcttagatgttcactgtgagttttgaaaattaaacataagcattaccccaggcaagatgtagaatactttcattattctaaaaacttccttcatggctctttctagtcagtgtcacacagcctctccaacaacttttctgattttcatatcatagattagattagtctgttcttggcatttgtgtaaattgatttcttctgtctctgagttcttttcattggtagtttttgacattcatccatgttgttgcaatggtctggatgctgggcatactgtttgctactggggtgtcattgcttctaggtctttcagtggacaaaatgaggaaaatatatgttgggaaaaatacactgattttactcatctaaagctttcaccataggattctttcctatctttctccattttatatttcagactcccttctcaaaggagtttcatttaaaataagtcctaattgtaatttaaaggaatccccaattatggccaggcgtggtgtttcacacctgtaatcctgcattttgggaggccgaggcgggtggatcatgaggtcaggagttcaagaccagcctggccaacttggtgaaaccccgtctctactaaaagtacaaaaaaattagccgggtgtggtagtgggtgcctgtaatcccagctactccgaaggctgaggcagagaattgcttgaacttgggaggcggaggttgcagtgagccaagttgacaacactgcactgtagcctgggtgacagagtgagactccgtctcaaaaaataaaaataataataataaaaaaagaaatgcccagttatggaaaatataacttgagagttaagtaccatactaatattaagagcaagagtaggttcttttttcaaaatctgttcatttctgaatggataatgttcttttttttttttgagatggaatcttgctctgtctccaggctggagtccagtggcgccatctcggctcactgcaacctccagctccctggttcaagtgattctcctgcctctgcctcccaagtagctgggattacaggcacatgccaccatgcccagctaatttctgtatttttagtagagatgaggtttcaccatattggccaagatggtctcaatctcctgacctcgtgatccacccgccccggtctcccaaagtgttgggattacaggcatgagcacctggcccggttaatgttcttaattatatacagcatgttctccagctaaaatgtagtgggctttaatttttataagttaatgtacatataactttatattgtttttatattatacattttgtatttatcctaatttctaaaaggtgagtactcctgtatttcagtgagaagttaaaccaataaggatttagtttgtatcttgaagaaattttggcctagttttgttttatccttgtagtacatattggggaggcacctttgcctaatggctaagacttttagttgtagatagatagtggtttgagtcctggtgttgtctcatactagatctgtgatctttgattaagtttatttctttgagcctcagtttcctcatctatatgtaggggtgataccttctttatgaggtattgtgaggaatcatgagtacatgtagtacttattattcaataaattgtggtaattattacaataataaaatgcctacattttatttggtaatattttaatggaagacaaggaaatatgagagagaagaaaatagtaaaagtcaatttgcttctagctgattcagtattccttaaatgactgttctaattgtgaaaaatatatcatctgaagttaaataagtgggagatcaggatatttgttaccttacaggtgcaaatgattttaaaacttgtgttctatgtggttaacttatggattttttagaatcttaactgcaaattagtttgctaatttcaggttttcaaatttttaggttcttagaagtatagcacagacagtgaaatagctcataattttaatagctcaatttctgttaataggcactgaaggatagcacagaagtagaaattgtggatgagaaaatgagaaaaaagatagaaccagaaaaatggccaattccaggccctcctccacgcagtgtgccaccaacagacttctctcaactgattgattgtccagagtttgtaccaggccaagccttttgctcacatacaggtaacatcttttcttctagagcaaacgatgtaacagtgggttatttggtccaatttacttacttatttatttattttcagtttatttagatttgataggaaaattaaagctaactgaaagacttttgagtcccattttgtattcatattgcctcactcacagagttacaaattaaataaggatttaagaattatgaggaaagctgtcttatgtttcttgttcttaaattatatgtgtactttgtcatgtatggagtttctatcttttatttttactaaataactatagatatgtatcgttttcccctgtaaaattggaatagtatgattggattattctaaaaaggtcttatactcaagagtggggtagtcttcctttaattttgttaccaatacgctttaatcttgtcttggaaagataaaatgacctgcattctaaattagaattggggttctgtttaatttggttgtgtttagaatttccaaaagatttaatgttaataattttttcctggatcatttttaagacattccctcttgggaaaaaatgtgtgcttaaacttttttcagtcagggtgatgatcttctgaagctcttggatgtcatttgatcggaatatgcagtggaataggtgactcactgaaatgcctttataaatactggaacaaatcctgctgcaaaaatgaaagcgatcagactgtcttctgttcaagaatgtctattcccacctcttggtggaggaagttgggccaacactgcagtggagataaccacctttgcgataatgagagacagaccagaggactgctactctttttataggagctgcctatttctgtgtaattggcctgggctgcatgggctgcttttattcatggtgggaaagttaattattattattctggaaataccgcaagattatgttttctgtttccagggttatgtacttgtgtccagatgaataaagcagaaaaagaggggattgagtagcatttcccagattcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtatttttgatacatcagtatgagaggacgtcccatcaacaaagcatcgatgatggacagtctcacactatttttatcatatgtttctttgtcagccttctgcttctaatcccagtaagcaacttggacaggcattttaaaagctgaagaaaagtgacattattttagctagtggtttttaatttattttttgttaagatataatgggtgattatataagttagatttatttatgatatcaacttgggtccaagatgatagttttagctagcttatgaacattgggttcacaaggcattgggtaagttagataaaatagcatatactttctctgcagggtaggtaagataggtcagtcaagttggtaatgcctgtccattaaccatttatgcatactaataaaattataagaataaaatcataatgttgtacatttttgtgttttttaatatacactcagatgcatgcacatacatattgtctgaaacaagccagtatatattaaaatgtcataaattttaggttatttagattacatatcagaaactagatggttaatgaagaaatataggaagatggagggttcttagaattatgctgattcacattaggtcataggaataaatatgtaaatcacctctttccatgaattcccaaatttctgaccttaataatttcctagtgataagaaagcctagtttctttaagtcaatggagagtagtatgtcaccaaaaatttgaagtggaaatagagataagaagcatagactgtgcttatatgtatctatgagtagagaaaagtagtgaaactgtatatcattttaatctcaaatttgaagaccttaaaattttaacaacataactctttatgatttctgagggatttgtatggtaaaatattctaacataattggtcttcttcatcaaagagattaaaatttctattttttttcctatctggaggttgaattttctaataggggttgaactgagcagaagtctacctttatgcaccagaaaacattgattatgggaatggtaagattacttctgaaacataggttttgcagttttatggatattgttagtattttactattaactcttaaatgaaaggatttcattcatcagaattgaaaggtcaggtacctgacaatgttgggtttttttctttttttaaattttaataatcttcacaagggcactgtaatgtagtgtttttctttcttttcttttttttttccccttgactcttagcaccactcaatgaaaattttaaaaagtgccacacataaaatatataatccttttttcaggaaacctttttaattacccagaactgtgatcctcccaaggtacaaaaaaaaaatcataccagagatgaaatgtatatggtgatttatctttggagagttcagttgatattttttttgttgttgttgagacggagcctcactctgtcgctcaggctggagtacagtggcgcagtctcggctcactgcaacttccgcctcctggattcaagcaattctcttgcctcagcctcccgagtagctgagattacaggtgtgtgccaccacgcttggcttatttttgtatttttagtagagatggagtttcaccatgttggtcaggcttgtctcgaactcctgaccttgtgatcagcccacctcggcctcctaaaatgggattacaggcgtgagccactgtgcccggccactgataattttcagttaataaaagcagcaaagataaattttctgtgttcttacaaattaaaacaagtattaaatatatgtatctaaattttttttgtttctaagtagtttaatatcaggtaatctaagtcatttaaactcattttgtcttggaagattagggtttactattacccttaatccgttcagatgtatagtttgaagtcttttcattattaaaaaaaaaaagatttgggaggccgaggcgggcggatcacgaggtcaggagatcgagaccatcccggctaaaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagatgcagcagaccacacagagcatatatgtaaattaattatgaggttaacacctttacgagtcttattctaagaattgtacgttttcttgtcttacccaaattctttagtgttttaatgtcatttcatttctaagcatatgtgttggcgaatatattgaaatactttacttcccagtagaagtatttaagcataattcaagcttaaataacatttagagataattttataagaagcatctgagtgtgggggtgtacacctgtagcccagctacttgggaggttaagtttggaggatacttgagcccaggagttccaaggccagactgggtgacataccaaaaactcataatttttttttttttttttttaagagatggtgtcttgctccgttgcccaggctggagtgcaatggcacgatctctgctcactgcagactccgcctcccaggttcaagcaattctcctgcctcagcctcccgggtagctgggactacaggtgtgtgctgccacgcccggctatttttttgtatttttagtagagacggggtttcaccatgttggtcaggctggtctcgaactcctgacttcaggtgatcacctgtctcggccccccaaagtgctgggattataggcatgagccaccaagcccagctcttcatctacttttaaggctttatttaatatgaacattgataattcatagtattagaaatagagttctctgggccaggtgcagtagctcatgcctataatcgcagcgctttagagattgaggtgagaggattgcttgaggccaggagttcaaggccagcctgggtaacaaagtgagacccagtctacaaaatacatgtatttttatgttgactgggtgtggtggtgtgcatgtgtagtactagttattcagcaggctgagttgagaggattacttgagcgcaggagtttgaggctgtagtgagctatgatcatggcactgtacagctgtaaggggccctgtctcttttttttgttttgtttttgagacaaagtcttgttcttgtcccccaggctggagtgcagtggctcactgcaacctccgcctcctgggttcaagtgattttcctgcctcatcctcccaagtagctgggattacaggtgcctaccaccacgcctggctaatttttgtattttttttttttttagtagagacggggtttcaccagttggccaggctggtcttgaactcctgacctcagatgatctgcctgcctcggcctcccaaagtgctgggattataggcatgagccactgtgcccatcctctgtctcttaaaaaaagtttcatgtatggttcattaaaaagaaaaaaaaaagtgttctctggagttaatatttttcccattcctataactagacaattaatgttcatccaaagcttgtatttcacttgtactttttttgtgaatgaattggtgatatatgtagtgttaataaagttacagagcaccactgtccaataaaaatgtgagccatgtatataactctaaaaattttagtattcttaaaattataaaacatgaaattaattttaatattttaaatagatattttaatttaacttaatagatccaaatgttatatgctcagtgtaaaaattaatggcactatttttttttagcggggttgggagtacctggtctttaatacctggtgtgtattttactcttgtcctgagcatgtttcaggactagccacatttgaagtgatagataactgcatatagctaatgcttactctatttttttttttttttttttttttttgagatggagtcttgctgtgtctcccaggctggagtgcaatggcgtgatctcagctcactgcaacctctgcctccttggttcaagggattcttctgtctcagcctcccaagtagttgggattacaggcacccaccaccacgcccggctagtttttgtattttcagtagggatggggttttgccatgttggtcaggctggtctccaactcctgaccttaggtgatccgcccacctcggccccccaaagtgctgggattacaggcatgagccaccacgcccagctgtgcctactgtattgaacagcacagttctagagcttttcctgttatgaaacaatatatagtcttttataaataatacagtaatctagtagttgagtcctggttgagtccatgtgtccaaggggaagatattaaagctatctgattttactctcatctatgtctagcatgtagatgaatgtaaaatcttgaaatactcttcttaaacccattcttgaaatgtgcctttcatttagtaaatattaaacaaaagattgctggtgttaatttatttcagctttctgcatttaacatttaacttctcaatattttcagtgaattgacttagaggagttaatgatgttaagaattttatggtatacatttttgaaaaataaattttattgtgtatatttgaggcttacaacataatgttacagagtacattttttgaagacaccttgtgttcaaagcaagttcatattgcatcttcagatctaaacatgaatataacttaaaatatttaaatattctttgacttttgaaaaaatatttataaaagaagccatttgattttttttctttttcttttctttttttctttttttttttttttgagacagagagttgctctgtcgcccaggctggagcgcagatcttagctcactgcaacctctgccttgcggattcaagcaattctctgcctcatcctcctgagtagtgggaattacaggtgctcaccaccaggcctggctaatttttttgtatttttagtagacacggagtttcaccatcttggccaggctggtcttgaactcctgaccttgtgatccacccgcctcagcctcccaaactgctgggattgtaggtgtgagccactgcgcctggctgcaatttgaattttatcattttgattaaaaataaacctacagaagtgtactgtatagaaagaccttttaagttccaacaatttttaaatgcttttaatgttattgccagggctgtgtgcgttagtgatgtgacatttactcttttttttttttttttttttttgagatggagtttcgcttttgttgcccaggctggagtgcaatagcgccatctcggctcactgcaacctccacctcccaggttcaagcgattctcctgcgtcagcctcctgagtagctgggattacaggcatgtgccaccacgcccggctaattttgtatttttagtagagatagggtttctccgtgttggtcaggccagtcgacacttcactctttaaagtatttcagtatgagccaaagtagtaaatgactacactgcatttattgcagtagacaaaccttgctgagccaaggaaatgtgaaaagtaggagtaataatggctttagtatagaccctagtagaacaagagactaattttaccttgaataagatgtgcatttagcttaactatggcttaatagcaactgagatgccataatttccttataatttatagattttaatctaagatttttcagagaacttgacttcctaatagttgtactgtcataattaggaagtgactcacattgatatttttgagaagtttacatgaatgtagtggtctgtgtaagacttggtgacatgctttaattattcagtggcttcacttttgagtaaatcttatgagcccttcaggtttgaaaatcactggaaagcttacagttgagactgatcatgtttttgtgaaaaaatatcaagccccagttaaggaaaaaatgaagtgtattttgtaagtaagaaaagccattatcattttaactatagaactaacttaaaattttagagtctgccccaaattctccaagaattggaagcccattgagcccaaagaaaaacagtgaaacaagtattcttcaagcaatgtctagaggtttgtctaccagtttgcctgacttggactcagaaccttggatagaagttaaaaaaagacatcagccagccccagtgaaattgagggtaagttgttacagactgagtgaagtgtgacataccctgggtggagtataaggtcagtgcactttatgtttgttaggtacatatgtaaaatttggaaaagtttagcacaattttaactttgtaattgttggccttcagtagacacttatgggttattctatgaggaaaataagttgtatcaatttttaaaatgttatttatttttttttttttgagatggagtcttgccctattgcccaggctggagtgcagtggcgcgatcttggctcactgccacctctgcctcccaggttcaagcgattctcctgccctggcctcctgagtagctgggattataggcgcgagccaccatgcccagctaatttttgtatttgtagtagagacggggtttcaccatgttggtcaggctggtcttgaactcctgacctcatgatccgcccgcctcgtcctcccaaagtgctgggattagaggcatgagccactgcacccggccttaaagtatattttttatttctgaacatgatttaagaattttggaggctgggcacagtggctcattcctgtaatcacaacacttcgggaggccaaggcaggaagattgcttgagcgcaggagttcggggccccctgggcaacatagggtgaccctgtctctacaaataattcataaagttagctaatgctaattttttggtggaatgtgcctgtggtctcagctactcaggaggctgagacaggaggaacacttgagctcaggaggtcaagactgcagtgagccatgatcacaccactgcactccagggagggtgacaaagtgagaccctgtctcaaaaaaaagaattttgtcttggtttttctacttgtgactaattttaacttgaataatatttcagttttttatgaagttgaaaaaatatgacttttattttttgagacagagtctcgctctgtcgcccaggctggggtgctgttgctgccatgttggctcactgcagcctttgcctgctgggttcgagagagtcttgtgcctcagccacctgacttactgggattacagggtcactccaccatgcccaactatttttttgtgtgtttctggtagagacgggattacaccatattgtccaggctggtctcaaactcctgtcctcaaataatttggctgccttggcctcccagagtgctaggattacaggcgtgagcctctgcggcctggccagaaaatgtataaattttgaagttacactcatgttaattatttataaggtttatataagtgttggtgatttatatatctggtttatatatgttttggtgatttaatgtgcaaaaggaaaagaaaattgaatttttggtggagggtacataagagagtgagatggttatatttataaaaagagaaataggagatccttgtggtggtactgctctgcatttttcactggtggtagatacacgaacttacatatgtgataggattgctttgatctaaatcacaaatgagtgcaagtaaaactggggaagtataagctaagattgatttatatcaaagtcaataccttgtttgggatgttgtagtatatttttgtgagatgttaacattgggggaaaccaggatatatgagatctctattatttcttacaactgtatctgaatgtataattatttcaaagtaaaagttcactaaaaataaacttggggagaatgccactcaaaagattcaaatattgaaagtaagctctctaaaggggatggaaggtattgagaggattgtgatgtggaggaccagcaaattggttctggtagctggttttaaaagtataaggagaactgtgtagttttatggccaaacaatgccagtatatctgaaatgtatggtattctgatgctacagactgaggatctggcctggaggaaacatggctttaggttctgggggcctagatatttcagagataactgttgaggtagctcagttattgacattatttttaatatacttttaaaaaagtgatcttttaaaaacattctagagtgggtatacagatctttgttgggcatcatttttctttggaattctaaaagcatttttcttttgtcatcttggtttcttttgtcatcttatgaaagtcagtccattcacattctttttatcaagtgatttttttttcctcttgagttttttttttttttgagtcttgctgtgtcgcccaggctagagtgcagtggcgcagtcttggctcactgcaacctctgccttctgggttcaagcaattctcctgtctcagcctaccgagcagctgggactataggtgtgtgctatcatgcccagctaattttttgtatttttaatggagatggagttttaccatgttagccaggatctcctgacctcctgatccgcctgccttagcctcccaaagtgctgggattatagggatgagctgccatgcccggcctgagatttttttttttttttgagacagagtcttgctcttgttgcccaggctgcagtggagtgcaatggtgtgatcttagctcactgcaaccttcacctcctgggttcaagagattctcctgcctcagattcgtgagtagctgggattacaggcacctgctactacacccggctaatttttgcatttatctatttatttttttcagacagaatctcactcttttgcccaagctggagtacagtggcgtgatctcggctctgtacaactttcccctcccgggttcaagcgattctcctgcctcagcctccagagtagatgggattaaaggcacaggccaccacacccagctaatttttatgtttttagtagacggggtttcaccatgttggccaggctgttctcgaactcctgacctcaggtgatccacccgcctcggcctcccaaagtgctgggattacaggtgtggcccactgcacctggcctaatttttgtatatttagtagagacgtggtttcactatgttggccaggctgttctcgaactcctgacctcaggtgaaccgctggcctcggcctcccaaagtgttgggattacaggtgtgaaccaccacacctggccttgcttgagatttttaagatcatttcttcatccccagctcttgaaatttcaagatgatgtgctttggtgtaggtctaattttaaacagaaaatctttttttttttttttttttggcagagggtttcactccctttgcctagactggtgtgcagtggcgcgatctctgctcactgcagcctctgcctcctgggctcaagcgattcccctgcttcagcctcccaagtagctgggactacaggcacaaaccaacaggcccggctaattttttttttttttttttttttttgtagagacagggtttctccttgctgcccaggctagtcttgaactcctgggctctagtgatccacccacctcgatctttcaaagtgttgggattacaggcatgagccaccttgcccagtcaggtctattttttttttttttttttgagatggagtcttgccctgtcactaggctggagtgcagtggcgcgatctcggctccctgcaaccttcacctcccgggttcatgccattctcctgcctcagcctcccaagtagctgggactacaggcgcttgccaccacgcccagctaatttttttttttgtatttttagtagagacggggtttcatcgtgttagccaggatggtcttgatctccttacctcgtgatccgcccgcctcagcctcccaaagtgctgggattacaggcgtgagtcaccgcgccctgctctgtctggtctatttttatgcattgtgctgagtattcatgtccttcatttgggagaaactaatgtttctcttatttccactttctggtatctgttttcatctgatgttggacctccttgatagatcatctaaatactgggccttgggtgtttaaaaaaagttctcttctgatattttcattatttccatcattgttttggttgctttttgaatgctttcttaatatctggcgatttttggttgatagttcatattaatattagtaaatatgcatggttttcttgtttgatctaatctgctcatctagtgggctgttttgtttaatgtgaggtatgattccacagtctttttttttttttgagacagagtttcgctcttgttgcccaggctggagtgcaatggcagtgtgatctcggctcactgtaacctccgcctcccaggttcaagcaattcttctgcctcagcctcccgagtagctgggattacaggcacccgccgccatgcccagctaatttttttgtgtatttttaatagagatggggtttcaccatgttggccaggctggtctcgaactcctgacctcaggtgatccacctgcctcggcctcccaaagtgctgggattacaggcgtgagccactgtgcccagctgattgcacgttcttggtaagtgaaaacgtcctatggacttggacacctaggcagagaatagggatgctggctctttttctccaaaattgctaaaacaaaaaaagcagtacttttctctgggatgtagaatttcttagtgtatctcattcattggtgaaattaccttttcttttcctccccccagctctattttagaggttcagaataatgctaggatgtgttcaacttctgttcagccccagtacacaaaacatgagccctctcttgtcaaatcttattttgtttagaaagtaattcttgggcttttagttgggagcgatctttatatagttttatattctgagataaagggattggattgactgttccagctgtgttctatagttggttttccaaatacctattttgattgccatccaatagtccattcctactccttgtaactgccatctcaaaactttctagaaccctggcgggatcaatggcttttgcttcccctttaacctttgtatcagttctaggttgctgttttctctgcttttgtttattatcaatacaatcccatttattttctgctttcccgaaagtcataaaagtctttgatcttctgatagtaatacttgttttcagtattgatgtggatttattgtttttattctttgcactgtgtattattactgcaaataagcatgcaaacttaagtcatcttcaacccctaatctcttaataatggtcttttcctcagaaattacaaaaacaaatttaacagtttgtttattctcttagacttttatcatgtacctgcaaatgtgaaaagcaatgtatattgtttaaaatatatcatcagtattttaaaaaatatatattcacagtgttttacaacttgtctttttttagtaaaaacatcttgggtagtcttctgtttactagaatgtgagctccatcagggcatagttgttgttaaatttattgctgtctgtccctgcctagaacagtgcctggctcagaggaagcactcagatagttatcgactaaatgaatatggatctacattattgggaattttgaaagggaggaattgtttttttcctagacataggaagttagcatgaactgaagggtaaaataggccagaggacgaaaaatgaatgtaacaccaagtagaaactacttccttctgttgggagttttaaactagtttacatgttataagatctaggatctaaaagcttagacttttaatgtaaaccaacaactgttttaagttcttttttttttttttgagatggggtctcgctctgtcacccaggctggagtacagtggcacaatctcagctcactgcagcctccgcctccagggttcaagcctccgcctccagggttcaagcgattctcctgtctcagcctcccgagtagctaggactacaggtgtgtgccactatacctgggtaatttttgcatttttagtagagatggggtctcaccatgttggccaggcaggtcttgaactcctggcctcaggtgatctgcccatcttggcctcccaaagtgttgggattacagatgtgagccactgcacctggcctagctgttttaagttctatagaaggggtagacaattttttttttttttttttttttcttcagacagagtctcgctctgtctcccaggctggagtccagtggcgtgatctcggctcactgcaacctctggctcccaggttcaagcaattctcctgcctcagcctcccgagtagctgggactacaggtgcgtgccaccacgcctggctaatttttgtatttttagtagagacggggtttcaccatgttggccaggctggtcttgaactcctgaccttgtgatccacccgcctcagcgtcccaaagtgctgggattataggtgtgagccactgcacctggcctgaggggtagacattttaacatttgctgaatattagcatgaatttgacatgaaaactgggccatgtagaatggggatgaggatagagtagagggattagctcagaaactatgttattatcattgtgaggtaaaaaggttcggaatagggaagaccattgactctgaaaatcagaagaccttgattctatctatctgtctatctatctatctatctatttattttttgagacagagtttcgctcttgtcgcccaggctctagcgcaatggcgcgatcttggctcactgcaacctccctgcctcccaggttcaaacgattctcctgcctcagcctcccgagtagctgggaatacagcaatccacaaccagataattggttctgtttataattatgaaatcataggcaaatactttcatatctctaggcctttgttttaatcagtaaaatgaatcagtgcaatgtaatggatgattaagactattccaactctaaaagagtctttaatgtaatcctttctttattcaactttgtgtttttctttagtcttaaatttactgggccaaaataatactcacttgattttcttttacagtttggctgttaaactagcaattgagcataaaagcttgatattacttacttgtaacactgttttatgacatttaatttaaaaatgatagaaagttttttatataaattaccaatttcttccttcaggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctgaggaatcgttttattttatgaaagtaacagcgtgatgaatactgtaattacaaaagaaaattagtactcactgacttatacccttgtttttttttttttttgttttgtttttttttgtttttgttttaggtgacaatactgagaacgccctttctcgtatgaaagaataaaaacaagttactgtggacaggcttaatttatatgctcattgcttacctggctctcaccgcagctgtatgagccagtggctttagagagcactcttcttgcctctttctgttttccccacttagtctatggtgcatgatctaaggtagtggaaatggttgtggacaaactataaatgactaaactggatgattatctctcttggtctagtcattactgtggtgctagggttactttttacaatcttgttctaattttttttaacttcttgcatttcatcccagatcctggttcctatcctagttattaaggtaaaatagagaaccagaatagtttatcaggtatctgcattccttcaatatgaattataatggtacagatatggggataaaaggaatctttttctgctattaagtttatcagaaaagccccaatagttaaatatttgttttcagtagagggtataataagggaaaattatataacattatatgccaaataggaaactgatcttggttggaaataaagttgtaggaagaaaagctagccaattagtggctgagtagaggggactgcctgtcggtggggcttcatatcatcaacaagaagtgtgctagccttcttggctcctcatttcttttcttcctggaatccccagtactgcttttagccttctgtaaccactgccttcttggaggacctgcctcaggctatgatagcttgttacgtgacttagagccttagcagttctctgcctgtcctactgctgtgggaaaggaagtgtgtttttataatgcttctcagttgaaagtctttcctagtgtaagcattgctattttatttgtaatacttaggttcggtaagtaatacctatcttaaatccttttagaacagagatactagtacattctactaataatcagttaaaattatccttcccccattctctatccctttacccagctttgtttttcaccatagcatatatcattatctataattctatatattttacttacttttattctcttggagaaaaaactatggatgtaataccaatgacaataggatttttttctatttgttcattactattgtatttctagtgttagaatagtttctggcacaaagaaatgttcaattcatgtttgtgggtaaataaattatggagtaaacattatgcattaaccaaaggaacccaaccattgtgtataatatttgttctgtgggaaatgttttcagtctgccaagtaacaaatttgtaagccaacttgagaaacatcctatttgtaggtgattatttccttaaattatagacaataattaaaagccatgtattgagttcttgaggcatgtgctgatcttattcattaaatattaacggaaagtaatcttggcttatataactttaaccattataattgcagatatgtcttactttgacctgattcttatgtacattcccatcatttaactcatcccctttggttctgattctgtcttctacatgtagtatctcattagacttgtacttttcctgtgggtctgcttaaagggagagaaatcagtcatttaacatatactcattgagtgcttactatgtgccagacactgcttagaaactgggcacagagtgagaaggtaacaaatagggtttctacatgcctagaacctacagctaactgggggaacagacttaaaaataaacccacaataagtacttaatcacaaattacaataaatactctaaaagaaaaaaacaggatgctatttcattgagtagtcagggaaggcctctgagaaagtcagtaatagtgaaatctgaagtggaagtaggacataaccaagcaaagagtagggaaacagtattccaggaaaagggaacagtaaatgtcaaggatctggcagaaaagattttggtgtatttgaggaactggaaaaaaggtcagtttgcctacggtattatataaaatgttaattatagatgaataggcaggagtcatcatttatgcgccatgttaaataatgtggagtttatctaaagttcaaatccagtaccttaggttttgcaaaggcagtgtgacatctaatttttatttttaatagatcactctggttgttttggcacagaatggattgtacagggacaagagtgggcagaagaaatccagttaacaggctgtccatatagaagatgaattggtcggccaagacaaacaggtggcagaggaaatatagaagtgagaagacctgtctcatctgagccttgaggaatgattatataggagttgtataggaaagtgtgttgttgtggaagtcaaaagctggctctaagagaagaaaataatcaggtgtgtcagcaactttacaggttgaattagataggaatgaaaagtatgccaaattgatagggcagtttagtactcatttttgacctctgcaaaaagagttttggtggatccagaagctatgttgaactggaccaaagagtgagtaaaggctttattctgtttttggcatatatttactgctgaagactactaaaatgataggcttataggtaagaaaatatctgcttaaaatctttgaagatatgctaggtaagttattatcaggataaaactatacagaagtgaagtactgaaacttagttttacccttaggaccctttgtagaagctacccaaaacgggtaaaaaccataaactcagggaccattcaaaactgtggattcccataggattccttttcccatttaattggtacccaaaagtgcaccaagatctcacagatcactactaaataacttactcgtgtaaccaaataccacctgttccccaaaaatctatgggagaaaaaagataccccaaaagaatacacttacagtggaagaactaaacttgcttcctacctgctccccaagggactctgtaaagaatatttttctggctggcgcagtggctcacgcctgtaatcccagcacttcgggaggccgatgtgggtggatcacgaggtcaagagattgagaccatctggccaacatgatgaaaccccatctctactaaaaatacaaaaattagctggacatggtggcgcgtgcctgtagtcccagctactcgggaggctgaaggcaggagaatcacttgaacccgggaggtggaggttgcagtgagtggagatcacgtcaatgcattccagccttgtgacagaacaagactctaactcaaaaaacaaaaaacaaaaacaaaaacaaaacagaatgtttttctggttgtgctgagcagaatagagaggaaaaaattgggctagaagttgtattcatgcaacccaagttcatactctgggtgactaaaggaagcactagttgtaaatttgatgtgattgtggtctcttagtttcccagacacctagcatatgaaaataaagattttttgtgtatgaaaatattcacctttatcttagacctcctttattcacattatattgcaaggaaagttagcagcacataaagtgaataatctaacaagaaagtgagatctcgcatgtgagaatgagcaaaagtaacaggcagcagaaacataccttaaaataatcttttttttttttttttttttttttttgagatggagtctctctccgtcacccaggctggagtgcagtggcaccatctcagctcactgcaacctccgcctcccaggttcaagtgattctcctgcctcagcctccaaagtagctgggattacaggcgtgtgccatcacacctggctaattttttatgttttttgtagagatggggtttcaccacgttggccaggctggtctcgaactcctgacctcaagtgatctgcttacctcggcttccgaaagtgctgggattacaggcgtgagccaccatgcctggccccttaaaataatttagatagtcagattattaaacaaaatatgcagtagctaggcttactgtgtttaaggaaataaaaatatgtgtagagaagaagaaatcctaaagaataacgatagaactggaagtaaaaacaattatgattaaaattaagaaccaaatcaattgaagggattagcaacagattagacagaattagagaattagtcaattggaagactgttcccaagaatttattcagaaatttccacagagtagcaaagaaatagaatatatgaaaagaggatacagaatgattttctacagtctttgctattggttggtaagttttaatcaagttttgtaatttaacatctagtagattttattataaagctttttatttgtttttgttttttttttaaaaaaaggtaagcaagaaacttggaatataggataacggagaaggtctaaaatatacatttagtcagagttccagaatgaaagggtagagagaatggggccaagtcattattataagaggcaattaggacctctacagaactgaggagaggtgtcagagtttagccagaaaaaaaagagattactttcaagaaagaagaatcattagacagctgatagctagtttcccaacagtgacaaccaatagacattggaatgatagctttaatttgccaagggaaaataactatcaactgataattgtaggccttgcaaaaatatctttcagtaagagtgtagaatatgagaaatggccaccagcagagtctcatgaaagaaagtcccaaagggtagaataaaagtgattttacctatcagagacacagaaaggactgcagagcaaaacaagtaataaatacatgaataaacctaagtgaatattaactgtataaagcaattattatgtcttatagatttactataacaacacaaactgggagagagagcagtaaatgaatctaatatttaaatgtaacttcatatctggacaaagggtactgattaaagttattaaagtttgcaaattgcagtttgaaggatacacatttaattgacaaggtgatctaagttcatttggaaatttcaggaatccatagtagtcaaaacactcttaaaaaataacaaaattacggccgggcacggtggctcacgcctgtaatcccagcacttcgggaggccgaggtgggtgtattacctgaggtcaggagttggagaccagcctgaccaacatggtgaaaccctgtctctactaaaaatacaaaattagccgggcatggtggtgtgtgcctataatcccagctacttgggaggctgaggcaggggaattgcttgaaccccgggaggtggaggttgcagtgagccgaaattgcgccattgcaatccatcctgggcaacaagcgtgaaaactcgcaaaacaaacaaaaaacaaaattgaaggactcatattttatgatttcaaaacttactacaaagctgcagtaatcaagatagtggtgctgtcataaggatgaacatatagatcaatggaataaaattcagagcccagaaataaacatgtctattttcaactgactttgcaacaaatgtgcctagaccattcagtatggaaagaatagttgtttcaacaactgggactctgtcaacttgatatctacaaacaaaagaaggaagttgggtccctccctatcttacatcatgtatcaaaattaacttgagttaaattcataaatttaagaggaaaaagtataaaactcttagaataaaatgtgtaaaatcttcatgaccttggatttgatggtggtttttcatatgacactaatagcacaagcaacaaacaataaaaacaggtaaattggacatcaaaatttaaaaattttgaatctcaaaggacactatacagaaagtgaaaagccagtacagatgttcctcaaattatgttggggttacatgcttataaactcatcataaattgaaaatacactgttaaactgaaatgtatttagtacacccaacctaccacacatcatagcttagcctagcctaccttaaacatgctcagagcacttatgttagccttagttgggcaaaatcatttaaacacaaggcatattttataataaagtattaatagcttatataatgtattaattattatactgaaagtaaaaaacagaatggctcactgctgctgccctgcattgcaagaaaatataccacgtattgctggcctgggagaatttaaaaatttgaagtacagtttcttctagtaagtgcctcttgctttcacaacattgtaaaggcaaaaccataagtcaaactatcataagcctggggctgtttgtacaaaaaaacacaatacaatttacattggcacccaaatacatgaaatagtttataaatctgacaaaatatgtacaggatctatctgaggattactacaaaaccctgatgaaagaaaaaggggctgggcgcagtggctcacgcctgtaatcccagcactttgggaggacgaggtgggcagatcacgaggtcaggagatcgagaccaccctggctaacatggtgaaaccgcgtctctattaaaaatacaaaaaaattagccaggcgtgatggtgggcgcctgtagtcccagctactcaggaggttgaggcaggagaatggcgtgaacccgggaggcggagcttgcagtgagccaagatcgcgccactgctctccatcctgggcgacagagcgagactctgtctcaaaaaaaaaaaaaaaaaaaaaaaaaaaaaaaaaaaaaaaattcagccgtgcgtggtggcgcgtgcctgtagtcccagctactggagaggctgagacaggagaacagattgaacccggaaggcggagggtgcagtgagccgaggtcacacactgcagcctgggcgacagagcaagactccgtctcaaaaaaaaaaaaaaaaggaataagtaaataaatcgagaaacattccttgttcatattatagataggaagactcaataatgtcatgtcagttctttccaacataaccatagattctgtgcagtttatggtcttgttaaattgagatgcatttagtatacccaatcaaaatcccagcaaatgattttgtggatatctccagaggcaaaaaacacctaaaaaacccagaatagctaatacaacattgaaaattggaagacgacactacctgacttcaagatttactgtaaagctgcagtaatgaaggcagtacggtactggtgaaagaatagacaactaaatcaatagaacagaatggaaagtgcagaaatagacccacacagatgcagtcaactgatgcttgacaaagaagcaaaggcaatacaatagagaaaagtcttttccacaaatggtgctagaacagctgagcattgaggtgaaaaaaaaaaaatgaatcttcacccttcagaaaaattaaagtggacggaccatcgtccaaaatgtaaaagacaaaaccataaacgtcctagaagatgatctaagagaaaatctagatgaccttgggcttatcatgactttttagattcaataccaaaacaatccatgaaagaaataataagctagaattctttaaaattcagaacttctgcccagtgaaagatactgtcaagagaatgaggaaggccaggtgcagtgagtggctcatgcctataatctcagtactttgggaggctgaagtgggaggattgcttgagaccacgagtttgagaccagcctgggcaacatagtgagactgtctctacgaaaaatttttttaaaaaaggagagaagccattgactgctagaaaatatttacaaatgacaaatttgatagagggctattatccaaaatatacaaagaactattaagactaagaaaacagaacccaatttaaaaatggttcactaaaaaatggtcgatagaccagtttattgaagaaaaaaagaaaaaacttgaaagacctgagctgacacttcaccaaagaagataaacagcaaatatgcatatgaaaagatgctcaacatcaaatatcattagggagctgcaagtaaaaacaacaatgagatactactgtagattcattaggagtgccaaaatccaaaacaataaccaaatgcttgcaaggatgtggagcattaggaaatctcattcattcctggtggcaatgcaaaacagtacagcttctttggaaggtagtttgacaatttcgtataaaactgaactaaactaaactcttaccaaaggatctagcaaatttactcaaatgagttgagatgtgtagccacacaataacctgaacgtggatgtttatagcagcttatccataaattgtcaaaacttggaaaaacccaaggtgtctttgaataggtggatggataaacaagctgtggtacattcagacaatggacttactcagagctcaaaaatgcatgagctatcaagctgtgaaaagacatggattcatacaaagactgagtttatattgggtgaaaaaagcctatttgaaaagactacatactgtatgattccaactacgtggcattctggaaagggcaaaactatagtaacagtaaaaagatcagtgattgccaatggttggaaggggaagagatgaatggacagagcacaggttttttagggcagtgacagtattttctatgatgttctgatgacgatacatgtcattgtacacttctcaaaacccatagaaaatgtacaggacaattttgataatactgtcagtgttttcatctattgtaactaatgtatcactctagtgcaggatgatagtgtgggaggttgtatgtgtttgggtgcagagggtctatggtatactctgtactttctgcttggttttgctgtgaacctaaaacttctaaaaatacctaaagaaagataacaggttaggagaaaatatttgcaaatcaaaggagggaggggcaaagagcttattttcttctaaaaatttttctttaaaaaaagtttttaccagtctgtgtgtgttgaaaaatatttgtaatatgcaaagagctcttacaaatcaataagacaaataacctaattttaaaatgggtaaacaagagttcaaggccagcctgggcaacttagtgagaccctgtctctaaaaaacgtaaagatataaactaggcaggtgtggtggtgtgtgtctgtattcccagctactccagaggttgaggcaggaggattgtgtgagcccaggagtttgaggttacagtgagctgtgattgtgccactgcactccagcctgagcaatcaagcaagtccctgtctctaaaaaataatacataaattaaaatgggcagagaatttgagtagacatttcttcaaagaagatatacatggggccaataagcacttgaaaagttgcttaacatcattagccaccaggggaattgaaataaaatcgttgttataccatgttatacccaaaaggataactataataaagaagacagatatactgacaagtgtgaggaaagggagaaattggaacccttatactctgctgctgggaatgtaaaatggtgcatctgctttggaatacagtctggcagttttcaaaaggctaaacatagggttaccatgtaacctagcaattccacttttatgtatgtaatccaaagaaacaaagacatttgtccacacagatgtcatgttcttgtacatgaatgttcatttcagcatttcaaaaaatgaacagaactcagatttttattaactgatgtttggatgaatgtggtatatccatacaatagagtatttggcaatcaaaagaaatgaagtactatttgtttttgattattattattgtgttttgagacagagtcttactctgtcgccctggctggagtgcagtggcgcgatcttggctcactgcaacctctgtctctcgggttcaagtgattctcctgcctcagcctcccaagtagctgggattacaggcacgccccaccacgcttggctaatttttgtattttttggtagagacggaatttcaccatgttggccaggctggtctcaaactcctgacctcaagtgatctgcctgcatcagtctccaaaagtgctgagattacaggggtgagccactgtgcccggccaatttttaaatttttattttttgtcttaagatcttttttctctaacctgcttcagagaaagagaaatgaaggactaatacttcataatgaagcattatgaagacagtatgtgaaaggagccatcataaaagactacatattgtagagcagcggtccccaacctttttgataccagagactaattttatggaagacagtttttctgtggactggggggcatggttttggaataatttaagcacattacatttattgtgcactttatttctgttattcattataatatataatgaaataattgtgcaatttatcataatgtagaatcagcaggagccctaagcttgtttttctgcaactagatggtcccatctgggggtgatgggagacaatgacagatcatcaagcattagattctcatgaggatcatgcaacctagattcctcgcatttgcagttcacaatagggttcatgctcctatgagaatctaatgctgccactgatctggcagacggtggagctcaggcagtaatgagagcgatagggagcagctgtaaatacagatgaagctttgctcacttgcccacccaccactcaaccgtggttcctaacaggctacagaccagtactggtgagtggctaggaggaaatgtggagtgactgttaatggttaccaggtttcttttggaggtgataaaaatgttctatagttgattgtggtaatggttgtgaaactctgaatatatgaaaaacaattgaattgtatacttcagtgaattgtactacatgtgaattacacattaataaagctgttatgaacaacaaataaatggaaagtcatctcatgttcatggatgacttaatattattaacatgtcagtactatccaaagtatctacagcttcagtgcaatgcctatgaaaatcccaatggcattttttgcacagttagaaaaagccacccaaaaaattcacgtggaatctcatggggccttgaatagtcaaaacattattattgaaaaagaagaaatttggaagcttcagacttcctgcttgttacagtaatcaaaaccttgtggtactgtcataaagacagacatacggaccaattgaatagacagtccagaaataaacccttaagtatatggttaaatgatttttttttcttttttgagacagagtttcgctcttgttgcccaggctagagtgcagtggtgcgatctcagctcactgcaacctccgcctcccaggttcaagtgattctcctgcctcagcctctcgagtagctgggactacaggcctgcaccaccatgcccgaccattgtttgtatttttagtagaaagggggtttcaccatgttgaccaggctggtcttgaactcctgacctgaagtgatccacctgtctcagcctcccaaagtgctgggattacaggcgtgggccactgtgcccagcccaatttttttttttttttttttaagacagtttctcactcttttgcccagtctggagtatggtggcatcatcatggctcactgcagtcttgacctcctgggctcatgcaatcctctcacctcagcctccagagtagttgggactacaggctcacactgccacacctgggtaattaatgaattttttttgtgtgtgtggaggcagggtcttgttatacctggtttcaaactcctggccttaagcaatccttccatcttggccttgcaaagtattgggattacaggtgtgagctactgaagctggctgggtaaatgatttttttgacaagtgtatcaagaccactcaatggagaaaggataatctcttcaacaaatgatattgggaaaattgggtatccacatgtaaaagaaggaagttagatctttaccttataccataaatgaagattaattaacctagattaaagacttaaacatattacataaaattatagaacatttagaagaaagcctttggggaaggccttcatgatcttggatttggcagtggtttcttggatatcacactaaaatcacatgttacagaacaaatgtagacaaatggaattcttgaaaattaaaaatttatgtgtatgaaaggacacagttaacagtaggcaacctatggaatgcagaaaaatatttgcaaattatatatctgataagggattagtatcctgagtatataaagaactcctacaaatcaacaaaaaatataacctgattttaaaaatggacagaagacttgtgtagatagttctctaaaggtgatatgaaaatggctaataaggctgggcgcaatggctcatgcctgtaatcccagcactttaggaggctgaggtgggtcaatcacttgaggtcaggagtttaagaccagcctggccaacatggcgaaactccatctctactaaaaatacaaaaaattagggttggtggtgcatgcctgtaatcccagccattcaggaggctgaggcaggggaatcgcttgaaccccggaggtgggggttgtggtgagctgagatcgcaccactgcactctagcctgggtgactgagacttcatctcaaaataaataaataaataaataaataaataaataaataaataaataaaaaggataacaaacatttgaaaagatgctcgaagtcactactcagaatagaaatgcaaataaaaaaatcagaggattatcacctcacactgattaggatggttaccatttaaaaaaacacacagaaaatagttgttaacaaggatttggagaaattagacccttgcgaactctcatgtgaatgtaaaatggtgcagcccttatggaatacaggatggcagtttctcaaaaaattaaggatagaaatatcatgttatccagcaataccaattctaggcatatatccaaaaaaatgaaggcaggatctctaagaggtatttgcgtgtccatgttcagagcagcattattcacaataacccaagaggtgggagtaagccaaatgtctttcagtggaggaatggataaacaaaatgtagtatatacataacaatggagtattattccaccttagaaaggatggaaatattgctgcaacacggatgaaccttgaggactttatgctaagggaaatattcagtcacaaaaagactcagtcgaagtatgtttccacttataggagatagctaactaaagtggtgaagtttatagaaacaaagtaagaaggtagttgccaggagctgaagggaggagagaaactgggaaagtgttgcttaatgggtatagggttttatttttgctagatgaaagttttggagatctattgcacagcagtgtgaatatatttaacactactgaattgcacactttaaaatggttaagatcgtaaattttgtgatgtgttttttaacattattaaaaattattttaaaaatccaactacataccaaattaaaaaaaaaataaccaaaagaaaacttaatacacataggccaggtgcggtggctcagacctgtaatcccaccactttcggaggccaaggtgggcagatcacctgaggtcaggagttcgagaccagcctggccaacatggcaaaaccccatctcttctaaaaatacaaaaattagctgggtgtggtggtgcacgcctgtaatcccagctacttgggaggctgaggtaggagaattgcttgagcccaggaagtggaggtggcagtgagctgagattgcgccatcgtacttcagtctgggagacagagctagactccatcttaaaaaacaaataacagtctcaagaaaaacaaaaaaacaaaaaaacaaaacaaaaaacaaaaaacaaaacttacatattagtagcagatggaagacttacaaagttgacttagagataaaaagcattactagtgtgaaagtgtcatataatgataaaaagtgaagtttatcagaggagataacttcaaattcaatgtatttaatattaaagcttcaaatatatgaaacaaaagttggtaaaacaaatccactgttgtaatttactctctaagtgatttactctctaagtaaacaaggcataatcagacaataaaaagtaatttcagaaacgttttgcctaagaattgcagagcattgttcttttttagtatatacatggtacttagacctccactggtatataaagtgaattccaaggcatttatattacacaaagcacattattagtggaattaaactggtgattttatttgttaatttttaaatatttttgtagagatgaggtctcactatgttgcctggctggtcttgaactcctggcctcaagagattctatggccttgccctcccaaagtgttgggattataggcatgccacactgcacctggtcaagctagtgattaataataataatataagtgaacgtaataaattcccatattccccaaaacaatgatatgtttttaaattaaacaactcagcattcaaagaagaaattaatggaaattagaaaatatgaattgaatggtaactaaagttaaaaagtgcagctaaggcaataggcttaaatgcaaatattaggaaaaacacttgaaattaatagtccaattaccaatattatcttgactttaattaaaaaaactcccccgacaggttgcagtgagcagagattgtgccactgcacttcaacctgggcgacagagcaagagtccatctcaaaaaaaaacaaaaaacaaaaactcccccaattctcaaagacagagcaaaagcatctcattcatgttacctgatattggctgtgggtcagctattacagctctgtatatttggttcttctccaattgtcttctcatttggggattaattccaaaacagcagttcctatacattacatgcttattcatgtggcagaggggaagaacaagaggcagagccaaatcttagttatatttgatgttgctgcttatatgtgctttatgtgcattttttatattccattgactatatggccaagcctatataggctggggaatatatattttttccttccatttggtatttattttttagtgatacataataattgtatatatttatgggatacatgtgatattttgatacatgcatacaatgtgtaatgatcaaattagggtaatttatatatctatcacctcaaacatttatcatttctttgtatttgaatggggaatatatatatacatacacacattatatatatacagaaacgtgtgtgtatacatatatatatatatatatatattttttttttaggggggttggtgacagagttttgctttgtctcccaggatggagttcagtggcatggatctcagctcactgcaaccaccgcctcctgggctcaagcagtgcttcagcctcctgagtagctgggactacaggcatgcaccaccaaacctggctaattttggaatatatattcttaaaaggcaggtgacagtgttgaatatgcataatcttctcttctggggaatatgaggattgaacaacataacagaatctgttatagcattgatctcaagaagttaggaaaagaattagcaatataaactcccataaaaaatatggaaggaaataaatagcagaatttaattaattatatctaacgcacaatagaggattaatcatatcaggacttaatttttcaaaaaggctagaattaagcttatcataacaaaaaaagaaaatagatattttacatggaatgcaagaggggatatagttactaaccatacagaaattttaaaatgtaattttagagcaataaatttgaacttttttataaagacagatttctagaaaagtatataacttcaaaatggagtggaaaagaaagtctagatagtgctatgacaatttaaaaatcttcaaactctataataacttcaaatatagatattttattaacatatctttttatgattggaatgaataatttcaggaatgcacaaatatttccagagaatagagctaataataagtcaaatatttgtggaaagggtagtggtgggggagaacacttatgagaagaacatatctttggtacctgagctgtacataagaaattagaattcatgagaacgtgaatgagagtcaggcattacctaggtataaaaaggctaaacagctgggcatggtggctcatgcctgtaatcccaaccttttgtgaggccaagccaggtggattacctgaggtcaggagttcaagaccagcctggccaccgtggtgaaatcctatctctactaaaaatacaaaattagccaggcatggtggtaggcacctgtagtccgagctacttgggaggctgaggcatgagaatcgcttgaacctgggaggcagttgcattgagccgagatcatgccacttcactccagcccgggtgacagagtgagactctcaaaaaataataataataatttaaaaaggtctaaacaatattttagtaaaccaaatatagcagttttttaaaaaacagataaccaagttgtgttcatttcaagatcatggattaattgtacataagaaaagttagtaaaggaaattcacattaacggattgaagaaagattgtgatcacttgaataaaaaagaaaaaaatagaagaaaataaagaaaaatatttgaggtgattgatatccccattaccctgatgtgatcattacacattgtatacaggtatcaaaatggcacatgtaccccagaagtatgtacaactaatatacatatatcagtttttttaagaagcataaaaagtccccaaaccagtaacagtctaggcattaaagaatatctgtaagtcaggcatagtgctgtgcacctgtagtcccagctattctagaggctaaggcaggaggatcccttgagcccaaaaattcagtgctgtagtgtgtgatgatcacagctgcgatgtagtgtgcacctgtgaatggccactgcactccagcctgggcaatatagtgaggcccatctcttaaaatagaagaaaagaatccataaagtagatttactaaatgcttgtaactgtataactgttaaaaaaaaaaacaaaaaaacagtataagatcgtgccattgcactccagcctgggcgacagagtgagactgtcacacacacacacacacaaaagattcagtatactgcttataagacatgaacaaactttttacaaaagaagaagtctaaatgactgagaacatgaaaagatgttcaacattattagtcaaggagatgaaaatatttcaatgaaatagttcataaaacttatattagcaatgttaagacatcagatggtaagtagagtttgggagtatttggagcaagaacctcaatctgtgggaataaaaaatggtaaaccatatgctatgatccaccatttccactcaggaatatattctcgagttgcattgtttagtagacattaaccacatgtagttattgagcccttgaaatgtggctagtccaaataggatgtgttttaaatgtaaaatactggattttgaagacttagtaacaaaaaggaatataaaatatctcaaattttaataattattgcatgtcgaaatagattatttaaaatgtacatcttgtatattttttgtagttatgggaaatttaagattacattgtgtttgtattggctggcactaccctggaggaatttagatgtgttcaccaggagcagtatgtaataatgtagcagaataattcattatagtcacaaattgaaaatatttgaagtatctatcagtagctgactatgtcatcattatagtagtgaaaagtagctatatagtagagaaaaaaatgattgccatacacatctttatgaatacatctagaaaacaatgctgaatgaaagaagtgagggttcatacacaatatgactccacaaaactcaagaacagatcaaatgaaacatgattttttaggtacacttaacgtatatagatggttgcataaagaaaaacctggaataattactacgtaagtcagaatttgttcattgtgggggctggggggaggtgtaggatcctcagaagtttctaaaatactaacagttgtgtttctggtagttgttacatgaatgcgttataagttgcacatgtatattttatgcattattctaggagacatatttcataacaatactaaaaggctagaattaaagggggatgggtagtacaaaagaggcaagccaaagctgatttatttacttcttgaagctgccacattgttgttccttggtctaaagtcaaggtaggttaattgtctctgtttttttttttggcagagtcttgctctgtcgcccaggctagagtgcagtggcgtgatctcggctcactgcaacctccgcctcccgggttcaagcgattctgctgcctcagcctcccaagtagctgggattacaggcatgcaccaccatgcctggctaatttttgtatttttagtagagatggagtttcatcatcttggccaggctggtcttgaactcctgacctcgtgatccacctgcctcggcctcccaaagtgctgggattacaggcatgagccaccgcacctggccaattgtctctgcttttttgcgtccagctatttgtcttcctttccagtggtctgcttgagtggtataaatctgtacagtattgaagactttgttaacataggatgtagagatcagacgtccattccaaaaatgtgctgataggcctttacatcttatcattggtatcattggctagcgtctgggctcatgagctcaggaatttcctggtccactatctcatgataccttcccctaactataaatgtttaatttgtatctacagaataagagagaaacacgttacaacgagttgctcagtattctatcctctgcccaagttgcttgtgtagaaactcaaatatgctaatgtgtttatctccaacattttaggaagaaccttcaaatttgaaacttatgaatcacatctgctagtcacttaatctcatcgttaggctcattgcatttacagtagtgaaatataccagttttgtccagtactacttatagtattatcaggtgaacttaacactcctcactggtggcctaaacatcagttcccagaatttttcttggaggtacttagctttgtggtatttgagagaacatttccagttgttagatgattgagaccatcagcaagcacgttgttgagaggttacactctcaacaagaaagcgtacctctagtggctttcttctgccttgacccagacagcattctggaattattggggtccttgagccttggaagactggatagctctcattcactttgactttgctgattacttcactctcttatgcagcattcccccttacaaatgaggcaagtccttacctgtatttatttcagatagtgaaaggaacttcagttgtggcagagtatttggtataaaggtggacatgctgtacacatttatcaggagatggctggcagacagaaacaatagcttcatactgacttgtcaagaggagagtcatgtaaacttcctgtctcctcaccaccacttgagctgaccttttctcattagagaagtgcaccaagttgagaacctgtctggcaaagcctgttcttgaccagcagtcaactatgtgcaagttccactgggagtgcagttctggaccaacacctaacttctgtgaatctcaggtggggatcattcttaccctgtccacctcatgaggttgtaaagaatttgaaaactgtaaaaaactgggcatatatgaagaaagaacaaagaccagatggttatgtgggaccagaaacaatgctacaaatggaggaaagaccaggaatttaaggaatgtagaagcttaggcagcctttacatagaaactgtgccatcaaagtacagtctgtggagttcttccaggtgccacagttccattattagtcctcttatgttgtatatttctttctttttttttttttttgagatggagtttcgctcttgttgcccaggctggagttcaatggcgcgatctctgctcactgcagcctctgcctcccgggttcaagctattcttctgcctcagccccccgagtatctgggattacaggcatgcgccaccacacctggctaattttgtatttttagtagagacggggtttctccatgtttctcaaactggtctcgaactcccaacctcaggtgatctgcccgccttggcctaccaaagtcctgggattacaggcgtgagccactgtgcctgggttatgttgtatatttcaaaatacaaaattcttttacactcttcctaacaccttactctgaaagacttctcagatcgctttcctttcatggacaacgtgagctctcaagttaactgtagtcactctctctttagaaatggttttgaactaaagttctttctgctggagagtcaagtgaatcaagagacctgattttagaggccaggcacggtggctcacgcctgtaatcccagcactttgggaggccgaggcaggctgatcatgaggtcaagagattgagaccatcctggccaacatggtgaaaccccatccctactaaaaatgtaaaaattagctgggtgtggtggcacacagctgtagtctcagctattcgggaggctgaggcaggagaatcacttgaacccgggaggtggaggttgcagtgagccaagatcatgccactgcactccgtgacagagcaagactccgtttcaaaaaaaagagacctgatttcaagttttgcctcattatgtaaattctagccataatcccttgcacaagttagtactatatttcaaatatggcagccttataataaattgactctgccagggattcattcattaacatatatttgagtgtctgctgtgtaccaaacaatgttggaagctgggaatttggtagtgaacatgactgacaattgaaaatacaatctctaaataattcaaaatggtggggtgggtggagctaattaaactggaaaatctaggcagaagagaactatcataattgaccactgaattcagttttgagcctcttgataaacaagagagaagaaatgtgctgagatatctcagtggaacagtggtgggggagagtgtgaatgaattaataagcagaaatatgagtatgatacattcaaatgtatgagtatattgcactcaaatattgaaacttggtataggtattggagaaatgacagtatctgaacatagataagttaaggcacagggtgtgtgtgtgtgtgtgtgtgtatctatattaatatgcttttaaagagtgaaaagtactagaacattttacatggtgatgggaacggtccagtgtaaagagagaatggaagatacagttgagagtagataatggggctaagttcctgaaaatacgagactagataggatttggagcatgtagtacagggtttctcaacctcagtactattaacatttcgaactaggtgattctttgttgtagaagctgtcttataaatcataggatggttagcattatctctagtctctacccacaagatgccagtagcatccccccaccccaatcccatgacaatgaaaaatgtatggtggaggtgtggacaaaatcaaaacccagttgagaaccacagaagtcagccattatttgtattcttgtccccttgtatgtaatgtgttgttttcccctctggctttcaagatttttactttaccattgattttcagcagttttactatgatgtgtcttggtttggttttctttgaatatatccaatttgaggttaactgaaacttttgaattagtaatttgatgtttttcatcaaatttgggcacatttcagtcattaattcttcaaatattttttatgttccttactcattttttacttgggaattcacttatagatatgttatactatttgataatatttcacaggtccttgaggttctttctgttttttttgttttgtttttttgagatattacccagactttttgtgaaatcctaggctcaagtgatcttcccacatcagcctcctgagtagctgggatttcaggtgtgagccgccatgcctggttctttctgttttctggaatatttatgttctatagattggactgtatttatcattctgtcttaaacttcactaatttttgtctaccattttcattctatttttaggcccgtccaagtaaaagtttttcagttctggaatttccattttttatagtttgcattttttgggctgcgatttcctatctattcacttattaagaccatgtttttcttctgtttcttcatatatatttataatagttgctttgaagtccttgtcttaaaatctgacatttgacatttgagagatcttgtgataacatttgagcgatctactgactgcttttttaccttgactatgggttacattttcctatttattttcactgctagtaatttttaaagttttatactgttcattatacatatgctgtagagattatagatgtcatcttcctctgaaggatgttgagttttttgttttattgggcgttgtaggctacacttggaattgtgtagacttattttactctttcgttaggttagatctgtggaaagcctctttaacttgacagaacttaacctccaaattctgtgtctcctctagatcttatgaggttttatattaggctttgctagtgagtctagagtaggtcttattctctagactcgagtgtggaccttattctgtagcatggcttcatttctaagctgtatcacacatgaatgcccaaagggttaatgagtagcttacaaagggtatccattcttaactgggcttgtatgctcaccatcccccagcactactggacctttagtatatctgttcagcttaaccacatagcagtcactttggggtatgtcttaggtagtcttatcctgaacatatgtgctctgcctccagccaaggacacacagcagcctgaccctcacatggacttattgcccccctcttccctgcatagattgtctccagcgctctattccacaggttccactgcttcaactgtactaaactctaaagcactaccttctcagctcagcaggacagttatactttgcttgggctgaagcttactgtgccatggttaggaaattgtacccagaaatagagctggagtgatcgtggagcccatcttgtgagctcttctctcagagatcacagtcttacattgcttttgttcaatccctaaaaatagttgtttcatagtcatatcagttttatggttatttacattaggaggcacaggctggtattggttgctccgtcatagccagaagcagaagaccatacccattacatcataaaattaaaaagtctgacaatattaagtcttggtaaagaagtggtgcaacatgaattcacacatcactattggtgttaaattaaattgttacaaccaactttagtattacttattaaagttgattgtttatgtatcctaagaagcatcagttccatttccacatgtacatatgtatacatgcatttttctaatacacatcagttccatttctagttatgtctatatgtgtacgtgtgtgtatcttttgtagagaaacttttgaatgtgtggactatgagacacatccatattgttaaatctaatagcttcattatgtctaaaatggtattatatatgttttgtatacagtggtatggtatttaacagtgaaataattggtatagaaatgaagatgattttaaaaacaatgccaatatagatcaaataagagaatggtaaaatggtgatagttgttgaaaccatgtgatgtgtatataggactttgttatactattctatttttgtatatgttagaaaaattccaaagtaaagaagttttaaaagtttggtggatgttagccatataatatatgcagaaaatatgattttattaatatacagttccaaaacaggggaaatgaaatatattgcatagggaaactttcaaaggtaataaatgaaagaacagttaggaaatcggtcttgctaaggtcaatatggtggtttttctggagagaaggaggggaatgggattgggcaggggcaaaaagggacttccaggatattggcagtgtcctattaacatagatggtagtagcatgtggtgttcattgtattaattttcataccatacacataggttttatacaagatatttcaaagcagaacagttatttaaaaatagctggatgaaagaattttgagagttttaggttggcataatcaagggaagcatcctagagaagcctagaacttaaaactaggtcctaaataacgaatattctatattataaaacatctgatctaggacccactgttatgcttagtattcctgaccaaaaataaaggacacagaagataacttccattgcaacacattctccttgatgacagtgtctatcccattggttcactcattcattcatctatccatttattcatttaacagatatttgagtagctgttaggtgctaagcatagtgataggcaatttgtgaacagtgttgaggagtgatggagtttccagtccccagattctttatgattctcagctttgttagctgggacgagagacctcttttgtatatttgctttgaggtgtgaactagttagccccaaacaactggctggcttctttcttgccctttttctaagatcgcctggtttctttgctcagatttctgtgacagagtctttccctttttctcactgctaagacagcgattgaaaaatttgctcttttatacattctttcaaaaagttctccccttgatgcatgcaagagttttgccttgattattaggcaatatttggatatatgtacaaaatcaaaacagagaataagtagtctagctagagaaggtagctggtgggtttgatttatgaaggggaacagtaaaaaagagaagttgaggacagaaagtagtatggggtgctctaagtgggtagattgcctcttaaataatgaaatctggatgtggttattgctagaacagtggctgaagaaaatcttgtgtttcaaagaaagtggattgaagagtactttttgtgacccagaattcaaaattaaaaacttataaagtcaataaatggaaaacaaatgagtttctgaagtgtcttcatcaaataatagaattatggccagtagtaaaaaaaagaaaaaagagttatggccagtaattacaatataatttataaagtttctagtcactccttcactgatagaatacagtaatatgtaagcacgaatgtgtttattaatagcctgttgatataatttatgaaaaaaatacagagtttacaacttttttttgaaattggctcctgagtaataaaaagtttcttgacattgattatctaatgagagctaagtatgtgaattatctaacagagttcaatattatttgggaataggttttagagcccttttaagttgaaaattgagaatgatcaaaacattcctaattctcttaaatcaccagtaaaatacgtatcactttatgcatagccttacaccttaatatgcatctaaagctgggcgcggtggcacatgcctgtaatcctagcactttgggaggctgaggcaggtagatcacctaagggcaggagtttgagaccagcctggccaacatggtgaagtccctctctactaaaaatataaaaaactagctgggcgtggtggtgggcgcctataaccccagctacttgggaggttgaggccggagaatctcttgaacctgggaggtggaggttgaagtgagccgagattgcaccattgcactccagtccagcctgggcaacaagagtgaaactctgtctcaaaaaaaaaaaagcttctaaatatatatgtagtaatgtagcaggatcatatttataaaataaagtattgaagtgcttgaattttgaagtacttgagcatatttataaagattctaatttgatgggtcttcctgtccatagtcatctttctctttagaagctgatttttttttaaattttattattttactttattttatttatttatttttgagatggagtctcattctgttgcccaggctggagcacagtggcggggtcttggctcattgcaacctccaccctcggggttcaagcaattctgctgcagcctcctgagtagctgggattataggtgctcaccacaatgcctggctaagttttgaatttttagtagagatggggtttcaccatgttggcctggctggtctcgaagtcctgacctcaagtaatccacctgccttggcctcccaaagtggtggagttacaggcatgagccactgcacctggccagaggctaatacttaaaataattctttctacttttagttgttatttccctatgcttttcaacatttttgaacatgaaaggatatggtaaaactatacttgtttgggcacttttcagtggtcaggacattatcgaaatgtattcatcctttcgttaggtttttctttctgtgcattaacattaggatttgattacatcaatgcatacattcattgagtagaatagcagtggcattgctggcccatttaaaaagtattattattgctaaacaagtataattgaatttctgtaagttaaatgttagcactacagtactctgaagattgggtaggtgaggtgggaccagattgcaaagtgtcttgaaagctttataggaatttagaataaagagcaattgcagtttttataaagaaagtggaatgatcaaaatagtggtttaataggtttatatatgtgaggcattaacctagatcagaataggggaggacagaagttgagttaaaaaacccacttatagtaatccaagggtgaaatgaagagctgaacaaaaggaatatcgtttattttctcaacattcattaataacctacgtgagaatgaaaaagtgccaaaattgggaagcgattttaaagaatctgttcataataccttgtgaaagaagtagggacattagcaaggaaaacctaggagagaatgatcttaagatcagatttggaaatgttgagttgattcatggtgtctatttatgtaaaatgtcttttgccctctctctaaatcctagagatgataagaaggccagaaatgtagattttggagtatttagtaaagaagggagacttaaagcaggaaaagtgattgaactttttaaggtattaaagaaaaggagagggaacaattgagacaggaagtccactagtggtaatttggaggaaaaaaataggtgtgggctgggcgcagtggctcacgcctgtaatcccagcattttgggaggcagaggcaggcggattacaaagtcaggagttcgagaccatcctggcctacatggtgaaaccctgtctctactaaaaatacaaaaattagccaggcatggtggtgcacacctgtactcccagctgttcaggaggctgaggcaggagaatcacttgaacccgggaggcggaggttgcagtgagccgagatcgtgccactgcactccagcctgggcgacagaccaagactccatctcaaaacaaaacaaaacaacaacaacaaaaaaggtgtggttattatatatagtttcactgaagaagccaagaaaataaatggtgtctgagattatgacccataaagggacacattctatctcaactatagctttaatttttttcttttttttttttttttcagacagggtctcaccctgttgtgcctaggctggaatgcagtggtgagatcatagcgtactgcagcctcaaactcctgggctcaagggagtcttctgtctcagcctccctagtagttggtactacaggcatgtgttaccacacctgactaattttttacttttttgtggagacagtgtctcactgtgttgctcatgctggtcttgaattcctggcctcaagtaatccttccacatcagcctcctgaagagctggaattatagatgtgagccactgcacccaaccagcttcatcttttttcccccactgacttcttattttaaggcagagaaaattgcttgaacccgagaagcagaagttgcagtgagccaagattgcgccactgcactccagcctgggcaagacagcaagactctgtcttgggaaaaaaaaataaatgaagaaatgtaaaataaaaaaataaaaatcccttactgctgaccaccttggacctaccatcagactgtaattcacattgacatgaatgggaagtgagaaagttgaagcaccaagggttctttcaagcaatttggctgaagggaaatccttgttgcttaagcttcttctttctagtcagaccaatatgagttgcagagaaatgtagactttgaaagacaatgccattttctcacttaatgttatgaatatttttctgtatcagtaatatgcatctatattttattccctccaagtcttcattttgaaatacttcaaaccttcagaaaagttacatacataatatgaggaatgccagtatattgttcacctagatttggcaaacatcttaccatatttcctttttttctatgtataaatatataggtgcatatatatacattttttcctgaatcatttgaaagttagttgtagacattatgtcagcttatcctaaaatacatcagcaagtatctcctaaaaacaagtacactctcctacataaccacaattatcaaaaacacaagaagtttaacattgatagaatgctattattgaatatgcagtttatatttacatttctccagttgtctcagttgtcctttataatttcttttatttttttctaagtcaattccagacaggaatcacacattgccttgagagtcatataattttaatgttctttcatttagaatagttgtgctgcctttttttttctttttggctattcatgacattgatgtttttcaagagttcaggccagttgttttgtccttcagtttggatttgcccgatatctttatatgattagcttcaggttaagattttttttttttaaggtggagtctcgctctgtcacccaggctggagtgcaatggcgtgatctcggctcactgcaggctctgcctcccgagttcaagtgattctcctgcctcagcctcctgagtagctgggattacaggcatgcactaccatgtctggctaattttctgtattttcagtagagacaaggtttcaccatgttggccaggttggtctcgaactccagacctcaagtgatctgcccaccttggcctcccaaagtgctgggattacaggtgtgagccaccgcgcccagccaggttaagtatttttgacaagaacattacataggcaatgtgccttgtttagtatatgctctccagagacatgtgatgtcagttacaaaatttgatgtggttagaattggtgatttggtcatttggttatgatgatatctaccagatttgctcactgtaaatgtaccttttctcttttgtaattaataaatgatccttggagtgatattttaaaactgtgttccccaacagtctttattcagtattttagcttccattggtgatttttgcttgaatcagctattatgcttattataagatggtgatttttttttttttttgaggtggactctcgctctgtccccaggctggagtgcagtggcgcaatctcggctcactgaaacctccacctcccgggttcaagcgattctcctgccttagcctcccgagtagcttggactacaggcgcataccaccacgcccagctaatttttgtattttcagtagagacgaggtttcaccatgttggccaggatggtctcgaactcctgacctcgtgatccacctgcctcggcctcccaaagtgctgagattacaggtgtgagccactgcgcccggccaacatggtgatttttatttattttttatttttttattttttaggttaatgttttttattttttatttttatttttttatttagatggtgatttttaaatttgttattccctatatgtctgttagtattcttctataaagaagaactttcctctccacttcatttttttatttttatattttaattttctccctttttagtgatagtatggactccaacatggatttctatccattcttgtcctcattcattttgatgttcagaatatctcaaacctagtcaggttagagctctctcaagatggttcctgcttataaccagcatgttgtcatctgttcagcacatttatattttatggcacaacaaagtggtcttgttgccctcttccttttttacttttgttttttaattgtgataaaacacacaacaggatttattattttacagttttaagtttacaattttggtttgccttttttttttttttttttttttttttgagatggagttttgctcttgtcacccaggctggagtgcaatggtgtaaccttggctcactgcaacctccacctcctgggttcaagcgattctcctgtctcagcctccccagtagctgggattacaggtgcccgccagcacacccagctcatttttgtatttttagtagagacggggtgtcactatgttggccaggctggtcttgaactcctgacctcagctgatccgcctgcctcgacctcccaaagtgttgggattacaggcatgaaccaccacgcctggccttggtttgccatttatttatttatttatttatttatttatttatttatttatgagacagactctcagtctgtcgcccaggctggagtgcagtggcgcgatcttggctcactgcaacttccgcctcccggattcaagcgattcttctgcctcagccacggactacaggcgtgcaccaccacgcctggctaatttttgtacttttagtagagatggggtttcaccattttggccaggctggcctcgaattcctgacctcgtgatccatccgccttggcctcccaaagtgctggaattacaggcatgagccacagtgcctggccagtttgccttttaaaatgtggtcttccctggtttatccctggcctacttctcttattattttgatagcttgtctagaaatgatagactctattcttaagttttgggtttttatttattaactgtatgctaatgactcccttgtgtctttgtgggactctagaactatattaccggtagcctactaaattctccagttatttgtcttatgtttcataggcatcttttttatattctgtctctcattttaaaaaatgaaagaaaacccaccccaaacctatattttttattttgcttggatgccttaggaatccccatccacttatcgtaacttctaacatgcagtttgtcactaggtcctatcagtcctttcatattcattcctactgccatgcgtcatctctctatagaagttttataggatgttcttggctctagttcattctctttctagcttaactcttgtcagagtagtctttcctccttatttctcatttcattttttttccctagcaaattagataatttactacaagtccaagaagcagttcttgattttaggcaaggctttgtataagacaccaaagaaagactttgcttttctttacccctatctttggtgtactttgctctgtgttagcttcattttcagttacgctttctctgagtgggagcaacagtggccattgatggtttcaggctttcattattttcaaagtaaatgattccaaggaaaatccttcatccttctaaaatccttcatcatcgtaaaatataaatatgattatttctctgtttttcttaattctattcagtggttcctcacccccttcaggataaagttcaaattctttggcaagcaagaattcatgaattcttgatttggcttttacatattttcattgtcctgttgctctctgctttaaaatttgtatccataaataccaagttgcatgtgcagtttcctctgcctgcagtggcttttcacattgtttacttgccaaattcattatcttttagctaaataaaccccagttcagatattactcttccaggaaaatcttatttgataaattttgtgctcaatcccagaaaaattactctcctgttctacctttgcaccacatatgtatgtttgtttttgacttatactgaattgtaatctgtttacaaaattttattttttttgagacggagttttttgctctgtcacccaagttggagtgcaatggtgtgatctcggctcactgcaacctccgtctcctgggttcaagcagttctcctacctcagcctcctgagtagctgggactacaggcgcccaccaccacgcccagctaatttttatatttttaatagagatgaggtttcactatgttggctaggctcctctcgaactcttgacatcaggtgatccacctgccttagccttgcaaagtgctgggattactggtgtgagccactgtgcccaggctacaaatttttttatatccattagatcattaaatctctttggtccctttttgaacaaggcaaggtataaatttattaaaaataacaacaacaacaaaaacaaaaaccaaaattaggctttggttgtgcatccagttgtggtagactggctaattcagatgaaccctattgctgagaacagctgaaaaagtaggtttaaaaaatctgtgtgaaggcacagtagagggccaagacagtaaaacatcatgtggtcaaaatctggaaagagagtcggaagccagcggccgtggaccacgcggagccgccagcccggggcatgttctgagacttcagggaacccggcccgagctccgggaatggcgtgggtatggcgaccccgcgcagccccccggccgcagtgcaggcagcccagcagaagttccacctcgtgccaaggatcagcaacatgagtggcagtgaggagctgcagtggatggtacagcttcattttctggggcccagcagttgccccaggcctctgacctacccttagtccagccccctacaaccccagccaggagccatccgggccctggggccgcctccagtggtgtgtccaaggccttgtgaacagatcagcccggaggaagaggagcgccgccgagtaaggcccgagcggaacaagctggctgcggccaagtgtaggaactggaggaaggaactgactgacttcctgcaggcggagactgataaactggaagatgagaaatcagggctgcagcgagagatcgaggagctgcagaagcagaaggagcgcctggagctggtgctggaagcccactgacccatctgcaaaatccccgaaggagccaaggaggggtacacaggcggtaccagcggcaccagcagcccgccagccccctgccgccctgtaccttgtatctccctttccccagggcctgtgcttgaacctgcggcactgcacacccccaagctcatgaccacaccctccctaactcctttcacccccagcctggtcttcacctaccccagcactcctgagccctgtgcctcagctcatcacaagagtagcagcagcagcggagacccatcctctgacccccttggctctccaaccctcctcgctttgtgaggcacccgagccttactccctgcaggtgccaccctaagcaacgtctgctccccttcccccaccagtccagctggcctggacagtatcccatacccaactccagcagctgcttctccatccctctaatgagactaaccatattgtgcttcacagtagagccagcttggggccaccaaagctgcccattgtttctctagagctggcctctctagcacaatttgcactaaatcagagacaaaatatttcccatttctgccggaggaatcctggaagcccagagactttgtagatccttagaggtcctctggagccctaaccccttccagatcactgccacactctccatcaccctcttcctgtgatccaaccctacccccgtgacagaaggtgccactttacccacctagaacaccaactcaccagccccactgccagcagcagcaggtgattggaccaggccattctgccgccccctcctgaaccgcacagcttgggaggtgcccatggcttctgtgatgagctgatctgcagatctcagctttgagaagccttcagctccagggaatccaagcctccacagtgagagcagctgctatttattttcctaaagagagtatttttatacaaacctaccaaaatggaataaaaggcttgaagctaaaaaaaaaaaaaaaaaaaaaaaaactggaaagagaagaaaacctagagaaataaggctggcatttgggtcttcatttccctcagactcatctgccagttccatcctaagcctcaagcttttagtaatagtgtctgatcctcaaaaaataattaggaatattagaagacaatatgatatgatagaaaaaaaacaaaagaaacaacaggaaatagaaacagacccctagtgatccagaaaatagagttatcaagcagactttgtttttaataagttaaaaaataaaagataagatggagaatttcagtatagagccagaaactttaaaaaataatcaagtggaaattttagaaatacaaaatatgataatcaagtgcaatgggtaggcttaatagtagatcaggacagtgaagagataattattaaactggaagatggatcaaaagaaaaatccagagtgaagcattgagcaaaaagatggaaaatacagaaaagggtgtaagagacatagtctaacacatatcattggatcctccaatgggggaagagagagagaataaagcgtaagtaatatttgaagagattatgggtaagaattttccaaaactgatgaaagacaccaaaggacagattctagtcctaaaaacttcaaagaagataaatacagagaaaacctcatcaagaccatataaaacaactgaaaacaaaagctggataaaaaggacagattacaagcattaatagtaagacttacagctaacttctcagtagaaataatggaggtgagggaacaaagggatgatgtagttacagtgcctgaaagaaagggaaaatagtgttcaagaattaaggtaaacaaataagtgaattgtacgcttaaataggtgaatttatgagatgtaaaataaagctctaaataaacctgtataaaaatgaaggtaaaatagagatattatcagagaaatgaaaactatgaaaatttatttgcagcagatctgctttaaagaaaatactaaagggaatttttcaggcagaggacaatgattccagaaagaaggttggagatgcaggaagaaatgaagagcaatgggaagggtaaatatgtgtatatatttaaataaatagtggcaataaacacaacaacgctggtgtaactctatttactctatcaggcaaagtaggtttttaaggcaaaacttattcaagatataaagatggatattttataatcatgacaagtttcattgccttagaagatataatatttctaaatttgtgtgcatctaataatgtagcttcaaagtacataaaatttgcaggcaaataggtgcattcataatcatagtgggagattgtaacacacacctttcgtataaagaaaggtgtaagatggagcaatcagaaccaaaaaatcagtaaggttatacaaaatgtgaatgcagtttagaaaagtgaattccagatggattatagttctaaacgtgaaacacaaaataataaaacttatagaaataatagctcagtaatatttcagtggggaagatttattgaacaggaagcacaatgaaggaaatgattgataaattgcactacattaaaggacttcttttcatcaagatactataagagaataaaaaggcaagttaaaaaagtgtcaaaaagtatttacaatattttataaagaactcttacaaatcaataagagaaagacaaccctatagaaaaatgagcaatagtattgaatagtcatctcaacaaaagaagctatccaaatcagcaaatatactcaagcttttcagcctcattagtaatcagagagatacaaattaaagctgcagtgagataacacatatacctaccaggatgactacattaaaagctttttctgaatatttattttgagatatttatagattcacaggaagttgcaaaaagtgtacagagaggtactgtgtaccgtcacttcccttcaaaagtcacatcttatatataactatatatacatcttatgtaactatagcacaatgctgggcaaggtagctcatgcctgtaatcccagctgttctggaggctgaggcaggaggattgcttgaggccaggagttcaagaccagtgtgggcaacatagtgagacttcatctcttaaaaaaaaaattaaaaaaaaaaattagcctgtcatggtggcatgcacctgtagtgccagctacaggttgaggtgggaagatcacctgggcccaggagttcaaggctacagagagctgtggtcgtaccactgcgttccagtctgggcaacagagcaagaccctgtctctagggaaaaaaaaaaaaaaggaaatatgttgtgtaatattaaaacaagaaaatagacatttcttatcacaaatgtatgtgtatagttttgtgccattttatcacatgtagattcatataactatcaccacagtcaagacactgaactgtattattaccacaaagttctccctgtgctctctaaagttacccctttagagtctaacccacctgcctcacctccactatccctaacccctggcaaccactaatctgttcttcatctctataattttgtcattttgagaatgttacatgatggaatcacacatttcttagagcaattttagattcatagcaaaattgagcagaagatagattttccatagatcctcttcccctacacaagcatagcctcccgtattgtcaacatcccctaccacagtggtacatttgttgcagttcatgaacctacctagatgcatcattctcactaaaagtttatagtttacattagggttcattcttgttcaaatggctaaattttgagactgaaaataccacacattggtgcagatgtagatcaacaggaactttaatatactgctaatggggataaaaataggtacagccactgtgaaaaactggcattttctactaaggctaaatagaaacctactgctcaattcagcaattccactcctaagtaaatatccaacaaaaatttgtgtccctgttccccaaaagaagtttttgtaaaaacgtatttataggaatttgtttgtaatagctataatctgagaaaggacccaaatgctcatcaatagcagaatggatttcttaaaaacttgcagtgtattcatatggtaggatagagcaagggtagacaaatatagtaaatatcttagactttgtgggtcatacgttgtctgtggtcatacattgtctacctaactgcagttgtagcaatgaagtagtcataggcaatatgtaaacaaatgagtgtggttatgttccaacacagccatttataaaaacaggctttagcctttgggcctgtagtttgctgacctctgctgtagagccacaaactgtggttacatgcacgtacatggatcagtctcataaacataattttgcatgaaagaaaccatgtggtgtaattcaatttttataaagttcagaaacatgcaaaacacctactgtattgaaggtgtatgagctattttgggggagaaagaggagatcctgaccagaagggacatgaaaaggaagcttctagggtgctaataattgctttacctgaatggtgattaagtctgtttaccttcgattattcattgagatatatacttatgatttgtacacttcttgtgtgtgtgtgtgtgtgtatgttatacattaatgaattagttaaaaataaaaataaacaaaaacatacacaacttgtgtttccatcagggtagaattgtgttatttatctctggcatgtagtaaacatacaataattatttatagaattgggagttgctaatagcaagctctgtagcaagataaaggacaagaggagtgagcaatgattctgatttagcctgaagagcttattgaaaacttttgaggaagaaatgttgataaatatacattttgatgtaattaaaggtactttagtgaaaaaagatcataatctaaaaggctaacattgggatttaataaatggtttgagctgacaagtgacttcatctttgaagacagaaggaaaagattcttttgttattaagagcaagctacaactattttgtaatgatatttaatttccttcctgttttaaatttgcttcaacccgaaaaattctttcttatgttttttacttgcttaaacccgctttggatgttgccctgtaaagattcatgtacccattagtaccatgtggagtagatgtgatatagggttttattgggaaaaacttagaagaaatagtggagtgtaagcagtccctcaaactccttttttatctcacagtttaggccagacatagagggtctttatggttcacctgggtgaaccatagggttcaacctttagggttcaacctttaagttcacctgtggccaagtgaacttccagtagagaatgacctctaccctctgtaatgctccacacatttgtaggtcagggccggaaacacttaagtgactatgcaatagtagttacaaaggggaagcctccagaaccccagaggcagggaggggtctattcttcctttgagctaacaactcaaatatactgagtctctttgctgcagctatccagggccatccagatttatctttatcacatgcatcccattattataaaacaaagtgaaatcttcttgacccagtattaaaggtcttctagtagctttctccaacttcctcatcagtcctctttgccactggttctacacagattttcttagtcacttaattactttgtaataaacacattgctttttccaagcttcttatctttgctctcattacctatttagaatgtttctccctttctctaaattctcatccttcaagaggtgcttttgtcccatctctcctgtgatggcttcctgatgatcgtaattcttacaccaatatcgctcttcacatactacctaatattatttatttttatgtgttcatttcttccttttcatctaacatataaattccttaatggtagggaacatgtattagattactttgtaacgtctgtaatacctggtagtcttgtatgtaaatgctcaacaaataattaatgattagtatgtgtggtcttataatgttttttaattataaaatcattataatattttagggtgttatatgcctcttagattctgaatgttgttattaagtataatgctagactctttattagaacgtctttttcactccattgtaattaatccctgttttagaagttcatttttttgaggttggtatcaattattgtctgttggttactctgttagccagtttagtaattagattcctccattctacttcagcaagaagttgagaactttaagaagctaaatctcattagtaaagagcagtttgaaaacctaacacctgaacttccttttgagccaaaccaagaagttcctgtagcaccttcacagtccaggcaaggtatgtaaatctgcttttgtgtaagtgtctgaatagtattaaagcagttctgaattgtttttaaaaattgctccttttttttctttatttgtggaaaatcattaggtaaatggtaaaatgctagaattttaaaactcaacttttatccttttgtgaacttctattatcacaccagattatgctcaaagccagaggcttacttagaagtaggcagaatttgttggttctttatgtatctgatgtgattttaagattgctgggaatgtttctcttcccaaaataaaatttttcactgactcactgatccttagaatgcgctagagtcattcttttgttttaagggcttagctctgtgtgagagtgtaaataaatacattgggagatccataaattgaatctgacatttcagacaagtataactgattttattatagccttttcctgaaggtggttaaaaaaatgatttataaaaagtcacacatatacaaagatagagtgaattttataataaaactcccatgtacctgctatacttaatcatctcatacccaattttgtctcgactccagtaactcctatacctccctgtggattatttttaaacaaattctcaatcacatgattcatatttttttgtccttaaagatttctgtatgtgtctttaaaaagataagggctatatcttttaacacataaatagcaggacattatcatatctaaaattaacagtaattccttaacgttagatatctagtgttcaaatttcctcattcatcactttttttttccagtttcttcaaatagattgcaatagattgatatgtcttttttagtctacaggtttctactattttttgccttataatttattggtccttgcaatttggtattgaagaaactgggttgtttgtcttgtagaatttttcacattctgaattttgctgattgcatccccatggtttcatttaacctgttttctagtcctgaattatctataactgttagttcagcatagagacttgattagattaagactcaaatctctgtaagaatatgtcatatgtagtattgaatactattaggagatacataatgctctattgtctctttttgtaatgttagcagtcattgatgatcagtgagtgaagcttttattttactaggggttgcaaaatagtgatgattctatttttaatcattacgtcttaccttaataggtagaatacttttataaagagaactttccccagaatatttatttattctgagatagagttcttacaggaaagtgagtcagtgctgaattatttccctttgtttactagtttcaaagtactagctggttccttaacattcttcgctggtgactaatgaagtttttgtttgtttgtttttaaatgatcattgtgaactcataaatacatgagatgggtttcattctattacagttattattattattattgatacctatgccagttatcagtttattgacttttagctctaaagccacctttcattttcttgctcagtaataatggagttggactgttaactttaatgtttcccaccccacagaaggttgagcccccaccaaggttgagctttgtcagtaccggatctgctactcagttggtccttgtttctaggccttttgaatagaaagagctaggaaattttttaaggagaaaaatatattacgtattcatgttgatattttctgtctaaatttaagattataggttttaattttaatttctttgattttgtagttgtattgctttttacttatatataaaaaatctttcttcctaaccacagtaacataattatttatttgctaatcctatgatataatagttccagaataacaataacattaaataataatattataaatactgaaaggtaacttcttttagagttctttaaactgtaaacttttaaaaacttcatactttaaagctttctttaaagttcttagtgtgtcccactagggctgttcagttaaattgctggattttttgccttgttaaatttgaatactttaaaattgagaatgtatattcctttgcacatcatagaaagcatacaagtcacaaataaggagataaatttggcattgcatgacattaacaaagaattaatatcatagaaatctaaaaccttaaaaattaatatgaaaaatggcaaacatgaatagaaaaagtagtaaatgaaacatgaacatcagtttcatatttgggaagaccaaatggccaataaatatgaaaagaggctatttttactgaggttttccaattaaaaccatagcaatacgccatattataacccagcagtttcatttcaagagatactgttgcaggccattgtggctcatgcctataatcccaacacttcgggaggccaaggcaggaggatcacttgagcccaggagtttgagaccagcctgggcatactgttgcaaatgtttaccaagagaacatttgtagtatcattgttcataatagaaaaaagcaaatgaaaactaaaaaatgcccagttatagtagaatgtattataagatgtggtgtagtcatacgtaggaaaaataggcagcagtggaaaatgaaagaactaatgttacatgtgacaaaatgtgttaatctaaaaatataggaaaaaataaaaaaataaaaaagggatgtataaaataagctagaacaaagaagttcattcagtgtaatgctattacataaagtataaaattcatggatagatgcatagcacataggagccatgaagagaagcaaggggaattattaatataaaaaattaatatattaatttactcctgagggtgggggaaatcccatctggaaggtctgcacatgtgtttgctagcatctggaatttatgtatgtattggtctagttggtcggtatgagtgtgtatcagctctattttaaaatttatatataaatttattaatttttatttgtgtgctataatgtctagtttttaaatatatgaacagaaaaatataaaaataaagcaaaaatttaaaagatagaatttgaccaatatattgctatgacaggaaatgttgaatagattaatgttcaaattaaaagataattttaatctttaaattaattggacttaaaaaaattcactctatgctagttatatgtcataacatatggaaagattggaaggtaaaggatgggaaatcatataaaagaatgatcctaatagaaaagagttggtattgctattacgatatagaatttaaggcataaagaaggagtttattttcactgtcttcagtatctatattcctatttattccctatacctgctccaaacaggcctctgtcctccacatcccaaatcagctactgataataccaccagaaatctccatatataagaggggtcaaatcagtcctcatcttacctgacatcagcattagatcaaattaatcgctctgtcctgaaacacatttttacttcctggatacttattcacttattctccttctgcctcatagagtcttttttgctagttcttcagtgtttccctaacttctaaaatttggaagctttaggacccagtcctcaaatttctcctcttttgaatcctcaataactccttgtgtaatagcatcaagtctcatgggttttaaagagcattattatactaatgagtatcaaattaatatgtatagaccagacctccatcctgtatttcagacaaatattcaactgtgtggttaacagtaccacttgtatattttataagcatgttaaatatcatatgtccaaaatctaagttctgaattcccacccctctccaaggactcttcctcctagacttccacatctctaaatattacctccatttttccagttgcacaggtcaaaacgtttgtgtcatttttgatccatttgttttttaaattccgtatcttatttattggaaagttatattcatatatatttaaaatatatctagaatctaaccacttctcactttctccatctctatcaccctgtaaaagtcaccagcgttttctccttggttaattgtaatgaactcctagcctgtctccctcctttcattctgatcaccctacaaatatccagttatattttttgtttcctcttaaaaatatatataaggtgtacaacatgatgttttgatatatatatagtgtaatggttacaatagttaagcaaatgaacatattcattatctcacatagttacctttttttgtggcaagagcacctaaaatctctcttagcaaaaataccaaatataatataatgttattagctatggccctcaggttgtacattagatctctagacttatctatcctacatatctgcaacttggtatttttttacctacatctccccattctccttcatcccacccttggtaactactgttttattatctacatctatatacttttttttttaaagattctatatataagtgacattatgaagtatttttctttctgtgtctggcttatttcatttagcataatgtcctccagtttcatccatgttgtagcaaatggcaggatctccttttttaaaggcttaattatattctattctctctctctctctctctctctctctctctctctctctctatatatatatatatatatatatacacacacacatatatatacatatatacatacacacgtgtgtacgtatatatacacacacacacacatatacacacacacacacatcaccatttctctgtttatcataagtggactcatactttagttgttcccatatcttatatcttggctgttgtgaataatgtggcaatggacatgtgagtgcagatagatatctttctatggtgatgatttcatttcctttgggtatatatataaggtgtacccagaagagggactgttgggtcatatggtaattctacttttaatttctttacaaatctccatactgttttccacaatggctgcaccagtgcaccttttcatatacctgttggcattgttatgtcttctttggagagatctctaatcaggtcttttgcccatgttttaattggattatttgcattcttgctattgagttgtctgagttacttatgtattttggatataactcctaatcagatgtgtggtttgcaaatgttttttcttattctgtaggttgtctgttcactctgttgattgtttcctttgctgtgcagaagcagctttttcatttgatgccatgtttgtttatttttgcttttgttgcctgagctttgtgggtcatatttttaaaaaaattaagatatagtttacattcagtaagtttcacaccatttatgtatattattttgggaactttgacagatgaatgcaatcatgtaaacaccacctagttaagttactgaacatttccattgctccctgagaatttttccatgcctctttgtattcaacccaggccaagtttttggcagtttgttttctattttctatccctatagttttgccatttctagaatgtcatataaatagaatcatataaaatacagacttttgagtctggctcctttcatttagcctagtgcctttcagatttattcatgcttttgtgtgtattacctttttattgacaagtagtattccattgcatggatgtaaacagtttatttatccacttattagttgaaggcatataggttgtgttcctgtttttggtgattatgaataaagctgctatgagtatcaagttgctatgtgaatatatgttttcatttcacttgggtaaatgcttttgagggcactgttggatcatacagtaagtataactttttaagaaactgtctaacttttccaaagtggttgtgccattttacgttcttaccaacaatatatgagggttccagttgctctacatcatcaccagcatttagtattgttagttttttttttaaaaaattttgcccatctaatagtagtatctcattgtgactgatgctgttgagtatctttttatgtgcttatttgccatcagtttatgcttggtaaagtgcctgctcaaatctttggacatttcttttattgagttgtttcttttgttactgagctttgagagttctttactctggatacaagtcctttgttacatatgtacatatgtaatttgcacatatcttctcagaacctggggcttatattttcattttttaggtatatcttttgggccagttgcagtggctcacgtcatgtggcttgtcttaattagtctgtttgtgttgtaaagtacattgattggttttcaaatgttgaactagtcttggattctcaggataagcctcatttagttattatattatccttttatatattgttagactcaggttgcttacatattttttgaagccttttgtactatattcatgaggaatattgtttttttttttcattgtcttggattatatttgtctgattttggtgtcagaggaatgctggcgtcataaaatgagttggtaagtgttccttcttttgtattttggaagagtttgtccacaattgtttatttcttacacattggtagcattcccaagtgatgccatctgggcctggaactattggaatgttttaaactacacatttatttatttaagaaacataagactaagtaagtcttttttctcaggtgagcttttgtacctattgaatttattcatttcctggaatttataatatgctctttttctccttttactgttcgtaggttctgtagagatatctcttctttcattcctactatttataaatttgtgtcttttttgtcttgatcgatctagctagaggttcatcagtttaatttttttaagttttattttcattgatttactttatttttattccaggtttattaatttttgctccttattatttccttttttcttattttgttcctccttttctagtttgagtggaagcttagatcatttatttgacaccatttttctttcctattataaccatttaatactacaaatttccacctaagcagtattttaggtgttattgtattttgattttcattcagttctatatattttctaatttctttttaattttttgatacatcagctatttagaagtgtttttgtttaatttttaaaatttggatatcttcctgaaatctatttttttgaaatctaatttttaagggagagtttaaattattgatttgagagtttcttttctgatataagcatttaatattctctctctatctctatttctatctttatctctatctatctatatatttttttaagacagaatctcggagtctcgccctgtcgcccaggctggagtgcagtggtacaatctcggctcactgccacctctgcctcctgagttcaagcgattctcctgcctcagcctcctaagtagctgggattacaggtctgtgccaccacacctggctaatttttgtatttttagtaaagaccaggtttcaccacgttggccaggccggtctcaaactcctggcctcaaatgatccacccacctcggcctcccaaagtgctgggattacaggcatgagccatgagcacagcccttaattctatgtatttttatttaagcactgatttagctgcattccacaaatttgatatgctgtattttattaatttttattcttttcaaaacattttctaaattcttttgagacttcctctttatggattatttaggagtgtattcggtgtaatttccaagtgattggaattttttcagttacccctctgttattaatcttattgatatatagtttaattatattatagccagagaacatactttacattattttaaaatttaaaattaatttgttaatttcaaatttgtttaattaatttgctaattttatcacccacaatatagtctgtcttggtgaatatgccatatgcatctgagaagaatgtttattacactatttttgagtagaatgttccatattgtctgttcaattcagttggttaatggtgttgatgagttctatatctttgctgattttttgtctactggttctgtcttactgagagaggagtgttgaagtcaccacctataattgcagacttgtttatttcctatttcagttctgttgtattttgctttatttatttagaagctcttttgttagttcaccttatacccattggtatattgtgtcatcttggtgaattggccctttcattcatatatgttgtccttgtttgctttgaaatttagtttgtctgattttaatatagccattccagctttctttcatttctttctcatggtatgtgatgtatcttttgccaactttttacttttaacgtacccatatcattatatttgaagtcagtttattatagatagcatatagttagttcatgttttttattcagtctgacagtatatcttttaattggtatgttttgactaatgtaattattggtatgtttggatttaggtcaacctttttattattcattttctttttcttttctttttttttttttttttggcttctattgcccattttgtgcattctttgtgttgtttgtaactttttccattacattttaatttatgtactatgaatttggacatatatatctttttttgtataattgtttttagtgattgctctaggggttgcaaaacacatacttttcagtttatttggaatcagtattttaccatttcaataagaatgtagaaacctaacctccatagagattttttttttttcctttctctccccaccggccccaccccaagagatagggtctcactctgttgccaaggctggagtgcagtggtctagtcatggctcactgcagcctcatactgctgggttcaagcaatcctaccacctcagcctcccgagtaggtcggactacaggtgcacgccacaaagcccaactaatttttttattttttgtggagacagggtctcactacattgaccagattggtctagtactgctggctggcctcaagagattctcctacctcagcctcccaaagtgctgggattataggcatgaatcaccacactcagctgaaatttctttatgtaataattgtcttatatatcttcatatgttaaaaagcccatcagacaatgtttgattgtctttcaagcgtgttttactttcaagcgtgttttaaataacttaaaaggagaatagtctattatatttatctggacctttaccgtttatcttgctgttcctctatttgtgatgtttcaggtttcctttgttatcattttcttctgtctgaaatactcaggttagcaattcttttagagcagttcagttggctatgatttatagttttctttcttctgagaatgtctttatttcacctcattgccaaggatattttcactggataaagaattctgaactgacaattgttttctgttagtgattcaaaactgttgtaccactcctttctgtcctccatggtttttggtataataatttatagtcattcaaattgtttccctacaagtaatgcatctctagctactttcaagattttttttttttttcatctgacatttacagcaaatagagtgtgatgtgccttggtatggagttctttgggtttatcctggatgggattctctgtttcttaaatctgtaggtttgactttagacaaatttgggaagttctcagctattatttcctcaaaaaaaatttttagccctgcatttcttctctcctagaccttttgttgtctcacaggttcttaaggattggctgattattttttttcaatttctttttttttctgttgttgaggttgcttttctgttttcggttcaatttctgttgattctggctgcttttaatgtttcctctgtcacctattttaagcaccttaattacgattgctttggtgtacttttcatgtttcttgtgcttgaactcactggatttttaaaatatgtgtgtttatacatttttaatcaaatttggaaagtgttcagctgttcctttaaatttaaaattttaattaaaaaattaataggctgggtgtggcagctcatgcctataatcccagcactttgggaggccaaggcgggtgtatcacctgaggtcaggagttcgagaccagcctggccaacatggtgaaaccccatctctactaaaaatacaaaaattcgctgggtgtggtggcgcacacctataatccaaggtacttgggaggctgaggcacgagaatcacttgaacccgggaggtagaggttgcggtgagccaagatcaaaccactgcattccagcctgggtgacagagtcagactctgtcttaaaaaaaaaaagaaaagaaaattaataatgttttcttgttacttttttctctttctctcaagactccaattacatttaaaatttatattagggcacttgaagttgtcccatacttcactaatgctctgttttgttgttgttgtttttcagtccttttactctgtttttgttttaggtaacttttattcctctcttcaagtttattagccttttcttctacagagtctatttttaatcccatccaatgtgtgtgtgtgtgtgtgtgtgtgtgtgtgtgtgtatgtgtatgttttaaaatctcagctgttgtccttttctcatctagaagcttgattgggttctcttttatactgcctatatatatattttaatatgcttatgtttttctgtgctttattgaatacacaaaatatagttatgattttgtttttttgctagcaaagtgtgaatccaggatttggattcatatctatctgaccgctatagttcagtggccagcaaattgtggcccattggctgaaactagcctgccacgggccaatgtgataacgctggtcatttacatatggcctctcgctgtttttatgctacaaaagcagagctgagctgtttcaacagagaccttatgtcttgaaaagccaaaaatatttactatctaacatttgtaggaaaagtttgctgagttctgctttagaggcatttttatttataaaaaacctgaagtgccagttctcatgtagcatttttaatttttgacgttcactaaacactaacagcataatattgagttttatttttataaaggcagtagagactgcagacaaggctcatatggttcaggtatgaagctgtgcaatgatctgatttggtagtgataaaatttggaaaatcttagatagtaaaatagttagcacaccccttcagtggtttttacatttagcatgtttaaggttcacctggaaagcttgttgaaacagattaaaggactctgtatcaactttcttattcagtaagttaggtgggatatgagaatatacatttctaacaagttcccaagtcatgccaatagttctgtttgggactataccttgaaaattactgctctaaccctttttaagtgtatcatttgaatttcagtagatgtataaaattgtataccagcaccacagtccggttttagaacaattccatcatactaaagagttcctcatgcacatttgcagtcaatgccaacattccccttcagcctgaggcaactagttatctttctttcactatggttttgcacttttcagaaattttatataaatggaattatatgatacatagttatatacttggaatgtttcacttaacataatatttttgagattcatctatgtcattgcatgtatcagtaactttcttttattgctaagtattatttcatagaatgagcatactacatttttttgtccattcaacattttatggacatttggattgtttctagttttggctattatgaaaaatgctattatgactattcatgttcaagagatggcatatgcttttgagcagaaggaagttataatatctagatgatattcatatattatcctatgcttgtagttgacaaaaaatgttaatatattcttgtttcctaatatatttccaataataatattttaatatttactatgaatattttatgttcttgcaatgaatatttgataattttatgtcaaaatattataaattggtatatgatagtctataaacattttgtaaaatgtttcttttgagataatcaacatactctatagatgttgatcttacaaaattaatatatctactcttattggtgggcaaaattcaccctggaataaaataagtataaaacaaataaaacttagcttttgatgttggaaatgttcagatacagataacagtagggagaattgtttaatgaaatccccatgtatccatctcacctaatttcaacaattgttaatagtttgacattcttttttaatctgtaccttgcctcccgatctattcctggtgttctatattgaatctcaaaatcatatcatttctcctggaaatacttcactatatattgcaaactgatgaggacttacgaaacaagtatgtatgtaaatttttacagcaccattaattcacctaacaaaaatagcaataatttgtaatatcatctactacccagtatatgtttagttgtccctaattgtgtgacgtatatttttcaaattgtttgattgaactaggatgaaacaagatgcaaacattgcaattgactgataacaccgttaagttaatcttaatctataatgatttctcttcccttgtttttccatgacaatgatttgttgaagaaactggttaatttgttgaagaaactggtaggatttcttatgatctgcatttacctgactgtatcttcttcatatcatttagtatatcatttatcccatgtattattaatgaagtataagtacaaaggatttagatataggactgagtatattcaggttttggcatggtttttttcctagtagcaaggatatttcttaggaagacttgtctatttcctatagcatcatagcatatctgtcactcccacttttactgatgctgtgattcatgatttgattcaggtgttgtcagcctgatgctttcattatcaagtttccctccaatcttttaccaaatggttttagcagctattgatgaatattccctagatttcctctatttcagtagaattgcaaaatggttatcttctaattccatcattccttctgcaatccttacataaaatttttctgtgaagaatgttctttcatcaactctttggttaccctgaaattcaacctttacagacaaggaaggataaatgcttgcttctttctttttattcagtttattggttttcaaaataatgagttggtgccctaggacactctaaatgtgactgagttttaaagtatcattatgaactcatggagcttatttattcaatgtgtttattaatccatttcggtcgttgttttcagtggtcaaattgttttatttttgactggtggacctctaagatttactcttgtgtcctttgatttatgctagtatttttaaaactactttattgccttttgctcaagatttcccaggctcagattatacattctgtgctccagatgttatttttttgaggagaactaattagtgggaattggaatttatagaccataatctaggtgctaggaagcttactctttctgggttgttactgttcctagatctttgaaaatttctttcacaaaggtactggatttaacacatttttcagtatatgttcatgtttttatctctaggattgtctctgtctctctctctcgatatatatatatacacacatatatatacacatatatgtgtgtatatatatttatattatatatataaatatatatattatatataaatatataaatatatttttatatattatatatttatatataaatttatatatacatttatataaatatatacatttatatatatacacatatgtgtgtgtgtgtgtgtatatatatatatatattttttttttagatgaagtcttgctcttgttccccaggctggagtgcaatggcatgatctcggctcactgcagcctccacctgccgggttcaagcaattctcctgcctcagcctcccgagtagctgggattacaggcgcctgctaccacgcctggctaatttttgcatttttagtagagatggggtttcaccacattggacaggctggtctcgagctgctgacctcatgtgatctacccgcctcggcctcccaaagtgctgggattacaggcgtgagccactgcacctggccagattgtatatatttttggcataaggaaaacagtattaacacaattcaattaagtttagcattcctttgatgaggatacattttttcccaaacattatgtatggtaggcactagtattcgatgcagttgtggtagttgctttctgggaagcaatgagacttactcttggcatctatgggatgatatgtaagaaaataaattttaatttaataaatgaaacaataaatggataaaatgcagacacagcacaaaaagggactaattaactctcttggcaggaggtgttcaaggagtgcttcacattcccaagaaaggtaacatctgtggtgggtattaaagggaggctatgatatcctttgcattgggtatacaaaagatgcaggaaagggactttcagacagaagaaaaagcatatgaaaagatatggaacaaggaacaggactgacagtttggtgctatttgtgtcaccaagaacaaagtggaaaatgacaacagatgaggcaaaatcagcaaaatctcatatgccagggtaaagagcctaggcttattctagaggcaaatgggaaacactgaaggatgttaagcagaaatatgaaatgatctaatttgctcctcagaataatcattctggtaacagtgaagaaaatggattgggagaggaaatggcaaatgtgtaagttcacttttgactttacaaattcgtgcctagaatagtgcttggcaaatagcgggcacttagtatttgttgagtgaaaaaacaaaaagttgttatatgaatcaaaaaaagtcgataagtctgaagaaaaaccacacagaaatagtgcctatttttttttgttgctactgcttgattcatctgctggcttgtttgttatcttaccataagattttcatgaacaaatcagtaagtaaaataaccgaataaaaaaaacagtcaaaggatttgaatagcaggcttacaaaagaggaagtctgaagggtaactagaaatatgaaaacatgctcaatttcactagcaacaactagatcatttaaatcccatgagatggaagaatatttaagagtttgcacaaaacccagtcttcaccagaatgttgaattggaattctcacatgctgctggtgagagtgtaagttggtgaaatcattatggaaagtggtttggctgtcagtagtcattaagttagaagatgcttatctcttttgactcagcatttccactcagatataaaccctagagaaatgcttgtacctgtacagagacatgttcagcaatgttgatcacagcattgttgattaaacaaaaaactttgaaataacataaatgtctatctgcaggagaatggataaattgtgatatatttgtacaccacatactattcagcaatgaaaatgaacaaattagagctatgtaaataaaacatgaaaaaagtttacaaagtgatatatatatatatatatatatatagcattatgttacataaagttaattatgcaaaataatattacatatatgtaataaaagatcaaaattccaatttaagaggctagttatctctgagaagggaaagcaggagggaaatgggattaggggaggttacacaggaagcttcaccctttctttaaaagaaaaaaaggtcataaacagatatagaaaaataaaaattttataaagctagataatggtcaaaaaagtatttgttatttttgtttttatatatttgaaatgttttcagtgaaaaatcctttgagcttagagaattacaaaattatccttattctcaaagtaaaatattttcctagcatctaaataattttaagagttttttattttgcagatttgactgatgaattagctcagaagttatttgatgtttcagaaataacttcagcagcaatggttcattcgttgcctacagcagttccagaatctcctagaattcatcctacaagaacacccaaaacacctcgaacacctaggttacaagatcctaacaaaacaccaagattttatcctgttgttaaagaaccaaaagccattgatgtaaaggtatacaaaacaaccaggaatataaggcttgcattttgtatcctttaacattacagaatgaaacgttttagtttctatcacattgaaaaatgtgtgttataacttgtaatatttcacttaaaaatcatactttaccatagtgatattttctctggttaggaaatttttcggttgggcacggtggtttatgcctgtaatccaacactttgggagaccgaggcaggtggatcgcttgtgcccaggagttggagacgagcctgggcaatgcagtgggaccccatctctaaaaaaatacaaaaattagatgggcgtggtggcgtgtgcctgtagtcccagctacttgggaggctgaggtggcaggattgcttgagcctgtaggggtcagggctgcagtgagccatgatcatgccactgcactccagccttggcaacagagtaagaccccatttaaaaataaacaaacaaacaaaaaccttttttacaattggatagtgtaattaaagacgaacagaaagtataatgaagaatcacactaagctgcacttcatttcatctttgtgtcacaaacctaccaaaggactttatttattaagttttgtaacttgtgtgtgagatttttgagttttgtgacttcatatgatttcacaatgtgttatctacagtatgaaaatgtttgagttcatttatagtcagagggttttaatttacttgtgaagttcacactattgaaactaattgcaatgcttgactttattttctttagagtccaagaaagagaaaaacaaggcatagcacaaatccccctctagagtgtcatgttggttgggtaatggattccagagaccgtgggccaggaacatcctctgtcaggtactatatttctcaaacattacttttttgttcgtgatttgaagttttttgaaaacagttactaattggatatttcaaaatatttaaaaattaatatgttagcaaattatagagcaatgaaaatggtacaaagaagccaaagaagagataagttttacaagtatgttaaggaaataatccagttggacagtttttttttcccatttaaattatttttcacaaatgtgaactcttagatttataagctatgtaggtctatgaaagttattatctttggaaagttcccagagtcttagtggcatttaataggttcttagtagatatttattgaggacattaatgtgctaaacaaacaactcaaactgtataaataatatggaaacgaagcattgttattttgcttttttcccccttttttgaaaatcattaagattagctgattattagcaggaatttttttttataagaaagaagaaaattaattaaaaaaagaagaagtctagagcaaatctcttagagtgccagtgatctgcaaagcactatggtatgttttgtccttcagaggggttgcagaggtgatttattgctcgttgctttgtgatgctttttttaaaataaaaatagagacagaatcttgctctgttacctaggatggtctcaaacttctggcctcaagcagtcctcctacctcagccttgtaaagtgctgggattacaggcatgagccacctcacccagcctgtgtttcttaaaaaccattttgtgtttatactagatattttcagaataattaactgatagtttttccatttgaaaactttgggaaaatatgtttttgactggttactagaaaagaaggattagttagtttcatgaaaagaaatgctagggagtttatcatgctctcaaaaccttgaaatctgtcttgttagtgatacacatttgattattttacattgttcttactagctatattgtctctaaaagataaaaagtgtgtatgttcttctgcacacctgtggtatactaatagttattttggggttataagtgatttttcagtttttttccccagagtatttctttttattggagcagtatatgtagagatcaacaacaatggaaaatgtttaatttacctaatgaaggacatcttgtctttgttgcttccaagttttgggaattatgaataaagctgctataaacatctatgtaaaggttttagtgtggacatatttttaaatcccttagataaatactaaggagcatgattgctggattgtataataagaatatatttagttttgtaagaaactgccaaactgttttccaaagtggccctatcattttgcattctcaccagtaatgtttctttttaaccttggtaatgtcttgttttgaagtcagccttgtctgatatttatataattatgccaactttctttagatgagtgtttgccagtgtatctttttctacctttttacttttaagcaatctctttgttttaaagtgggtttaatgtaggcagcatatatttgggtctttctttgctttttataacccagtctgataatgtgttgtttaattagtatgtttagaccatccacatttagtgtagttattgatgtggttggatttaaatctatcatttatttttctcatccattcttttttttttttttttcttttgagactgagtctcactctgtctcccattctggagtgcaatggcatgatcttggctcacttcaacttccggctcccaggttcaggtgaggactcaacctcctgagtagctgggattacaggtgcctggcaccacacccagctaatttttgtatttttagtagagatggggtttcaccaggttggccaggctggtctccaactgctgacctcaggtgatccacctgtcttggcctcctcaggtgctgggattacaggcatgagccacactgcgcccagctgtctcatctattcttcattcttttttctctttttctgctttcttttggattgagtttttataatgatcctattttatctctactattgacttattagttatgtctcttttttattttttactgatcctctaggatttacaggtatactttgttttgttgtgcttcatagatactgtttttcacaaagtgaaggtttgtggcacccctgtgttgagcaagtttatcaatgccctttatctaacagatgtactcaattcatgtctctgtgtcaccttttggtaattcttgcaatatttcaaactttattattattatgatgtccttttttttttttttttttttttgagacgaagtctcgctctgtcgcccaggctggagtgcaggggtgtgatctcagctcactgcaagctctgcctcctgggttcacgccattctcctgcctcagcctcctgagtagctgggactacaggtgcccgccaccacgcctggctaacttttttttttgtatttttttagtagagacggggtttcaccgtgttagccaggatggtctcaatctcctgatctcgtgatctgcccgccttggcctcccaaagtgctgggattacaggcatgagccactgcacccggccttttttttttttttttttttgagacagagtctcactctgttgcacaggctggagttctgtggcacaatcatggcccactgcaaccgtaacctcccagactcaagtgatcctcccacttcagcctcctgagtagctggaactacagttgcatgccaccatatccagctaatttttgtattttttatagagatggggtctctgctgtctgggctggtcttgaattcctggactcaagcagttctcctatctcggccttccaaagtgctgtgattacagacatgaaccaccatgcccagctactattttgtattttatggtgatctgtgattagtgatctttgatgttaactattgtaattgttttggtacaccatgaaccatgccaggataagacagtgaacttaataaatattgtatgttttctggctgctccactgactggccatttctccatctctccccctcttcttgggcatccctgtaccctgagagacaaaaatgttgaaattagaccaactaataaccctacagtggcccctaattgttcaagtgaaattaagagtcaaaattcttcaaaattaggaatgtcatcattaatgaggaaggcacgttgaaagccccaagacaggctgaaaactagatctcttgtgtcaaacagccaaaatatgaaggcaaagtttttgagggaaattaaaagtgctactccagtgaatacacaaatgataagaaagtgaaacagttttattgatgatagggatagagtttgagtggtctggataaaagatcaaaccacccccaatattcccttaagccaaagcataatccagagcaaggccctgactctcttcaattctctgaagactgaaagaggcgagggaggtgcagaagaaaagttggaagctagcagaagttggttaatgaggtttaagaagctgtctccataatataaaagtgcaaggtgaaggagcaagtgctgatggggaaggtgcagcaagttttaaggaagatctagctaagataataaaagtggctacatttctgcaggtctagatctgaaaaaaaagtgtggctaccttaaacaatagattttcagtgtagacaaaacagccttctattgggagaagaagccatctaggactttcatagttaggaaggagcagtcaatgtttggcttcagagcttcaagggatggggctgactctcttgttaggggctaatgcaggtggtgactttaagttgaaggcaatgccagggctcttttgaattatgctgaatctactaatctgcttatgctctataaatagaacaacaaagtctatgtgacagcacatctacttacaatgtgggttactaaatattttaagcccactgttaagacctactatttagaaaaaaagattcctttcaaaatattactgctcattgacagtgtacgtcatcacccaagaatgctgatgaatatatacaaggagattaatgtttttttcatacctgctaacacatttattctgcagtccatggattccaaggagtcattttaactttctagtcttattatttagaatattcatatatagtatattcataaggctatagctgccacagctagtcattcctctgttggacctgagcaaagtaaattgaaaacattctggagagtattcaccattctacatgccattaagaacattggtgattcataggaggaagtcaaaatatcaacattaacaggattttaaaagaagttgatttctaccctcatggatgactttgagaggctcagacttcagtggaggatttaattacagatgtggtggaaatagcaagagaagtagaattagaagtggagcctgaagatgtgactgaattgctgcgatctcacgataaaacctgaaaggatgaggaattgcttcttatggacgagcacagagagtagtttcttgagatagaatctactcctggtgaagattctgtgaacattgttgaaatgacaacaacagatttagaatattatataaagcagtggcagggtttgagaggactgactccaattttcaaaggagttctactgtgggtaaaatgctatcaggacagcatccatgctacagagaaaacttgggaacagaagagtcaatcaatgtagcaaatttcattgttgtcttattttaagaaattgccacagccattccaaccgtcagcaaccaccgctctgatcagtcagcagccatcagcatcgaggcaaaaccctccaccagcaaaaagactatgacttgctgaaggctcatatgaccattagcatttttagcaatacagtttttaaaaaaattgatacataacagttgtacatattttgggggtgcatgtgatattttgatacatgcatacaatgtgtaatgatcaaatcagggtaatggggatatcaatcacctcaaacatttttctttattctgttccatttttttccttttctttttaagatctttttgcataccaaccttctagctattttgtactatacaatatgttattgttaagtatggttattctactgtactataaaacactaggtctcatttctggtattaactgtatttttgtacctgttaaataactgcttttcaccgcccttccccctacccattctagtccctggtaagcactaatcaactctcttatctctatgagatctacttttttacctcccacttattagtgagaacatgtggtacttatctttctgtgcctggcttatttcatataatataatgacttccagttctatgtttctgcaaatgacataattcttttttatggctgaatagtattccattgtgtatgtgtgtatgtttatgtatgtgcctatgtatgtatgtgcatatatttacacatatatacatatatacacatatacatacatgtacatacacatatatatacccatatataaaattttcttcattcatccattgatagacacttaggttgattacatgtcttggctatagtgaatagtgctgcaataaacatggaagtgcagctgtctctttgatatactgatttcctctattttggatatatatccagcagggagatttctggatcatatggtagttctgtttttgttttttgaggaacttctattctgttttctgtagtggctgtactaatttacattcccaccaatggtgtgtgaagcattctcctttctctgcatccttgcaacatccattattttttgttttcttgataaaagccattttaactggggtgagatgctttatcattgtagttttgattttctttatcttcttgataattagtaatgttgagcactttaaaatatacctgttgtccagttgatgtcttctttggagaaatgtctattagatcttttgtcagttttaaaatgggattatttgtattgtttttttttttctactgagttgtttgagttccttgtatattctagttattagtccttttttggatggatagtttgcaaatattttctcctattctgtaggttgtctcttcactttgttgattccttcatgtgctgtgcagaaacttttttgcttgatataatctcattagtctatttttgcttttgttccttgtgcttttagcatctaacacaaaacatctttgcctagaccaatggcctagagtgttttcccaatattttcttctagtaatttcatagctttgggtcctagtttaagtctttagtccattttgattggctttttgtagagaggggtctagcttcagacttttgcattatggttatctagttttcttagccccacttatcgaagtgactgtcctttcttcaatgtatgttcttggtacctttgtcaaaaatgaattggctgataatgtgtagatttttttctaaattttctattttgttccattggtctatgtgtctgcttttacaccagtaccatgctaccttggttactatggctttgtattatattttgaagttgggtagtgtgatgcctccaggtttattctttttgcccagaattaatttgatttttcacggccttttgtggttctgtataaattttaggattttttttctatttctgtgaagaaattttgatagggatggaattaaatctgtagaagttgctgcatagtattgagattttaacaatgttaatttttccaatccatgagcatgtgctatcattccctttctttcgtgtgacctctttaatttctttcatctgtgttttttagttttctttgtagagatctttcactttggttacacttatacctagatactttatgtatttttgtagctgtcttgatttctttttcagtgtgtttgcttttggcatatataaatgctactgtttttttgtatattgattttgtattgtgcaactttactgaattgacccagatttttggtggagtctttagatttttctaaatataatatcagatcatctgcaggcaaggataatttgacttcttcttttccagtgtggatgctctttctcttgcctaattgctcttgctaggacttacagtactatgttcaattaaagtggtaaagtggacaaccttgtgttattccagatcttagaggaaaggccaagtgctcatgtctaagacaatgagaaaaacaccttgtaggcattttagagacctcccgccgcaggaccagaggcctaggaggacagaatggggccctgtgcaaccttgggaaactgctccctgcattccagctgctccagctgtagcatggctaaaaggggcccagatacagcttggggctgctgcttcagagggtgcaaaccataaaccttggcaggttccatgtggtagtaagcctgcaggtggtgcacagaatgcaagagttgaggcttgggagcctctgcctatatttcagaggatgtatggaaaatcctggatgtctagactaaagcctgctgtaggggcagagccctcatggagaacctctacaaggacagtgcagagaggaaatgtggggttggatccctcatacagactccccactggggcactgcctagtgaagctttgagaagagggccactgtcctccagaccccagaatggtagatccactagcagcctgcatcctcagcctcgaaaagccacaggcactcagtgccagcccttaagagcagccatgtgggctaaaccctggaaagccataggcatggagctgcccaaggctttgtgagcccaccccttgcaccagcataccctggatgtaacatatggagtcaaaggatattattttggaactttaagatttagtgattgcccttctgggctttggacttgcatgcagcctgtagcccctttcttttgggctatttcttccttttgtgtatttacccaaggcctatacctccattgtatcttggaagtacctaccttgtttttgattttacaggctcataggtggaagggactagccttgtctcaaatgagactttggacttttgagttaatgctagaatgagttaagactttgggggattgttgggaagacatgactagattttgcaatgtgagaaggacatgagatttggcaggggccagggtagaattatatggtttggatctatgtccccacccaaatctcatgttcaattgtaatccccagtattggaggtggggcctggtgggaggtgattggatcaccggggcagtttctcatggtttaacaccatctgccttggagttgtcattgtgatagtgagttgtgagatctggttgtttaaaagtgtgtggcacctccactgtctctcttcctcctgctccagctatgtgaagtgctgctccccctgccttccaccatgattgtaagttttcctaaggcctccctagaagctgagccagcatcatgctgtactgcctacagaaccatgagccaattaaacctctttcctctataatttacccagtctcgggtatttttttttttttttgaggcggagttttgctcttgttgcccaggctcaagtgcagtggtgtgatttcagctcactgcaacctccgcctcccgggttcaagtgattctcctgcttcagcctcctgagtagctgggattacaggcatgcaccaccatgtctgggtaatttttgtatttttagtagagatggggtttctccatgttggtcaggctggtctcgaactcccaacctcaggtcatccgcccgccttggtctcccaaagtgctgggattacaggcatgagccactgcgcctggctgggtatttctttatagtaatgtgagaacagcctaatacatctagctgaaggtttgttgattttgtttatcttttcaaaaaaccaactttttcatttcattgattttttgtacttgttttagtctcaattttatttatttctgccttgatctttattgtttctttctactaattttgggtttgatttgttcttttctagttcttttaagtacatcgttaggttgcttatttgaaacctacttttttgatgtaggcatttattgctataaaattctctcttagtactgctatgctgtatctcataggttttggaaagttacgtttccatttgcatttgtttgaagacattttgaagttttcttcttaatttctttattaatctgttgatcattcaggagcatgttgtttaatttccacgtttgtgtagattccaaaattcttcatgttattgatttctatttttattctgttgtagccagaaaagatacttgatatgattttgacttttttaaatttgttgagacatgttttgtagcctaacatatgttttatcctggagaatgttccatgtgctaatgagaagaatgtgtattctgcagtagtaggtgaaatgttctataaatgtcactaggtccagttggtctaggtgtagtttaacttcattgtatctttgttgattttctgtctggatgatctgtccattattgagagatgggtgttgaagccccctgctattatttgtattatagtctatctctcctctagatttattaatgtttacttaatatatctgggtgctccagaattgggtgcatatatttttaaattgttacagcctcttgctgaattgatcctttcctttatcatcatacagtgaccttccgtgtcctttttttttttttttttacagactttcacttgttctattttgtttgatacaagtatggctacttttttttttttttttttttttttttgcttccatttgcgtggaatgtctttttccattcttcactttcagactatgtgtgtctttataggtgatttgagtttcttgtaggcaatatatagttggatcttgtttctaaaagtttttcactcagccatgcttatatcttttggttggagaatttagttcatttacattcagtattattattgatagataaggacttactacgcagtatgtcattacttggtttctggttgttttgtaactcctcccttacttccttcttactgcctttgtttgtgattaagtggtttttctctgggagtatgttttaattcattgctttttatttttagtgtatctatcataagtctttgctttgtggttaccatgaggcttaccaaagccatagctgtaagttattttaaacatatgacaacttaactttgatcacaaagaaaaggaaagaatcaagggaaaaactaaaaaactctacacttcaactccatcctcccacattttgacattttgttgtcttaatttacatctatttatcttccctatctcttaacaggttgctgttaatattttcagtagatttgtcttttagtcttcatattagagatatgaatggattacatgtaacaattactgcattagagcattctgaatttgtctacttttaccagtgagttttataccttcaaacatttttggttttgcacatcaaagtttgttttctttcaaattaaagaactccctttagcatttctgaaaagatgggtctagtagtgatgaattcccttagcttttgtctaggaaagactttatatctccttcctgtttgaaggaaaactttgctgggtacagcatagttggttggcaggttttgtttttgtttccatttatcctgtagcactttgaatgtgtcacttaactccctcatggcctgtttggtttctgttgaaaagtctcttgccaaaaaaatcagagctcttttatatgttcttttattttttttctcttgctgttttaaggatcttctctttgtccttgacattttcaggtttgattattatttgccttgggatactcttatttggattgaatattgatatggtttggctttgtgttcccacccgtctcatctcgaattgtaattcccataatccccatgtgtcaagggagggacctggtaggaggtgattggatcatgggggcacttatcccatgccgttcttgtgatagtgagtgagttctcacaagatctgatggttttataagtgtttgacggtttctccttcacacatactctctctcacctgctgcagtgtaagggtgcctgcttcccctcccaccacgattgtaagtttcctgaagcctccccagccatgtggaactgagtcaattaaaccactttccctcataaattacccagcctcaggtattatttatagcagagtgaaaatggactaataaaaatatatttggtaatttctgaccttctgtacctagatatttatatctttctttagatttggaatgttttctgttatttctttgaataagcttactactccttgctcttaactcatcattgaatgccagtggctcttacatttgttcttttgagattattctttatatcttgcaggtgttcttcattcctttctttttctcctctgactgtattttccaataggctgtatttgagctcactgattgtttcttgcaatgtgagagcctgtaatccatttttcagaaaacgtatttctgagttccaggatttttttttttaatttcaatctctttgtgttacatttctctgataaatttaattgcttctctgtgttatcttggattttgctgagtgtctgtagaactgttattttgttcttgatctgagacctcacacattgcttttcttctccctgactccttgctttgtgcatttggggatgtcatagttccgtgtttgctgttgtttctcgtggatgtacatttgtggctttgctttaaaggatttattatttatcccagtctttgctgtcttgcttgttttgtctttctaaggtatgttttcttagagattctttgcagtagcgtgtgagttcccttaatactattgtatatcagtgcctccttttgggcactagatggcgccttaagcccaagtttgccttggctctcacaaacattggagcactgcctgtcagatggtgggggtggcaaaggggattaccccaactgtgtggtaaggctggcaaacggtttgtacccagaaaactcatggatcatacctcctacagtgtggtcctgctgaacagccactctgatatggcatctcttttggctgaaataaagaggagaatttcagggctagggtttctgttcctgcttcccctctttttctgccttcatgatttttttttctccctgctagccctcatgatattatacttcttatgggttgaggcaggaacagttttcctgcaagggaacccaagatggtgggaaagctggctgtcctcctccatctaactttttccaatgaagaagctgagtctgggaggaatttttcatgcacagggcctggcagattgcagaaaaggcatcatgcaaagagaaggctatttctcttactgtttgcttggagtttttcagttctctgtggctcacgggtactatcagcctcagatttgagttctgggatattgctgatgataagctttgtgctagatatttgtttttggctttctgtgggagagtgaagccagattgcttctactctgccattttggtgacatcattgtctcaataaagtatttttaaattaaggtatgtactttttttaagtcataatgctattgcacacttggtagagtacagtataatgtaaatataacttttatatttactgggaagccaaaatattcatgtgacttgcttttttgcaatatgtgctgttttgtggtggtctagaattgaaccagcaatatctctgagatatgcccatataattcagctgttccttgaattatgatgtggttacatcctgatgaaccctttgtagcttgaaaatatcataagttgaaaatgcatttaatacacctaacctactgaacatcatggctcagcctagcttaccttaaatgtgctcagaacacttatattaacctatagttgggcaaaatctagcacaaagcctattttataataaaatgttgaatatcttatgtaatttattgaatgctttgctgaaactgaagaacagaatggttgtatggtacttgagctatggtttttactgaatgcatattgcttttgtaccatcataaacctgaaaaaccgtaagtgaaaccatcttttaagttgaggaccagctttatacattttaacgtaccacagtctactttcaaataatcttatcccacttcatgtgtagtataagcaccttacaacattaaattttcattatttctccccatttctctgtttgtttctttgttttttttttttaaattagagacagagtctcgatctttcacccaggatagagtgcagtggcaaaatctcaggttactgcagtctcaaactcctgaacttaagcagtcctcccaccttaacctcaagtatctgggactacaggtgtgcaccacaatagctggctaatttttaaaaaaatttttgttgcgacaagatcttgctatgtaattcaggctggtcttgaactcctgggctcaagcaattctcctgccttagcctcccaaggtgttgggattaccgttatgagtcaccacacccagtcccccattctttgtgctatactttgttattatttttctttagacagttatgtgtacatgtatatacacatacatatatgtgcacatgtgcatacacacatacacacatatagtttgagtagatagtttagcacattaaatccttcatatatatctattaaaaactttctaaatgccattgagaatctgggagatttctttagtaggttcgtaatagatatttgcctgttattaatacacccacacacaaacacatacacacacctataaagtatcctgctctggttctctgatggtttcagatttatggctttttaaattgttagaataatttttgactcatcataaatttttttgccctgttttctttttttccttcttctgggtttcaaattacatatatgttagaccatttgataatacccatagctgttggatgctctgatctgctttttctcctactccttttttattttatttttttatttttatttttatttttgagacagagtttcgctctcgttgcccaggttggagtgcaatggagtgatcttggctcactgcaacccctgcctcctgggttcaaacgattctcctgcctcagcctcctgagtagctggaattacaggtgcaagccaccacgcccagctaattttttgtatttttggtagagacagggtttcaccatgttggtcaagttagtcgtgaattcctgacctcaggagatccgcctgccttggccttccaaagtgctgggattacaggcgtgagccactgcgcttggcctcttactccttttaaattgtatttcactttgtgtaattttgattgatttatattcaggtttcctgattctttccttagctgttctagtgtgctaagaagtccatcaaagaagtattcatttctgatattgtgttgtgtatattttgcattactgtttgactatttatttattgagatgcagtttcactcatgtcgcccaggctggagtgcaatggcacgatctcagctcactgcaacctccacctcctgggttcaagcgattcttctgcctcagcctcctaagtagctgggattacaggtgcccgctaccacacccggctaatttttgtattttaatagagacagggtttcaccgtgttggccaggctagccttggacccctgatgtcaggtgatccgcccacctcggcctccgaaaatgctgggattacaagtgtgagttaccgcgcccggccccatttgactttttaaaaatagttttcttggctggtcgcagtggctcacgcctgtaatcccagcactttgggaggccgaggcgggcggatcacgaggtcaggagattgagaccatcctggctaacacggtgaaaccccgtctctgctaaaaatacacaaaaattagccgggcatggtggcgggcgcctgtagtcccagctactcgggaggctgaggcaggagaatggcgtgaacccgggaggcggagcttgcagtgagccaagatctcgccactgcactccagcctgggcgacagagcaagactctgtctcaaaaaaaaaaaaaaaaaaaaaaaaaaaaagttttcttggctggatgtggtggcgctcactggtaatcccaactacttaggaggctgaggcaggagaatcgcttgaacctaggaggtggaaattgcagtgagctgggatggggccactgcactccaacctgggcaactgagtgagactccatcgcaaaaaaaaaaaagttttctttttttctgctgaaattctccatctcttcatgaatgttcatcttttacattagagtcttcaacatattaatcatggttattttaaagttcatttgtgattatgctagtactgagttatctgtaagtctggttctattcattgtctcctgaattttattttttctttttgtgtgtcttatacattttgattgaattctagattattacttctagacttttttttgttgttgaaatcttgccaaatcccagtctgaataaatccagctttctattatatttgctcctagtctactgaatgttgctaaagtaagtcctaggcttattgatagtaatatagattcatgtgctgtaattatagttagagcttcgatgttatctgcatttcttttactaatctaagtattcgatattaattttatcttcgttctttccttttgattgaggaattctttatctctcattgttccatcttttgaaaactgttttcaaatttctatttgttagtcttcattttgatctacctctttgcttccttctggctccctgtgataagtatgccagtaaggtatatttattcattgtggagaatttatttaatgatagctaccacttttatatgctttcaataaatgttccaggcactgtgctcaacattttacatgcattgtttctctatgtcttctttagacaataagttctttaatgtaaagaacttctcagtacctgtcatactttgcagtcaataaataactacatgaatgaaactactgattccatatagagacagggaagtttatagctgtaaatgcctacatttaaaaaagaaaaaagatctgaaatcggcaacctagctttatactttaaggaactagaaaaagaagagcaaactaaacccaaaatagtagagaaaatcaaggaaactaaaagttgattctttgaagagatcaacaaaattgacgaaactttagctagactgacaaagaaagagagaagatgcaaataactagaatcagaaaaacaaacaaacaaatgggatattactactggttgaccttacagagataaaaaggatatgagaatactgtgggctgggcgtggtggctcatgcctgtaatcccagcactttgtgaggctgaggcaggtggatcacaaggtcaggagttcgagaccagcttgccaatatggtgaaaccctgtctctactaaaaatacaaaaattagctgggcatggtggtgggcgcctgtagtcccagctactcaggaggctgaggcaggaaaatcacttgagcccgggaagcggatgtcacagtgagccgagatcatgtcactacacttcagcctgggcgacagagtgagagtctgtcaaaaaaaaaaaaaaaaaaagaaagaaagaaagaaaaagaaaagggaaaaaaaaaaacccaaaaattaacacccagcctgcgcaacacggtgagaccacgtctctactaaaaatccaaaaaattagccaggcatagtggtacttgcctgtagtcttagctacttgggaggctgaggtgggaggattgcctgaacccaggaggttgaagctgcagtgagccatgaccatgccactgcactccagtctgggcgacagagcaagaccctgtctcaaaaaaataaaaagtaaaaaagaattaacaccaatccttctcaaattctttcaaaaaaattgaaggaatttttgttttctgtttttttttttcggacacggagtctcactctgtcgcccaggctggagtgcagtggtgcaatctcggctcactgcaacctctaccagctataccactcttagttatatatcaaaagtattgaaaacacatattgtatgcccatgtttgtagcagcattattcatgatagccaaaaagtgggattctcaacaaaagactggataagcaagtatccaacaacaaatgattagataaacacatacaatggaatataaatattcaaccacaaaaaggaatgaaattttgatttatgctgctacatggatgagctttgaaaacattatgcttaatgaaacaaggttgacacagaaggataaatattatacgatcccacttatatggagtacctagaatagtcaaatttatagacagaaagtagaatagaggttactagggctgtagggaggggtagaggggtagtttttatttaacaggtacagtttttgatggagatgatgaaaaaattttgagtctagatagtggtgatgattacagaatattgtgattatatttaatgcctattaattatacacttatgaatagtgtttaaaatgatatatattatgttaggtatatttttaccacacatgtacacacaaaaactcctaaaattcttttttatttcattagaaaagtctttaagtattggttgtaactgtcaggctcttagtgacaaatacaagatttccaaaattttcatttttgcttgaaagctcaaattttatcattggaaaaaacagttgttttccttgacattaaaaactcatttttttatcagctgggcgcagtagcttacgcctgtaatcccagcactttgggaggccgaggcgggcagatcacgaggtcaagagattgagaccatcctggccaacatggtgaaaccccatctctactaaaaatacaaaaattagttgggtgtggtggcaggtgcctgtagtcccagctactcaggaggctgaggcaggagaatcgcttgaacccaggaggtggaggttgcagtgagccgagatggcgccactgcactccagcctggcaacagagcgacactctgtctcaaaaaaaagaaaaacaaagaaagaaaaaaaacctattttttttcattttcaaggaaatatctgagaaataataaagtctgagtaaccatagtttgtgggttgttcttttagttaaacatgaaaaaagttgctagtttgccttataacttaatcacacaagtgctttgctttaagaaaacgattgtagctttttttttttttttttttttttgagatggagttttgctcatcacctaggctggagtgcaatggcatgatctctgctcactgcaacctccgctgcccgggttcaagtgattttcctgcctcagcctcccgagtagctgggattacaggtacatgccaccacgtccagctaatttttgtattttttatagagacagggtttcaccatgttggccaggctggtctcgaactcctgacctcaggtgatccgccaacctcggcctcccaaagtgctgggattacaggcgtgaacccaccacacccagccccattgtagtttaatatgctgcaaaaatgctttgtgttttcttctcatttttaaaaaattgtaaaaaaatgtataacatgaaatttaccatcttaacagttcttaagtgtacaactcagtagtgttcagtatattcacattgttgtgaaacagatctccagaacattttcatcttgcaaaacaagcttccatttcatgtttgtcacacacaaaaagatatgtactcatgagtgagattttataattttttggctttatcaaggatatttttaagttgaaactggaattgttttattttttctaattgcaagtgcataacaatgaaggatgcagtcacaagtaagtaaagtttggtgccactgcctcaattcacatcagttttacacaccattgcttttgtaccatcagtagaaaggtcaacatagaggcaagggccaacaatgtcttcttattatgaaatcagttttgactttgtagactttctagaaggttcttaggaaccttccaacagtccacagaccactttgagaaccactgatttagataaatgttttaggaagataactttggtggcaggatagagaagggacacttggaaaaacaaagagactggttaattcaagtgaaagaagagagactggttaattcaagtgaaagaagaggaaggtctaaatttgaatttaggtctatatttgaatttgagtgcagatgagaaggaaaagacagatttaggagatagatcaaaagtggaattgatttagagaattgcaggttctgtcttacttttgatgcctttagaaaaaaagaaaattgcaggtatgtctttgagataatgaaattattgcccatctttgtgccagattttatccctaatctccatgtattcaatttacatcactaacctaaattattcaagataagttgaaagtttccacataataaaaaactaatctaaatgaaattaataatgatttggaggaggaatgagctattcagttatctgcttctgcttaaactgtgttagcttgagagtttatgaccatgctttttatcagcttctgaatttacatatgtgtattgaacataaatagcactatatgcagatctgtatgtcattaatttaggagagttttagggactactgtcttttccactgcttagacccccaataatgaaaaaaatagtacaaattggttcatatacttggttcttgatttttcattttgaaggcttttttcccctttctcaaacagcacttcaaatgcttcaccttcagaaggcgcaccactagcaggaagttatggatgtactcctcattcattcccaaagttccagcatccttctcatgaacttttgaaggaaaatggctttacccaacaagtgtaccacaagtatcgtcgaagatgcctaagtggtaagatgcttgtcctttatctatctaatatatttaaaattaaaatataattctaaaaaatttaaatgttgtcatttaatatcaggttaagatattcttttattgttagactatacatagttttactttaaacatgtttacatatattctttattcatgtactttataacttagacacattaggaaataaaaattaatatactcggctgagcatggtggctcatgccagtaatctcagcactttgggaggccgaggcatgcagatcacttgaggtcaggagtatgagaccagcctggccaacatagtgaaactccatctgtactaaaaatacaaaagttagctgggtgtgatggcaggcgcctgtaatcccagctacccaggagattgaggcaggagaattgctgggacctgggaggcagaggttgcagtgagccaaaatcgtgccattgcactccagcctgggcaacagagtgagactctgtctcaaaaaaagaaaaaaaaatttattatactcttcttgttgctattgagagatatttataatttaagcagtgagtcaaaaaatgggttagcatttgtcagctgtttcagcagtcctcaatctttttggcaccagggacctgtttcatggaagacaatttttccatgggggatggttttggataaaactgttccacctcagatcatcaggcattagattctcttaaggagtgtccagtctagatccctcacatgtgcagttcacagtagggtaccagtctgtggcctggaggttggagatccccactctatttagaagaaacctaaatacactttgaggattaatatggttgagctttcttcattttatatataacatctgctgtcttgtctttaaaaagtatgtttaataaaataatattttatttaacttttttcagagagaaaacgcttgggaattggtcagtcccaagaaatgaataccctctttcgtttctggtcctttttcctcagagatcacttcaataaaaaaatgtatgaggaatttagacaacttgcttgggaagatgcaaaagaaaattacaggtcagatattttcttttacacttcaagggagttttattattttcttcttctttttttctttacccaggtagatccgatagagggagtttttagaaaataatttttaaaactagtactgaagtagcctgattttgaaccgtgaaagtagcacaatataactagagggagacctgtattagttttctatttctgcattgcaaattaccccaaaactccataggttaaaacaataaacatttgttagttcacagcttcaaagagttgagactccagaaactgcttagctgggtggttctggcttatggtttctcatgagcttgcagccaagatgttgaagtgggctgtggtctctgaagacttggcctgggctggaggatctttttcaagctcattcacatggctcttggcaggaggcttcagttccttgccacactgaccttccctagggcattttacaatacggtttcaccctgaatgagtagagcttccaaaatggaagcctcagtattttatacaacctgcacttggaagtggcataccattatttctgccatattgtatagtccatacagaccagtcctggtacagtataggagggtactacacaaggttgttaataccaagagatgggatcattaggaaccatcttagaggctggcagaagggctgaatgaaattacaaaacttttctctcccatgctcccaccattacagacttcccttgcatgtacatatacataccccaattgatatgtgcttagagccaacccagttcttaagattctttgagaaaagaaaaagcaaggcctctcacaatatgtcctttgactcaccttgtctaattttttccccgctagtcctgtagtactctgggcaacagtgatactgaactacatattcttcaaatgaaccaagctctctagcctctggacatctgtgcatgttcttaactttgcttctacttctcttcgtcctccctgtgcttttctaaatcctattctttttgtcccagcttagaccttgcttccttcagaaatgttcatggaaagtcttgagagtgcctgtagggctgagtgagggcagacaaagagggtaagaaggaacatggcgtggactcatgaaggctatttattcatggggaaaaggagaaaggaacaagagatggagagaagggaaaaagatgatttttcattcaatcatatttacctaaacttacccttctttaagttctgaaaatggattcctcttgtaaatatcaaataagaatatattgtttaccagatattgtgatctttgagaagaatacaaggtgtgctacaaatacatttttctgattaaaatcacaaaaatttctttgtgttgacttatgtaaaaacaaagcccgtttaatttttatctgttatctatatcaggaacagcagatccatggcaggtgtacttctatttctttttcctctattactgatatctctaatcaatcccagttatgttttatgttctttcttaccacacttttaagatttatactcttccttatgactttaatagctactgccagtttaccagagttggcataaaaagcaaaatttgccattcctaatctcattgttcttattcaaactgtggtttgctacctattcgtcaattgtaaaatcaattgagtggttctaacatgctttaaaaaatacagtagaaaataccagactgcactgagcatagtaattcatacatatgaatttaattcatacccatatacatacaaatttaagaactgttttgcaaaacatatatctttttatgtacacacatatagagacatgcatattgatttagttataaggtaaaatatttttcatggtattggacctagtcagaaaagtttgaaagccattgttttaattgatctcagactattttgctatttatgcaatttctgtttgttccttaagactttctgataacttctctgattccatttccacccaagtctaggttgggagttcctcttctgtgttcctatacacatacctctgtgtatgtttctaatacctttgtaacacagtttcctacctttggttctgtttctgcagtatttaccactagactgtattagctacttcttaggaagtagtggttaagcacctgaagtccttgaaatcaggactatgtttgagttgcagccattaatttactgtggccttggcagattataatcccaccaggctttaggttctttataaaaagtaggttaagccaggcatggtggctcacacctgtaatccctgcactttgggaggccgaggcaggcagatcactgaagccaggagttcgagactagcctggccaacatggcaaaaccccgtctcttctaaaaatacaaaaattagcttggcgtggtggcctgcgcttatagctgcttgggaggctgaaacatgagaactgcttgagcctgggaggaggaggttgcagtgagccaaggttgtgctactgcacttcagtctgggtgactgaacaagactctgtctcaacaaaaaaaaaggttaaattgtgatagatactctctcatggggttattgtgaagattacacaaagcatttaaagggcttaacacattaacttatgtatagtaagtgcttgacaaatgattccctctctccctccctccctccctccctccctcttttcttttctttttcctccctccctcccttcctttctttttttctttgagacaaagtcacactgttgcctaggctggagtgcagtgtcgcgatctcggctcactgcaacctctgcctcctgggttcaagcaattcttctgcctcagcctcgtaagtagctggcatcacaggtgcccaccaccacacccggctaatttttgtatttttagtagaaatggggttttaccatattggccaggctggtcttgaacacctgacctcaagtgatccacccacctcggcctcccaaagtgctaggattacaggtgtgagccactgtggccggccagatgattattgtcattagggaattgttactaattctgtccattggttgaaagtagtaataatgtgattacaggaaggagggagagagctaacatcgcttacatctcttcaatgtgctagctctggtctagagggtttacaaatatctattttcgaaaaataggatctaattgactcaattttcagtgatataatgacaagcccatgattcaaatatagttctttctggttctaagcctctaggttttctactcctctgagctgtcttgcagttagtggtaaatgagtaaatgacaactgagaaggctgatcatttgcctttgtccttcactccagcagttatgctgtgtatttgggttgtgttattaatgtcatacttttggtctttggaatagtttgctaagaaataagagtaaaaatccaaatattgcctattcaatataaatgttgtattgtcatcctttatcaataatctaagaatttctatattcctctaaaatatgatttacttgataaaaaccaaaaacttacttctccagaaataaagagagatactgaggcttcacctcaaagattctggttttgggtacaaaaaaaaaaaatggttggaaagaatgagtaagacctactatttgatagcataatagggtgactatagtcaatggtagcttaattgtacattttaaaatggcttaaagaggccaggcgtggtggctcatgcctgtaatcccagcactttgggagaccgaggtaggtggatcacatgacattaggagttcaagaccagcctggccaacatggtgaaaccccatctctactaaaaatacaaaaattagccagacgtggtggcaggcgcctgtaatcccagctacttgggaggctgaggcaggagaatcacttgaacccaggaggtggaggttgcagtgagccgagatcgcaccactacactccatcctgggcaacaagagtaaaactctgtctcaaaaaaaaaaaaattaaaattaaaaaataaataaataaaatggcttaaagagtataattgaattgtttgtaactcaaaggataaatgcttgaggggatggatactccattcccaatgatatgcttatctcacattgcatgcctgtatcaaaacatgtcatgtgccccataaatatatgcacccactgtgtacccacaaaaattttaaaaattaaaaaaaaagatcctgattccattggtttggagcagagcctgggcatcagtatttttaaaagctccccagatgattataatgtgtagctaagattgagaacaactgatgtcggtatatgatcccataagaggaacatcaaagcaagtttgtcattctgaactgtggttcctttagtctttgatctccttagacttcagtcatgcaagctcaaccagtagcatcacttaaggctatgggagccaagggctcaggttgctgtataagtgtgtagttggcagtcctgcatttctcttgttggcttgccagaccatcactcttcgtcttgtaaataagctggttgcaaaagagacacacaatcacataccctgcttcctgtgactgacagccagttaatattatgttagcagaatgaagaggttgtaacctttctgctgaggtacccagaatgacttaggattctaacttaggagtgttttaattgtggtatcttttagttgagtcagctagacaaggtctttttgctgccatcttacagccttgtttcactctcatgggttctgctcatcacctgtggttgaaggttgagcctatatagtttgctgatctactgagcagaactcctagattctcaagatagttatagacagaaacaaggaaatttgttttctcatttacgtagtgattatagctctattagcaatatatctactattaattgtactttataatgaaagcagggaggctctcttaaccatttaattatgtttgtaccattatagttgaatgggacagccacacctgggatctagggcacagccgtacagtctttatcttcctagagtaaagcttacattcaagagtatttatttaatgctgtgtacaaagataccattataaattttggtttggggaaaatctaacacatccccaatttatcactaaatcttttggccagttcttcagaaataccagggagagataatgtgtgcatctaaagaggtcatactgaactgtccaagggctgcctttcatgcagcaggttctcagtataccttcatgatgtgctacggctgagtcaacaaaaatagcaaagccagctgtagattactaattaccagttcagttaaaaatctgcataccggccgggcgcagtgactcacacctgtaatcccagcactttgggaggccgaggcagatggatcccctgaggccaggagtttgagaccagcctggccaacatggtgaaaccccgtctctactaaaaatacaaaaaattagctggatgtggtggtgggcacctgtaatcccagctactcgggaggctgaggcaggagaatagcttgaaccagggaggcggaggttgcagtgagccgaggtcgcaccattgcactccagcctgagcaacaagagtgagactctgtctcaaaaataattaaaaaatctgaatgctaaaattttattttttgtttaggattagttgtgccatgtttgcttatattgatgttactaactatagagatattgtattttattataaaccttttattttctctttataggtatgggttagaatgtctgttcaggttttatagttatggactggaaaaaaaattcaggcgagaaatttttcaggatttccaagaagaaaccaaaaaagactacgaatctggtaacaataacatcagaaaacttgtactctaattggaaattgtaaacctgagtctgtcagtaaatagggaaggagttcatagtttttttcttcagggcaaaccatttaagatcttcatgctattgttgtgtttcttgatgaaggatggggcaccaggtagtaagaaggcctttcctgggaggtgttggaaagtaactactctcaagtctttcttttatggaggtatattttgtcattatccctttgacaaacgtggctactcactgatgttccgttacatgaaaattctatgcaacatcagcaggtaagcttggaaaggcagaaatagcacagtggttaagagtgcaggctctgggacagactgctaggtgcaaattccctttccactatttagaagctatgtgattgtgggtaaattgcctacccttgctagcctcagttttctcatctgtaacatatatgagaacacccatcttttgggttgtatatggttcaaattagtttgatgcataataaagcacttaatgcttgttacataacaaatgctcaataaatattagctgccattattggttaattcattacatgtcttattctcaagatctagagtaagcatatattggaagataaattgtttattgctgataggattatatttaatgtgaataatttttaaaatttcatataattcataatgtatattattctttgttattaggtcagctgtatggactagaaaagttttgggcttatttgaaatattctcaatctaagacacagtctattgacccaaaacttcaggaatacctctgtagttttaagaggttagaagacttccgtgttgatgtaagttttaagtcatttcctctattctttttattatccatatatttcagtctcttatcagtgactttttaagctttaattttgtaatttttattttttaactttttagttttaaaattaaactttgaaatagatataaaaatagttcagagaattcccatatactctgttcactcagatttcgcaaatgttaacatcttgtataaccacagtgcaattgttaattcaatttaattttcatatgctgctataattaaacattttctagatttattaatttttacctgatatgctaatttgtcactagcaatgtgaaaacttttcactttttaatgatcttttatccatataattcctgtaacatgtgctgatatggatttagggtacctgcataataaaattaaggagagaatgttgtgtgcatgtgtgcaagcacaagagtggtgtcttttagttgagtcagccagacaaggtccttttgctgccatcttacaacgatgtccactctcatgcgttcttctcatcacctttggtggaaggttgaacttatataggctttatccatttgatttcaagaggaaaagaaaagcattaaaaaatgtcacgaatgtaagaagatagaggaaaaggaggaagaagataaataaaaaataaaggaaaaagcctgggtgtggtggctcacacctgtaattccagcactttgggaggccgaggcgggtggatcacctgatgccaggagttcaagaccagcctggtcaacatggcaaaactctgtctctactaaaaatacaaaaattagctgggtgtgatggtgcacgtgtgtaatccctgctactcaggaggctgaggcacaagaattgcttgaacctgggaggtggaggttgcagtgggcagagattgtgccactgcactccagcctaggcaacagaatgagactctgtctcaaaaaaaaaaaaaaaagggaagaagaaaaattttaaatttaaaaataggaaagaagtaaaaggaaggctaggttcatcatctctgctttgtgttgtaatttgtcttgcagttttgtgtaaatggacttgatgacccagggatagggttaataaaagtgcctgtctctggaattaagagctatttttctagagtggcctagccagttctgtcacaaagacatccttgctctatatttgagactcttgccccatctgaacataagctaagaattcaggcctccttctttaagtacaacggaagattggatgaggaggttactatcttagtttagctccacataaaaatactagttcattggtgtccagttctgggctcccaaatcttggtaactggaaaggcataaaaagctgactttttttgaatgcaggataccttttcactgggtacttaaacgtttgaagatgtttaaatttggtgccatcaataatattctccagtctcatcataggaattctagataaaccttcaaacttgctaacgataatttaacttggcatctcttttattcccctactgctttcatttatctgttatttaaacattttcacttaagcaagcctggaataggagtttaggattgagaaagagactggaaatacaaatcctttacagttgatgaaattaataaagaaggcaaatagcctcgctgaaacattttcttggagccaaggaacccagccttatagttatgccccatcagatagctcaggccctaaaaaatgagagaagcttagtaaacatgtgttgaggccaggcatggtggctcatgcctgtaatctcagcactttgggaggccgaggcgggtggatcgcctgagcttaggagtttgagaccacccagggcaacatggtgaaaccccgtctctactaaaaatacgaaaaaattaactgggtgtggtggcttgcgcctctactcccagctacttgggaggctgaggcaggagaatcgcttgaaccccaaaggcaaagattccagtgagccgatgtggcaccactgcacatcagcttgggctacagagtgagactctgtctcaaaacaaaaacaaaaaacaagcaaacaaaaaaaacactcgggctacagagtgagactccgtctcaaaaacaaaaaacaaaaaccacaaacatatgttgagtaaaagaatgagcaaatactagtaggctgatttagttaggaaggaaatttaagtttagtaccttaagttgctgttaagtttttgttatactaatacaatctgtgaggcggaagaatggcgtgaacccgggaggcggagcttgcagtgacccgagatcgcgccactgcactccagcctgggtgacagaatgagactccatcaaaaaaaaaaaaaaaaaaaaaaattatactgaagtgtccatttaacttacttttttggggaaaagtctagccttagattctgaagggaggaaaaacagtaaaattgtcaacggtgttgcctttcatcatttgcagccccctattagtgatgaatttggaagaaaaagacattcctctacttctggtgaggagagtaatcgtcatagacttccacctaattcctctacaaagccaccaaatgctgctaaacctacatctaccagtgagcttcaggtaccaataaactctcccagaaggaatatttcaccggagtccagtgacaattcacattaaacagtgctgcctgtgtcctgtggtctcaagaaatggtgaaatgcctgagaaatagactcttatgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctgaattttttgaattgatttttaattatttttatttagaatatagttgaaaagctgtaatattcagttttgctagtaaaagaccatttttttgtgtgaatgaagtttcaattataaacttacattcactttattgagcactacataatttacagatattttgttgtattggcaaaagcaagtggtttccatatgctaaattaattgtattttctttttgagcagattggatatcttgttcttataaattataatattgaaatacatataatctttggatggatgggctgttaatttgtaaataggttttcattaagttatttctcatgataagtaataatcagcagttttataatatttactatttggagggtcattttgatgctttaaattgcagaaatagtcaaatttgaatattcagaaaataaatttatttagatatattgtaaagagggtgcaaaacaagcaatgggttagaataatagatcttcaagtcttttcttaaatggggtatgtagttccagcttttcagtgagaaatttccaaaccgtgcttattagctttaaatggtctcttgaaatgatcataaatttttctcagtgtcctttttgtgttgaacacatatatctgaaacctgtatttaaccagatatttctactcaactgaatatacaagtgtaaatttgattggaaaattgtatattataaatgaaaatacaataatcaggagttttgtggtttgtattaattagtagttttatcatatttttattataaaagtaatacatgtacattgggaaatttagaaaagcacaaagaagaaaataaagtacttgttataaaaagaagaaaaaccaaaattggtgtcaggctatatatagtgttataacctgcatttgtcacttaatggagttgaacattttctgatgtcattaatatttctcattactttttttttttaaattgtagagatggggtttcaccatgttgaccaggctgatcttgaactcctggtctcaagtgatccaccttcctcggcctcctaaagtgcttgaattacaggcatgatgagccaccgtgcctggccagtgatgtcattaatatttctatttcatggcttttactagttacatagtattccagtgtgtgaatatgccgagtttacgtagctaactgctgactgttgaactttggctgtggctaggttttagctgttacaaacaacaattaataggctgggcatggtggctcatgcctgtaatcccagcactttgggaggctgaggcgggtggatcacttgagatcagaaatgcgagaccagcctggccaacatgatgtgaaaccccatctctactaaaaatacaaaaaactagctgggcgtggtggtgcatgtctgtaatctcagctactggggaggctgagacaggagaatcgcttgaacccaagaggcagagaggttgcaatgagccgagtccgcaccactgcactccagcctgggcgacagagtgagactctgtctcaaaaaaacaaaaacaaaaacaaaaaacaaacaaacaacaatgaatagtatccttacagataaatctttgtgtataaaagagttactgtcaagaactcctagaagttggaactctaagtaaaaacgtgtctccatttaagacctctaggaaggttgcacagtttacacttttatcaacatctgcttccctacatccttatcaacaccaattatgataaatctttctctttagactgataagcaaaaaatcatttaaatctctctctttttttttttttttttttttttgagatggagctttgctcttgttgcccgggctggagtgcaatgacgcgatctcgtctcactgcaacttccaccttccagatccaagcaattctcccgcctcagccttccgagtagctgggactataggcatgcaccactatgcccggctaattttgtatttttagttgagatggggtttcaccatgttggctaggctggtctcgaactactgacctcaggtgatccaccttggcctcccaaagtgctgggattacaggtgtgagccactgcgcctggccactaaatctcattattaatgtcaccattttaatcattttaaatgatttaatcattttaatcattttaaatagtgaccattttaatcaggtcactaatgagcaataatttttattgcttattaaccatattgtttgtagattgcttgaaaataccccttacgttttccttttggagtgattatctctttctgataaatttatggagtgttttcacttatcaagaatattaaccctttgctttctaattttgcttatgtatgcttgacatggtatgtactttttttgggtaaaattttaaaaaactataccccttaaagaaattctgaatgtaaagctcaagcaaataaaagcactgctatttaatgaaaagaaaaacattattgactataaatctaaatggccctacccaaaatttatgaaagtccctacagaccttagggcttccttttttattattttgcacaattttcaatatcaaaaaaggcaatgctaaaaatgttattcaaactcctcctcctccttttaagagattagttgaagctgtctttgacattttctatataaaaggaattagtggggggaggagccaagatggctgaataggaacagctccggtctacagctcccagcgtgagcgacgcagaagacgggtgatttctgcatttccatctgaggtaccgggttcatctcactagggagtgccagacagtgggcgcaggccagtgtgtgcgtgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagactatatcccacacctggctcagagggtcctacgcccacggaatctcgctgattgctagcacagcagtctgagatcaaactgcaaggtggcaacgaggctggtggaggggcgcccgccattgcccaggcttgcttaggtaaacaaagcagccgggaagctcgaactgggtggagcccaccacagctcaaggaggcctgcctgcctctgtaggctccacttctgggggcagggcacagacaaacaaaaagacagcagtaacctctgcagacttaagtgtccctgtctgacagctttgaagagagcagtggttctcccagcacgcagctggagatctgagaactggcagactgcctcctcaagtgggtccctgacccctgacccccgagcagcctaactgggaggcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccgtcgagactaggaagaaactgcatcaactaacgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctaataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactcaggattaagaatctcactcaaagctgctcaactacttggaaactgaacaacctgctcctgaatgactactgggtacataacgaaatgaaggcagaaataaagatgttctttgaaaccaacgagaacaaagacacgacataccagaatctctgggacgcattcaaagcagtgtgtagagggaaatttatagcactaaatgcctacaagagaaagcaggaaagatccaaaattgacaccctaacatcacaattaaaagaactagagaagcaagagcaaacacattcaaaagctagcagaaggcaagaaataactaagatcagagcagaactgaaggaaatagagacacaaaaaacccttcaaaaaatcagtgaatccaggagctggttttttgaaaggatgaacaaaattgatagaccgctagcaagactaataaagaaaaaaagagaagaatcaaatagacacaataaaaaatgataaaggggatatcaccaccgatcccacagaaatacaaactaccatcagagaatactacaaacaactctacgcaaataaactagaaaatctagaagaaatggatacattcctcgacacatacactctcccaagactaaaccaggaagaaattgaatctctgaatagaccaataacaggctctgaaattgtggcaataatcaatagtttaccaaccaaaaagagtccaggaccagatggattcacagccgaattctgccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattacccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaagaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcgtcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacagcagttagaatggcaatcattcaaaagtcaggaaacaacaggtgctggagaggatgtggagaaataggaacactttgacactgttggtgggactgtaaactagttcaaccattgtggaagtcagtgtggcaattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcgttagtgggtgcagcgcaccagcatggcacatgtatacataggtaactaacctgcacaatgtgcacatgtaccctaaaacttaaagtataataaaataaataaataaataaataaataaataaataaatggaattaggaagggggttatgtttatattattttagctttgaaatacattttattttattttatttttttgagacagagtttcgctcttgttgcccaggctggagtgcaatggcacgatctcggctcactgtaacctctgtctaccaggttcaagcgattctcctgcctcagcctcctgagtagctgggattacaggcatgtgccaccacgcccggctaattttttatttttaatagagacagggtttctccatgttggtcagggtggtctcaaactcccgacctcaggtgatccacccacctcagcctcccaaagtgctgtgattacaggtgtgagccactgctcctggctagattttattttttaagcttatgttagtttggaactccactctgacattctgtatgcttcttgccattttacaaagtagtgtcaccactttcctttgtgtgtttaatcttttccttcaactaatttcttggcttttatgtaactattatttttattttattcttgcataggaggctgatccgatagagtaatacctaattatatcaccatgagatggcaaaacggaatgtcagatctgtagacttttgacaggaaagtgagtatgtgtgtgtttttgagacctcttactccatcttgtggtgatatcatataattatatcaattactcttgcattcctaatagtcatatgtgtgtctcacaactcgttacgtggttaggcattgccctagttattggtaaatttgcattagttatttggttattagtaaatatatatgataacattaagacttgtgtatagttaaaaatggaaatacttttgctttggtattgtcctttcacttaagagtttgaagtacttcattagcattatttttttaactcttgagatgtgaacaaagcaagcagattttaaggtatatctcctggctaacctaagccatgtagttaagtcacacagcaagttaatgaatggatcctacctaaaacacgataaacttaaaactagttgttaatcttgtaactagaacaaagtgttatcacacaactagttgaatggctgagctagcgtttgaactccagtagtctggcttcagagcccaggctcttcatcttaaccagattgttctttaacagcgtgaaatagaacacagaacccctgactttcgaactcaactgcaatgattcttaagtattataaatcaagattggattcttgtggttaagactgcatttttttttgatgataggcatcctctgcagtaatggagggtctaatggagtatttaaaaacataaattatgtgataaatgatttacaatatatgctaaatcttttgggaggaaattttgattaggaaacaaatatcatccatgtgtttaaatgttttcctagaattagataaggtaaaatacaaatgaaactgagcattttatttagaatttgcttagaaattttgcattagtttatttagggttattattgacaactgaagattctgaactgttcggcttgaaggaaatatcccacaaggttaattgataggaatcaattctgactttacactctgtgtcagttttctgagttctttacaataagcctgttttttccttgcaaattgagaaatactttggttaatagaatggtttctaacaatatactgcacgtattagcttcaataaattctagaaaccagaatccgctgctattgttttgtttttttccagatagtgttccaagtctacaaaattgagtacctttctccatgtgttttaagattcattagacttttattgtaacacaaacattatcacagtactgtaatgcttaatgttaacattttctggtttccagttgaatgcctttaagtataatctgaggtgagacttattttaatgagtcagtggatggactttaagggaaagggtctgtgagagccaaaatttagttaactgctgctctagagacagcttatttgttagaaacatgagttgaatcctggcccctctcactaagttacagtcctttatctacaaaattacacttacctcatagtgtcctgaagaataaatgcacagcatgtaacacagtgcatggtggtacagtaagcacttagtaaacatgagctatcattagggctaagcactggacaaattatctccaggtattgcaaggtattttctccagtaggctgtgaatataattttaaattttcatgggaaattaatctacttaaaacattttaattagtaaggaaaagtctgattttaattgttttattgtcctaacatagtggtttatgaatgcttttctgcccttgtggtggttcactgacttccatgtgagaagtagtagagttgcttagatgccgttatttctactgaccttgaccaagtgacaagagcatgatttccatgaagcagttaccatgaatctgaaatcacaccttcagttttagttctttccctttgttttttaacaattttgcttattatgttttcccagaatcaccatgatcgattacttctgctcatcataaacatctagttcctaagcaggatatgagaatctgccttcctgtgacctctcctgggctcagtgacactccagtcgccgccccaccccacatcaatgccacttccaagtttgacttgcatcttacaaaccatatttctgtttactttttttctgccctgggacatttttaataacttttagataacaacttcaacaaaaatttacctcccaccaagagaagttgtctttattgtgagaagttgtctttattcccaagaaggggaataacttactctttaagtcagttttattacaggtaaatttgtaccagctttttcctctacttgtgttaagacctgtctccaatagacattccaattgaggattgtggaaatagcaaattacattggtgtctgcccaccactgaaggcaaaaagctggtttatctaggccacaggcagagcccgcaggggaggcaggtaacttctcggaccaccagattatcttgatcttcagccagctttattgttgttctacattttaataaacactacatgtttattttattttattttatatgtgttatgttatgttatgttattttttttgaggcagagtctccctgtttctcccaggctggagcacagtggtgagatctcggctcactgcaacctccgcctcccaggttcaaacgactctcgtgcctcagcctcgcgagtagctgggactacagacatgcaccaccatgtccgcctaacttttctatttttgtagagatggggttttgccaggttgcccaggatgatcttgaactcctgacctcaattgatcctctctcctcagcctcccagagtgctgggattacaggcgtgagcactgcgcgcctggcctgttttattattttgaagattacagtataggtttctaggaagcctggatggaggttctcatattctaggtaatatttagctatttaataaaaatttattttcaaaaccttaaagtttgtggattacatacaatacagtttttgacttggtgcatgaatgtattgaaatgaacttgataccattatattcactttaaagcatatcggcacaatttcctagaaccaatctctaatgactattcctgaaacttttcatacttgtcatatttttccattcaactatgttatttacttatttattttaatttttttgagatggagtcttgccctgtcacccaggccggagtggagtggtgcgatcttggctcactgcaacagcctgcctcatggcttcgagcgattctcctgcctcagccttctgagtagctggggttacaggcgcacgctaccacacctggctaatttttgtgcttttagtagagacaggtgtcatcatgttggccaggctggtcttgaactcctgacctcaggtgatctgcctgcctcagcctcccaaagtgctgggattacaagcctgagccactgcacccggccttgactatgttatttaaatcactagtgcctaaactttgctaaagtgatatagtaatagctcaaataatcgtaataaggatattttcagaataaaaaagaatatcatggaagttattacccaagtaaaacttcattccaatctttgcattttaccttctctcaactatgagaagtcaggaatattgtctatcttggttaccattatatttccaacaaagaagaataaaagaaagagggaaagaaaagaggaggaaagatggaaggaatatcttgaaatcctgtcatctaaaataactatcatgacatctggcatatataacataatattttgcctaaattcttaaactatacaaggacaatatatgtaagatattttatttatatttatttatttttaatttctcagcaaaagccacattcaaatatgtaaggtattttaaacaatatcacaagtgctgaagagataaaacacataagagccaaaagagtgaagactgatagaaggcaggctgtaactagaaatccttctagccatcatccagggaatggaactgtatatgagattgaagtatggttatagctaaacatacttgcttgattttttaaagctttacacagttgattcagggtaattattgtgttatctttgggggattcttgatcctgaacaaagcttcattgttagtactactacgttaaaagtcctattgagtgaaacagaggatatagtctaattcaagggccaagggaaggcatcaaaatatttaattggtttgtcaaaaactcccacctttagaaactcctgggaggtgcagtggctcatgcctgtaatcccagcactttcgtaggccaaggtgggaggaacacttgaggtcaagagttcgagaccagcctgaggaaatagcgaaatccagtctctacaaaaaaggaggaagaggagaaggagaaaaggtgcacaaattcctaatttttttcctccactttataaaagaaaggcattgtcctgacctatcccaaatactgctgtagttatgcaagctgtcatgggccacacataggtgaaatcttcatagtaattcattgagctatcataaacccacaagacttgctaaatttctcttctttataaatatttatgggtaaagctttgtatattgtggctagtgtacactgtattattcaatgagggatttagaacacatttttatcaaatcataaaatatgcattacaattactatgagtccatcctacaaaatgtttaaaattgttaactttttatttacaaaatatattattttaaaaatagctgctaaatttgtttttagtagactaaagcattctgtttcattagatttattttaaaagttgaatcatgatttttctcaagacaggcatttccagtaaatctgtggccaagattgtcgagctgtttacccaaagcatttctagaatgctagactgcattcctgtcctcctgctctttcaggtttgccaatataattggttctggttattggaaagcagatgaagtaaggggctccacttctagacttggccacgtgccatcttcatgctcattcctttcttcttcagctatacagaagccatatgttgaaaacaacagagccctgaggagtagccctgaatcactacctagtccttttggggactctatattaaatcaagaaatagcttttaattatattaagccacaagattttgaactttatctgttacagtagctaatattaacttaagtgataataacaaatttactacttatgtttaataattaccaaaatgtgtatatattgttgttgtctcgatcaattctatattaatatttgtaataactcaagaaaagtttttatcaactagaaccacttatagtcagagtaaagtaaaattttaaattatgtacttatttttgttttaatacatttacatatctggtcaataatattttcaaacataaaaacattatgataaaaatctggaaaaaatgggatagaatacaagctcaaggagaaaaaggaaagatgtaagctttctaaaagttaaagaataacttgctcatatatttaaaaaaatagatccaaatgttatatatttggatttcgttggattcgcttaaaatgaaatttataatatgctggaaattatgacctatgcaattatttaaaattataaaaagcttagatgtcagcttaaagcttcatgagggatatatagcttatgaaaattattttagggggttttcaagcaaaaaagtgtaaatgcactgacaaaagggggaaggtgcatgctttggagttaagtagccctgcatccaaactctgcttttgctatatgactgggcaagttagattaacccattggcccttattctgctcaataaattaaatgaaaatacatgtaaagtgctatctggcactaacctgctcttgctattaaaaatcttaagtacttctaggaaggaaaaattagccactcaggtgaaaattaattaatcagagcccatatttctgagagtagattaaaaaattaggtacagaggggaaagaacttatttgggagagaaaggataattttagaacatgtagtataagccaagagaagaagctctgttacatggcagaatgatactggatgggaccctattttggaggacatccggaaaggttggcgaggctgtacataaaggaaaagtgagaagaaagcatacatttgctttcatttgccttggttctagtctaccatgcaatgaaaatagctctcatattttaaagtcactcaaaagattgcttttaagtgggtgtaatgattttatatgtaccctaaattacagcatgtgctttatgaacctcctcccttgtgttccacgtgactcctattttaagtagattcaaagtgattccagagttaaccaggtcaattaccacctgtgcttgtttcctttaattcttttaaatccctgagagaaaataagacattaagttagcaatttctttttctaatacccctgattacagtgtgtacctattgagacatcggataaacgctagcggccatggctggaacggaagctagggaaggctgtggagttgcaaaagttcctgcctgctaaacagggcagatgcagttaaaataatacctggcattgtctgaccgttctattccttcatgagccaccttaaaattcagatttgttgctagagttcttatatttaggaagggatcagagaaagtcacaagagaaccatattttgaaaaacagtagccaatgttggtagaagtataaattggtagaaaacctctatggttaaaaatttagcaatagctttcaaaattttaagtgcatttgccatttgacctggcaattccacttctaggaatttaccctgcaaataaaatctttgcacatgtgtgcaaagatgtaaatactcatatagtcattactttaaatagcacaagattataatgagtatttgtcaataaaagtgattaatttttattgtatggtcatataatggaattccatgaagtatgacagctcaacagttgataaggaagaatggaatattccttaaggagtgatctgtaagatatattaactaaaaaaggcaaggcacacagcattatgtcttccaccttttggttaaaaaaatatacaaatatgttcatactgtatacatgaatatccttacaaggataaataataaagtgataataatggctgcctgtagaaagagttatatgagagagaatttttatcctatcaccttttgaattttgtgttatatgcatatttaaaaaaaaatttttttagaaagttcctaaacttcacgaggctgagaaactaagatgtattgctgttgcctggtcttaacagcccaaatacaatatagaagacaatgtgtggtgcaaaagcatttggttttgttataaagacaaatagtacagcatctatgtatatccttctggacttgtgggtgttgggattttaagcaggagataataaattatgccccctttgttccccttcagtgtgctgcaacaaatcagatatacccaggatgcagacagaaagggagcaaaatagccatcactaccaatagtgctggatttgacaactgggtttaatacctatgcctttgctcagataattaaacttgccatccagagacagctggacaaatgcaggcctctccttagaggcaaccagcttaacacttagaagaggaggaagagatgagggaagatcagtcagttccacagggagttatggctggtaagaggaagggagagaattgctgagcagggcagcttggttcctctgccagtctcatcaatcactcatacatggggaagagttgggagcagcggggaggaggaaagaaatactttttccagtacaaatgcctgaagggtttcaaatttctattctgtggactctggcaggaacactgggaggaggacagactggtttctcctgaaagcagccagcactgctgccatccagggctctccttgctgcctgtcacctgtgccagctgttccctcacagttcccttgcatcacctgtctcctttgctcacactggtttgattactgccccttgcatgccttgcacagtttcctaccttttgcactcaaaatagtaatgatccccttttctccccaattggctcttcaggtccaaatcgagctctagctctggcagtcccagggacagcatctttgtgctcctctgagccttttcagaacttgttttctgacccctgttttggccccagcatgtgctgcccgtcttgttacatttctctttatgattccaggctttactttctttgcttttcagtcctaaagtaatccatcaagcttaactttttaaaaaagaaaccctatgggctgcagttatacaatatatacctggataactaagataaatttggactcattttcatatcccaaatattgtatggaagacaatgtgtggtagagggattaagatgtcctttcctagactgtggaacttagtgtgcaatgagggaaatttaatctctctccctgcccccatctcctgtttcccaggatactgtggcaattgtttgttcatagatgcctcataagctcttggaggcgactgagaattaagttgcttattaattcatttagtcttgacctacatatggttgaataatcacagggccatctgtcctccttaattaacatgcagagatgaagagatttctttctaccttctgtggattgtgtgtgaatcctgtcaagagggccccaaaacgactgctgccagagtcctggcaattgcttataagtgaaaccaacagctaatggggagggcttttgttgttttctcttattttgtcttttttaagagccctcctgttgtgattagcccttgctatttcaccagctgaaggcaatctcataaatgaatcagcaatagtatatctcctttcaggttgggaagatagaatgagaggctttcccagatgcctgtgagtttcatctctcacaggcttccaggcttctcacaaagccctcacccttggctgtgtgaaatagacggattaaaacactgtattacagagcattgcttcttcttggttgttgacatgaagtgtgatgggttaagaagctgtcaactaaaaccagacaaacccttattgatgaaccttggagtatctgtgaacttttatgaccagaaaattctacttaacagttatcaaggacctgaccagatgcttcatagctcttgggacggatgattaatagttgtgtgagtaataatagcttctgtgttagagtgctttacagtacacgaaaacctgttcacacactttacgtcacttgagcctcaagatatctctgtgaggtagggcaggtagtataatccccattttacagatcaatgaaaataaaagcataagtaaactgagccttagagcgctaagagaattattaaggcccactccttttaaatgcagaggcaggactagaattctgattctggtccccttgtgcagtgctctttccaatattgtaccctgttggagttttcatacatcccttaattacagtgccatatgccatgtccatttagctgtaatgtgaccacaagctgcaatatactgtgaggagtgcagggtggaccattctgaccaaagacattaaatgggatcttgccagaggtggagaactgtgagataacctgaattttgagtttcccctttttctcttgaatgtgtccaccacatacccaaattcacctgcataaaaatgatgactaccaaaacaatcttgaaaaagaacaaagttggaagacccacacttcccaacatcaaaacttactacaaagctacagtaatcaaaacagtgtggtgctggcatgcagacagacatatagaccagtggaatagaatggtgtgtctagaaataagtcctcacatatacaggcatccactgtaggatgacattttggtcaatgatggactgcgtgtacaacagtggtcctataagataatggagctgggccggaggcggtggctcatgcctgtaattccagcactttgggaggtcgaggtgggcagatcacctgaggtcaggagttagagaccagcctggccaacatggtgaaaccccctatctattaaaaatatcaaaaattagctgggcatagtggcgggcacctgtaatcccagctactcaggaggctgagacaggagaatcgcttgaacccgggaggcagaggttgcagtgagccgagatcacgtaattgcactccagcctgggcaacaagagtgaaactccgtctcaaaaaaaaaaaaaaaaaaaaagacaatggagctgaaaaattcctattgcctagtgatgtcataatgtcatgacattactcatgtgtttgtggtgatgctggtataaacacacctactctgctgccagtcataaaagtatagcacatttaggtacagtacatagtacttgacaataaacaactatgtaactggtttatgtatttattatacttttcaattatcattttagtgtttactccttctacttattaaaaaaacaaaacaaaactataaaacagccttagccaggtccttcaagaggcattccagaagaaggcattgttatcataggagatgacagctccttgtgtttcattgcccctgaagaccttctggtaggactggatatgaaggggaagacagtgatattgatgatcttgaccttatgtaggcctaggctaatgtgtgtgtgtcttagtttttataaaaaaaagtttaaaaaattaaaaaaataaaaaattttaaaaacagagaaaagcttatggaataaggatataaaggatttttgtctttttttaaagtttaaaaagttaaaaaaaaattttaaaaattgaaaaaagcttatagaataaagattaaaaaaactctgcacaactatttttgaaacttttttatagtatgtgttttaagctaagtgttatatcaaaacattaaaaatattgaaatgcttataaagtaaaaaagttacagtaagctaaggttaacttattgaagaaagacaaatatattttataaaggtgtagcccaagtgtacagtgtttataaaatctacagtagggtaaagtaatatctaggccttcacattcactcaccactcactcactgactcacccagagcaattttcaatcctgcaagtcccattcatgctaagtgccccaaacaggtataccatttttatcttttatactttatttttattgtacctttaccatatttcctgtatagatgagtctacttttatgagctacttagaataggcaagttcagagacagaacctatatcagagattcctgtctagatatgtttagatacacaaatacctgtgttacaattgtctacagtattcagtagagtaacatttgtgcagatatgtagcctaggagcaatagctttaccatataagctaggtgtgtaggaggctataccatccagatttgtctaagtacactctatgatgtttccacaatgatgaaattgcctaatgacacatttctcaggacatatccctgttgttaagcaacacgacagtatagtcaattaatttttgacagtagagacaagaccattcaatggggaaaggattacctattcaacaaatggggctgggaaagctgggtatccacatgcagagaatgaagttggacccttaattataccacatacagaaattaactcaaaatgaaccaaagacctaaatttaagacacaaactataaaactcttagaagaaaacctaggggaaatcttcatgaccttgaatttgacaatggtttcttaagtatgtcaacaaaagcacaggaaacaaaagaaaaaatagatattagacatcatcaaaattagaaacttttgtgcatcaaaagataccataaagagaatgaaaaacaattgtggaagaaaatatttaccaaccacatatctgatcagggattagtatccagaatatataaggaactcctatagctcaacaacaaaaaaaacctcagttcaaatatagatgaaggacttgaataggcatttctccaaagaagatatacaaaagaccaataaacacatgaaaagatgctcaacatcattagccattagggaaatgcagatcaaaacccaaatgagaaacactcgagttattccctaataactaatgggcttttttttttaactcctcttactattattcccagttgaatgggctattctaaagcaaactaaacaaaacagaaccagaaaataacaaatggtgatgatgtggagaaattagaacacttacgtatttctggtgaaatatgaatggtgcctcccctgtggaaaatactttggcagttcctcaaaatattaaacttagagttactatatgatcagcagtttcacccctaggtctgtgttaaaaagaattgaaaacagggactcaaacacatacttgtacactaatgttagcattattcacaatagccagaaggctgaaacaacccaagtacctattgacagatgactggataagaaaaatgaggtctatccgtacaatggatattactcagccataaagaggaatggaattctgaaacacacgacaacatagatgagccttaaaaacaagctacacgaaagaagccagacatgaaaggaatattttatgatttcactttgtaaaaaagcaattattttgggtacatatgattccacttttatgagatacttagaataggcaagctcagagacagaacttagattaaagattaccaaggggttgggggaaagggaaatgggaattgttgcttaatgagtatagagtttctgttcggggtgatggaaaagttttggaaacagggagcagtgatggttgcacaatgttgtgaatgtatttaatgccactgaattgtacacttaaaatggtaaattttatgttatatatattttaccaccataaaaacagatttgaacataatttttaaaaaattacagaccaggtaacttcatagagatagagaagcagaaattcacagctgctcagaaaataatcataaagctagttggaaagaaggggacaggatgtgagtggctgaaaccaagaggggtgaattggagacagcttcaaggaaaagcctgtggagtaagaagggaaagagcacggttgttaagtgatcatcatttggcagactccgcagggaaagcttttatgtacttttcatttcatcctcacggcaattgtgtgtggtacatcctgttagtaacctgtttcatatgaaggaacagaaccttaagttaattaagtcacttgctcaaggactcacccagtgagtggcagagccagaaatcaaaacccaatctgtcgcttccagaacccatattctaattttgtcaatctcaacttttttggttaagaactggaacagggctgggtgcagtggctcacatctgtaatcccagagctttgaaaggctgaggcgggtagatcacctgaggtcagaagttcaagaccagcctggccaacatggtgaaaccctgtctctactaaaaatacacattagccgggtgtggtggtgggcacctgtaatcccagctactcgggagggtgaggcaggagaattgcttgaacccgggaggtagaggttgcagtgagccgagatggtgccattgtactctagcctgggcagaaagagtgaaactccatctcaaaaaaaagaaagaactggaaacaatatccaccccacagagttgttgtgagggttaaatgagaagtaatttttaaactaggaagttctaagtataacaggattttgcattttttttgactgctttatcctctatgcccccataggaggctgagaccttttttttacagccctctataccatagtagattgttcactaaagatcgttctaccatttgtgcatttcacaatggcaaaaactctattttattaattgttaaaaaggtatgtgattttttttttccagacggagttttgctcttgttgcccaggctggagtgcagcgacgcaatcttggctcactgcaacctctgcctcctgagttcaagtgattctcctgcctcagcctcccaagtagctgggattacaggcgcccaccaccacgcctgcctaattttgaatttttagtaaagacagggtttcactatgttggacaggctggtctcgaactcctgacctcaagtgatcccccacctcggcctcctaaagtgctgggatttcaggcatgagccactgcgcctggccctaaatgttttttgagtgaaggtgatgtttgagtagaattttgagatgaaaatcatggcagaaaggatgggcaaggatacctataacaactgcatttgaaggccaaacaggcttctcattggagtggagggccagagctggcctattatataatagggaagaagagagttgaggcagggaagcaattagtgagaaatttggatctgaacagcctttgggactcaatgtaagattctgggaaggagacggatctctggagaacatgggtgacctcactgtgtaaaggatcctttggatgggaaagaaatgaaaatcggcaacaagatcagcattctgaactagaccagtggttgtcaggtgggggagatgggattttgacgagtcagcatcaaacattgcctctgtgtgtattactccaaagcttcctgaatccctactgtaccaaatggtatcattgcatcctcatggtcctcaccatcatgaatgctattatcttcagtcacagcaataataaccacagtagcagtgaatatgctatgagaccctaatgggtggaaaccactaaccagagctacaaacaaaagtttaagcctccacattcttttttttaaagatggagtttcactcttgtcgccaggctggagtgcaatggcacgatttcggctcactgcaaccttcgcctcccaggttcaagcaattctcctgcctcagcctccggagtagctgggattacaggtgtgtgccaccacactcagctaatttttgtatttttagtagagacgtggtttcaccatgttggccaggctggtctcgaactcctgacctcagctgatccacccaccttggcctcccaaagtgctgggattacaggcatgagccaccatgcccggccgaagcctctgctttcaaagtatctaaaaaggtgctagatcctcccaccaccttctaccctgtcctctgatgccagactctattttcttaaatgccacgtaaataaataatgtcattcagtgttgctgaaaagaaaacatcctaactccttagcatttaggccttccaaattgggatcttaattttttaaaaaataattttaattctttttagagtagattttatagtcacatggctcaaaaaagcacctaggtatatggtgaaaagtcttcctttccatttttatttcagttcccctatttgtttcctgtgtgcccttccaggagggcttctaaatatgtctttttaatgtttcccgcaccacctgcacagttttcccatcggatcatcctgtctttgaatgtgcctttgctgttcttctttctgcctgtaaaatactccttctacccggctatgaatctattaaaccaagaaatatccaagatttctccagggttgtgatttattgaccaataaaaagaaaaggagaaaagaggaaaggagctagcttctgtattttggacccaggaagtcaggaagagatacccaagctggagtgcagtggcgtgatcatggctcactgtaaccttgaactcttgggctcaagccatcttcctgcctcagcctcccaagtagctgggattacaggtgtgcaccaccacactcagctaattcatagactttaaacatcaattaagattgggggagctgacaacctttataaaaactgaaggcctagtatcatgaggatgcttttgactgcaacttccagagagcccaactcaaaagaacttaaagacctgggtaatttattttaatatttcctgtttttgaaaaatttatttaaagctataaatttccttctgagaaatgcttaggcaaatctcagattttggcatggagtttttctattatcacctaaaacccttgtgtttagtaaacatttcagttttaaaaaggtatcctttggttgttaacatctaattttattgcattatggcaggttaatttacactattcataatagcaacaaaaactttataggattaagacaagaataaaatattctaagacaaaaatataatatttctatgaagtaaactttaaagtgctagtaagggacatagaaagggatctggctaaagctgaccacagtggctcacacctgtaatcccgacactttgagaggccgaggaagccagatcacttgaggtcaggtgttcgagaccagcctggccaacatggtgaaaccccgtctctactaaaaatatgaaaattagccgggtgtggtggcacatgcctgtaatcccagctactcaggagtctgaggcaagaggattgcttgaacccagaggttgtagtgagccaagagcacaccactgcattccagcctgggagacaggagacaaaccctgtggcaaaaaaaaaaaaaaaaaaaaaaaagtgggggtgggggttaaatggagagatattcttttttttttttttttctttttgagatggagtcttgcactgtcacccaggctggagtgcagtggtgtgatctctgctcactgcaacctccgcctcccaggttcaagagattctcctgcctcagcctacctagtagctgggattagaggtgcctgccaccatgcccagcaattttttttttttgtatttttagtagagacagggtttcatcatgttggccaggttgatctggaactcctgaccttgtgatccacccaccttggcctcccaaagtgctgggattacaggtgtgagccaccgtgtccagcagttcatgaattctaataaatgcaccatactaatgtaagatgttaataatgtgggaaactgcatgtggggtatggggaactctctgtactatattctcaatttttatatgttcagaaatctaaaatgattccaaaaaataaaatctatttaagaaaatacatatgcagacaaaaagattctcatggaaatgcagcagataggagtagagtatggggatacagagaataaacaagtggaacaggagtaacgcgcagggtgccatggtgactgtgtgcctcacaataaggatggtcagtaaacagatcctttgtgccacaggtccaaaaacaaataaataaaagaaaacagtaagcaggcaaacaaaagcaacagtcaattctcactcctaatctcactggacttggcagcatttgagtcttttcttcttgaaccaccttattcgggtctctcagtccaccctctccccacacaatctccttttggctctcccttctatctcatcctctaaaacagggaggcttttgcagtttgtagtgctatggactcctttggtaatctgttgaatcctaggcaccctttctcaaaatacgatttttaaatgtacaagataaaatacatagaattacgaagaaaaccaaatgtatattggtttgattggtgtatatatgtgtgtgtgtgtgtgtgtgtgtgtgtgtacatggtatacacatagatataccattgtatatggtatgccatataaatatacacacacaaaaattatatatatatatatatataccattttgtaaacagaaattgattctgagcccccccttctcaaagccttctagtccattgtcatttggataaacaaaagtgcttgactgtgccattcctgcacaccactctgatggacttgatgacttgacatagcatagtctctagaataggcctcctttattacagaagaaaataaattatattgaaatatagtatcaaacatttaaaaaattattacatattaatataaaggcctaattgttaactcattaaacaataagatctaggagtctgcctactaactaccatcatttagaagctgtaatgaatataaattttatatatatatatatatttttttttttttgagatagagtctcactttgtcattcaggctggagtgcagtggcacgatctcagctcgctgcaacctctgcctccctgatttaagtgattcttctgcctcagcctccagagtagctgggactacaggtgtgcgccaccatgcctggctaatttttgtatttttagtagagacggggtttcaccatattggccaggctggtcttgaactcctgacctcatgatccacctgccttggcctcccaaagtgctgggattacaggcatgagccaccatgcctggcccataaataatatttcatgagagatagtctctcagccaaccaggaatagaaggaaacttcctcaacctaacaaaggggttctacaaaaaccctgcagcggtattttacttaatggtgaaaggttgaaatgttttctatccaaaattgggaacaacgcaaggatgcttgctcttaaccactcgaattcaacattgtactggaggttgttagcacagtaaggcaagaaaaagaaaagtcatcaagaatggaagagaagaagcaaaactatctttgcttgcagttagcatgattgtttatgtagaaaatcctaagagagctacaaaacacaaaacaactctcataatatgatagacaaggaaattaaatatgggcaaaagattttatcagatacttcactaaagaaatgtgtaaatcaccattaagcacaggaaaagatgctcaaatgcgttattcaccagggaaatgcaatgtgatattacaatatgtccacctaccagaatggataaaattgagaagcctggtagtactgaatgttagtgaggatatggagcaactggaagttgcatatactatggtggaaatataaaatgatacaactactttggaaatacaatttagcagtttcttattaagttaaacacacacttaccattcataacagcaattccattcttaagtattaatccaggagaagtaaaaacttctgtccatgtaaagatttattcaaagaagttttattaataatagctgcaaataagaaataacccagacaggtgaaagaatgaagaagctgtggtatatgtgtacaaaggaatactagtcaacaataaaaaggaataaagtttttattgcaacaacatgcatgaaacaatgtggatacatctcaaaacattatagtaagtgaaaaaagcaaaacataacatatcggttaaagaaaaaggcaaatctaatctaaagtgagagcagatcagtggttacttaagatcaggcaacctaggcaagagagaactttttggagtgagaaaaatattctttctcttcacagtggtaatggttgcattagtatatataattgtcaaaagtcattgaactgtatccttaaaatgaatgtatttgttgtatgttacttatatatcaataaagttgatttaaagatactgagttttgaaactcaagacagagttagttgactggaaagaaaaagaatctttgagttctgagagcctagatgttttcagtcctgaactgaaatcctggtctaaacaatagacatcagactgggtgcagtgactcattcctttaatcccagcgctttaggagaccaaggtaggaggatcacttgagcccaggagttcaaaaccaacctgggtaacatagtgagattccatttctacaaataatttaaaaattagccaggtgtggtggcacctgccagtggtcccagctacttcagaggttgaggcaggaggatcgccagagcctggaaggttgaggctgcagtgaacactaagatcacaccactgccctgcagtctgggcaacagagtgaggctatgtcttgaaaaaataaaccaaggaaacaaaaaacaatagttgtcgaacctagaacagaacaagagcatagtctcgttatccccggtagcccaactttgtcgaaaaacttactaggctggggaatgcggagaagagttcaataggaaagaaagtgagctattggttggagtcccaaagaaggggtcctatatcacccttgtgccccttcatcctccagccaagtcagatcagcttatagagacaagctgggagagtccacttgcttgtgagaagtagcaaggcccacagggcattcctgaggccactgtggcagggaagatcaggtggggctctggcagtctgagggatgtcctgtatgctcagcatgcttggaagagtggctggcaaaagcctgagaacaggagatctggaggggcctcacagctaggaagcggggagactattatatcagtggctgcagcataggctgcgtggttggagataccattgaggagacagcaacagtggacaaccaaaagggaatttattttggtggatgctaacatgaaggggttgatgacagagcaatggcactgatgccgtgagcccacagaagccttgtggaactaacttgccacttcagggacaaggctgtgggtggggaatgaaggcagggaaaaaattcatttgaaaaatgctcttttggcctctcttggagtagcctggcttttgtctctgctaacacatcagaccagccctgtcctccccaggattctctggggactctgagatgtggtgtaggggacagattggatccctaatttgctgccgacctcctttctgcaaactctttgggctagatcaatgtgagcgctgcaaggtgtaagcaagggaagccatcatcgatagcacaccatttccactttcattctgaactcttaactgacacatttacagaacctcttacaaaaatgaaaagttcaaatatccctctgttgtaaagaaacaagatgggcccagtggaatagtccatcttgtttctttactctttacatttggatgaagaaccacaccatttggtcttgggatccacttgaaaactctccaggactcagatttctgttcttatttctcataaggcacagtgtacgtgtgtcatcctctgagctgtctgtgatgttttccacctgaccacagctcatgctgtgtctcccaccatggtctggtcaggcaagctgtgtgtacacttcttgagaaggctgattgttgtgaaaacctttgccacagaaacaaaaacgaggggctgcctctttcagatacattcgccagcagcttttctcttatgacctctggaacacaattgcatcaactcagacatgtgactgggcagaaataccagctcaaagaccatctggttaagaatgaggcatacttcccagcttggtggatggcaaaatgtcaaaatgccccagggggatctgcctcatctctcattcctaaaatattcacaggctgactgtttctgacccagcctcaaaaaggggggttttccctggcagaagctgaagtgatcctggcctcaggttctatgtcttttggagcactgtcaggggcttctgtgtttctggagctaatctaaggaataagtgttgttttaggacagtcgtaattcagtgaaatttattgatgcactcactaagtgagcagatactgtcctgggggtagggatactgttttagtcttcctgtgctgctataaccaaatacatgagactgaataatttatgaaaaacagaaatttatattctcacagttctggaggctgggaagtccaagatcaaggcaggttcagtgtctggtgaaggccacttgttcatagacagtaccgtccagatgtcctcacttggcagaagggacagaagagcgaaaaggggacaaacactgtgtcctcatgggcagaagagtggaagggcaaacttgcccctgcaagccctttataaggcactaatccattcatgagggctccagccccatggcctaatcacctccttatagccccacattttaatgctgctgcattgtggattaagtttcaacatgaaatctggaggggcacaaacattcaaaccacagcaggcacaaagatagtcaatttctgctcttaacagatcaggcaacgcggggagggtctaagagagggaggaaagagacaatagattagatgctgatgacacagggtggccatgctatgacagaggtaggtgagcatagcaggggagaacagatgaggcacacctcaccccagagggctcatgggagtggtgttagtaaaggctttttgaagaaaaggatccttggactcagtcttgaagaaaaagtttggaattcgctaggcaaaggttgagagatttcctagaagatgagatgagatgtgcaaaggtgcagaggcaagagagggcctagggcactgtaccacctggagcgcatgatgagagatcagattgaagatggcagtggaggcccagtgatgaagggccatgaatgtaatgctaacagcttgcaatttgtcctctggggacagggaaccattggaaagagagccattttgtcagtggagcgatcttaaatgtgtgcttaagagaatatatggaactgcggggacagatccctgagagggagtgggaggtgaagaattggagaggccttctaagatgatgaggagttatatttggcagagctgggtgggtgggtgggtgggtgggtgtggagtagagagcatgggccaaggaagactccaggtttctggcgtgggtgactgaggacagtgctgttggcaaacgggaaggccagaggatagatggtttgttttcttttttagtggagaagctgatgaatgccttgaacacactgaaccgggggaacctgtgggccatcacgaggagggactcagtgggccaagggcactaaggtctgtgcctgggacagagtcatcagtccaaagatggaggtgacagtcaggggagtggcagagattgctcaggtgtgtatgggagcgaggaaagaagaggcccacaaaagctggggcagccactcttgcgttggctgaggaagaaactatgaggcctgaggtagaagcccagggtggtgtggagtcctgctgtcaaagtcaaggagaatgcagtggtggccatgtggcaaaataagggcagaaaagtttttctgagaatgaatcacaaaaggaattgcaggtccctggagcttgccctgaaaaggaacaggggctggaaattctggccctctgggtgggcctcccttcagcagcctctgagtccgtttctggagccctgctcactcccctccaggaatcagcccccagcaggacttctacccaaggcgtgctgcactttatcagaagcttccaaggccaacaggtgctgggagcgagtcatgtctttttaggttgttagagtgcccgtcagcaaatcgctatcctttccaggttatttttttccttctagtgtattcctctcctgatacctttaaaaacacacaaaaaaatttcgtttttcctcacataattctattatcttagatgtttttctgcttttaaatgtctatgttgctagcagaaccccttccccaaccttttaaaaatgtcaaatacactttgtcctgataaggtaagtgaaggttcaatcaatttattgctttaatcagtaaacatttgtggcatgcctgcttggtaccaggccctgtaccaggtgctgtggcagcagaaagaccacctgagggacagcctgaggggaatgaatgctgagaagatcagaggaaggcgtctcccactctcccctgccacagtgcccttttattttgtcctccccagtttttgaggtgtgaaagacccgtacagcatggatgccaagagcacgagatgaagtggcagcggttcctaatcctttctgggtctggaggaggctatgccctggaagtggactctgaaagcaggtccccaatgtgcctgtcaccttaccatgtcaatcatagacctccccttgcctttctttaaatacacatgcagcttccactctttgagcttgtaagaaacaaacaagcaaaaaaacaaccaaacaaaaaccaaaacaaccctacacatgtaggttcattcaaagtagtgaagcagcaacttaagttgctggcagggagaggtaggacagtcagagaatggtagctttccctgctactctgctgtgcatctctggtgagtcactgtctttaggaaatgcaagcaagactcaaagatgaacggaggctaccatgagtggtaatgggtcagtcccaggcaaagcagacgcttctcacctccttccccattggacacctggtaaagacagacatacattaacatttccataacacattttagtttatcatgcacttcccccctactttagttcactgaatcaaaagaggtaagctgttgtggtaaatgtagacatttcttttaggtactaaggaacggtttgaaatcattatatggaaaattagacttgaagtagttaaaaaaaaaagaggcaaattttacctgtaatactgtggaactatttccaaaatacattaatgaattaaacaaacaagtctgcagaataacatacagtaggatgccattgatgttaggaaaaaaagaggaggatgataatagctaatagtttatagtgcttatgatgtgctagacactgttctaagtgcttcacatgcatgaactcatttgatcctccaaacaaatctacaaatctggcactattattatcttcattttacaaatttgagaactagggcacggagagggtaagtggcttgcccagtcatacagctaataagtgatggagcaaggatttatacctaggcagtttgtctacagattctggaccataagctctacaatatttctacaggtatagctatatgaatataaatgctgatatggtttggctgtgtccccatccaaatctcaacttgaattgtatctcccagaattcccacctgttgtgggatggacccagggggaggtaattgaatcatggaggccagtctttcctgtgctattctcgtggtagtgaataagtctcacgagatctgataggtttatcaggggtttccacttttgcttcttcctcattttctcttgccgctgccacgtaagaagtaccttttgctttccaccatgattctgaggcctcctcagccatgtggaactgtaagtccagttaagcctctttttcttcccagtccgggttatgtcttaatcagcagcatgaaaatggactaatacaaatgcttagaaaaaaggtcagtcatgtccccagatgttaggcaaatgtgacaccactggtatccaaatgactattcagcttttgcagctgataaatccttactctctctctcttcctttcctctccaaagcagttaacctaagaccacttcatgttgaagtcaatgcaattttctgtgatgctacctttccaagctgggatatgagaaacaactatatttggggaagggttaaatacatgtgactctgactttcaaatcaagttgttgttttttaaattttcctcagtcatgttataaagtgatgaaatagggaggaaaattcaaatgccaaacaatgaattgtgattgatgagagatgaaatccctaacgttcttaaatatttaagagtaaaattaaatactgtctgttatttcatatacttttctaatatagtggctaaagtctacttttctacatttttgtagtctactttggttactaaaatcctacagaaaaaaagataaatgaattagagactgtgaaccctgaaaatctgagacaggtctcagttaattcggaaagtttattttgccaaggttgaggacatgcacctatgacacagcctcaggcggtcctgatgatatatgctcaaggtggtaggggcatagcttaggtttatacattttagggagacataagacatcaatcaatatgtgtaagatgtacattggttcagtctggaaaggtgggacaactcgagatgaaggcaggacaacttgaagcagggagggagctcccaggtcataggcagataagaggcaaatggttgcattcttttgagtttctgattagcctctccaaataaggcaatcatatacgcatttgtttcaatgagcagcagggtgactgaatagaatgggaggcaggtttgctctaagcagttcacagcttgacttttccatttagcttagtgattttgggccccgagacttattttcctgtcacatttccccctttttatttttaaaaatcttttggagaaagaattttaggagaaaatgagtctctggtctcatgtttcctctgatctgtcatggctgggatggtttattcctagattggtaggtcctgagttattaggaaagttcattgttagcaggttgtgaagtctcatgtcctgtaaagaaaaagtagggggaggaaggaagaaaaacaacaacaagccaaagaacaattctggaaggccaggtgtggtgctaatgcctgtaatcccagaactttgggaggccaaggagggctgatcatttgaggtcaggagttcaagaccagtgaaaccccatctttactaaaaatacaaaaaatcagccaggcacagtggtacgtgcctgtaatcccagctaatcaggaggctgaggtaggaaaatcacttgaacctgggaggcaaaagttgcagtgagccgagatcgtgccactgtactccagccagggcaacagagctagactctgtctcaaaaaaatgaaacacaacaaacaaaaaaagaataatcctggaaaatcagtataggccacattactctgaattccatacatcagtaggcaggtatgaaagtggcttgtgtatgtaaataggttgctattattttcttctgaagtttaagttgtctagcttcagttcacagggctttatgaaagcacagcttagttttcagtgactccaaattaggaaaaatggggaaaaaagaaggaaaaaaatggaaaacattattctgaagacttatagccaagaaaaattagaattcagttcaaactgcagaaaataattaacactgaaaaacattaggcaagactagaatctaacaactggtgtactgtagtttttggaaaataatttttctatctccagttttccatttttagtaaagacaaagcatggtaggaccggtttgctttgttttacttggcctgattatttgtatacagtgcagcaggaataattattttcttacataggcttttaaattggctttgatggaactttgttctatagagggaatctcagaaaagacttttttttaaagccgagtccaaccatggatttataacatcaaatacctataagttgggtgaattcctctcctcttgagattccgagataaacttggggctcctgtgcctgtcagaaaatgacattctttacttaccacaggtcaggaaccctgtacagagactgtatgtacaaggtatgagggcagttttcccataagtcaagtttgattccttaaaggaaagcacagcattccagtcaaagccttataaccagtttctccagttgtgttctgttataaatgaaaacagattcttattgcatttatacaaataactatattgccattagttaagaatactcaaaaatagtttccaaattctggagaaatcaggtagagcgaagtcaatatgttctaaattttgttcacaggagcatactaaattattaaaagcatcaatatctcaaaagaaaagtttcctttactctgaaaaaataaaacaaaggatcagcaatgtcttaagcaaaaagtcaaaaagattgcttctgcctgctattagttcagtccatgtagttaatttctgttctgcttgatattcatgaacatttctgttctccatgagtcctaaaagtttttcttctatcctgatgtcacaatcgccaaagttttcaaaaaacttgtattcaaaagcacctgttagagttttagagctgattataaaaccaccttccaaagaggaccaaaacaagacaacgattgtccatggatgacaaaaagttttagggcagccatagttgagaacacaattgacaaggaaatttttacctctgtggcacacaaaaatttaacataacaattataattattactgataatgtatactaagtcatatcagaattataggagtttcccataattttggagaacataccaataacatatttatacaaatacagcccaaaaaaaccaaacaccatttcatatttgacaatgtttcctgtataatttttataccaaataaaccaaattatgtcatttttggacttcagggaacctaatatcttaaagatttaattaggtcagaaaaagacataatttatagtttgcttttgaaaggtttgtcaaatatcaaaggtttaaaacacttgatatcacaggccattgtaaaataagtcattaatttgaccaaagtgctaacttgaggatttaaaaaaaaaaaagcaaaaaccttcattttttgagagaggagacttaattttccaaataataagccctaataaaaacagcatgaagccaattaaatttgtttttcaaaattttataaacaatctataaaattttaatcttgattgtaagatataacttctataagccttttataacctttataacctttattaaggagttggttaatgcttcaagaaaaccttgttaatctgacataggggcccatatgctgatcttgtatcactgtgtctttacattaatgattaatttatagggaaactgaacttattttatctctcaaaattggcctttacaatctcacatgtccatctcttctgctatagtcctggggccttgaggagttgaatagctttattttctggccctgtgtctcaggaatgtagtatattttgattggtatcttctactgggcctgaagatgaggctctaattgctgtcagtgtttaagatttagcaggaattggtgtcctttctagacccaggagtcaaaaccctgtaactcaatttcacaagtactttaaaagcacacacagaaagatacatggacataataaccttcattaaaaaatttttttttctcttttcttcctaagcaaaccaaaacttaataataatggcataggaattgttttgataaaccataaaatcttttgggccagttaccaaaaggcaaaagaaaagaccttctgcattgcacagtatattatgttgaaagaaaacatttcctttagacctttaagaaaacattgttagcatcaggccacaacaaatagaactcgaggaaaaaatcttacatgaaccgaaaatgagttgaaggggagtgttactattttgtaccctttaaaaggggagagaaaactaaaattagggagatgcaataaaagttgaactttgggtttaaaaaaattaattgttctaacaaattatttagcatataagtattttttttttacctcaagcgtaatctctagaaagaccattataatttctctttaattaatagacagattgatcacataaaagtttctgcttttttaaaataaatcctcttgtgacttacacagaccgttcatgatatgcttggactttctggtttgtcctgaacatccttctttcttcaaaaatagtcgttttattctaggactaaatctaccatacaagattctttctcacataaaattatttctctttaagctttcttccccccaaaaaaaccacctctttatttttataactttctttaaatttctcttatttcctggttccttttaccttgtcttatacataaaatttatataagctttgatttagacaaaaattgttaacctttttaaaatgaacacaccttttttagaaagaatgtttccctacaaatatatttttattggaaaaaatactcaaataataaaatatctattatttaatttaactttagattctaaattatgatgagtttgtctacgtatatttatcccattacatttacctaattattttattttaatcatttacctagattatttatgaaaactgcaatagtcatcatttaaagttatggaattgtcattgcaaaattataactgagacagtgaaaaagatctgacctgactccatcttgtttctaacctccaagctatccttgttcatttctgggcataggccaaactaattttgggaggaactttgctgatagtttagctttgaaacaaatggtaatagtcccttcccaaaacaaaccttactacctttggactaaatttcataaagccacaagattagaagttgcagtaattttactaaattcaagatatagctatttttcttaaacgaatatcaatgtcttatttattatagattacacaagcagagatcattctgttttgggctggatttatagttttgtaaccactatgccaaattttgaaaccttatagtatttggcaggtataagtatgaaattgcttgtttaataaatgcaaacaaaaatgtatgctggcaattcttaagacatttataatattactttaccagtaatttcaaagatagcttatttattaaatattttacttaagttatttaaatttgaaaaagcatttgactagttttgtcttttttcaataaagcttttgattcagacacttttgttttcttaagccaattaattagagctctttatatattttcagtagtgaaacattgtgtacacaacacttaaatacatagacatattagacatgtcaatagaactacatcttacagagtcataaaaacctttttaattctatcttagactttcaaattattgataacctgctttactaccccaggcagttgtcagctaaatagccttaaatttgcatattaaaggaaacaactcaggtgaaaatcaaatagcaaaatttacttcataaggtacagagagaagaagtgtggtgtgctagagaaaaactaaaatggatttaattgccaattaaatataaaattatagaaattacaaaggccttttaaatatatacacaaacacataaatacacacacacaaagatcctatagcttttacttcagaactttagccatgagataaatacaaactcactggcttgcaaaaagaatctgttggatccaaacagtggtttttatcttaataaaaaaataacagcagatttaaagcaggcagaaaagaaaaatgagaaaagagaacttaggaactctgtagtttgcaggtcaaccccagggctctttttccttaatgtaaatgtgcacaaagaccatattacttccattttacataaactctggcaagtagagttgccataaaacctacagagtgcttgaaagggggtcattctccttttcttctcattcttagattgtttcccacttttttttcttaaaaggaagaactgatgcggggcacggtggctcaagcctgtaatcccagcactttgggaggctgaggtgggtggatcacgaggtcaggagatcgagatcatcctggctaacacggtgaaaccctgtctctattaaaaatacaataatcagctgggcatggtggcacatgcctgtaaccccagctacttgggaggctgaggcaggagaatcgcttggacctgggagtaggaggttgcagtgagctgacatcgcaccactgaactccagcctggtgacagagctagactctgtctcaaaaaaaaaaaaaaaaaagaagaactgaggagtggcctagaatttttgtgtggtggatcaatgtgtgctgcttgtgggcacacatagtgtgtcgccactgagccgtttctgccctcttacatgtctcggtttctctctccaaaggtctatcacctctgagagggctcaaaacatgaggtgatcagctcttatatgcgtttcctggatgactctttttttaacattaatttttattggggatttcgctgtggggctgctgcatgtcacagggggtcagctccccagacactcccataaggctcttggtcacccaggggtgccttttggctgggaagagcaaatgccctttctttttggagctgagaaaactcagtctctcatttacctatgaacaacagtttagttcctcatgcaagtgtgcacagacaagctgaatcgagattaattttgagagaaaaagcaacagagaagaccccttagaatgcacctctgaactagaattaggatgcttaaagaacagctttttgggagagaaaaaaggccagccaagaccacttcctgtaaaccgtgctcagccacccctactttgtagctcttgtccgccattacacatgctaaagtcaattcctctcacagtacgaggtcatctctggtacccccagagccaaagaggtcaggtcatgcaatataggaaaacagagctttattgcccatgacccttgaaactccacaaagataacagaacaccccaaagggatgagtggcacctttgttctgaattctttaaaggggttcaagtcattagaagccttctctagattttttggtactgcagatggcaaaggggaaggagatatagggtggaagaaaagtaaatgaacatttgttttctctttttttctaaaataagaagcaaacacagaaaccaagtgcgtgatttctttggggttttttgtttggcttttttctcttttgcagctgtgagaaattttggccaaattgagaggttttgtcacccataatttggaattctaacttggatttgaccaaatcaggtagagttggtcaaatctgatagaagaaagactggaatgaacaccaccaccaccatcacccaacaatatggtcacctagtgctctaatggtaaggagaaattaaaaccagctggttgttaaactttagccaagacaaaaccccaactcagctacttacctagaaatgggtctcaggctgaagactgctttctatcatcctagaagcaggaaaaaaaaaaccaaaaaaaccctcaaactcgtgttgctttgctgggagcaagctcaaactccagaaacaagttacctgccttccatcatcatggaaacaggaaatcttgccttccttcttggaagcaagtaaaaccccaaaagaagggagttgtacagcaaaataaactttagatctcgaccagattttaggagaccagggattcaatggaggggtaccccccgacctcagcaaattgtcctatttgtttgagccataaagttagctcatgatggtaccaggcactgataggatattcatcacaggtcaggggtatctccactcagaatcccttcatggttaccaaaatgtgaaccccgaaaatctgagacaggtctcagttaacttagaaagtatattttgccaaggttgaggacgcgtgcctgtgacacagcctcaggaggtcctgatgacatgtgcccaagatggtaggggcacagcttgggtttatacattttagggagacataagacatcaatcaatatgtgtaagatgtacattggtatattggttcagtctggaaaggtggaacaacttgtggtgaagacaggacaacttgaagtggggaggcgcttccgggtcataggtagataacagaaaaatgattgcgttcttttgagtttctgattagcctctccaaacgaggcaatcagatatgcatttatctcagtgagcagaggggtgactttgaatagaacgggaggcaggtttgccctaagcagttcccagtttgacttttccctttagcttagtgattctggggccccaagatttattttcctttcacaagactaacctgtagttttctttgaaatatgaattgtttgtcacctttttcattctcagctgtgcttcttcttactatatttatccaatatcccagatttcaggagttcatatgttccttaacaaacatcagatagatttcttctgtatagagatgcaatgtttataatttggcttgttattaaacttaaaaagtcagtgttttttatatatacatgttacagtacgtagcaagtcagacatgagcagggcaggaaagggctcccctgcactccccctcccgccatacacacacaccaggaatgtcaggcgaccatcaggtgatggtcaggtggttgttaacagtttctctaaaataataattcgtctcagcatcagggaaagtcagtcttgctatagatagaaaaaacctgaaactggtgatcagcagcttcccgataagatctcaggagctgggcgagtgagcgcaagcatgtgcattaagaggcaaaatagcagagtttaactggtatatgacctcctagggacatttggctggaaagggaagaatgcctcaagtgagcatgcctacaactgcagtaaacaaactatgcatgctcccctcccaagtgctggcagccactgtgcatgcagacagcccacccattcctctctaagggaagaattaggggagaagggatggaagaccctaaacgtatgccaacatataaaaccccaagtcaaaatgtcaaacaaaaatgtcaagttgcccgcttggcccccttccaggtgtactttccttccttttgttcctgctctagagctttctaatcaactttcgctcctgctctaaaacttgaccttgttctttttttctgcctcatgtccctcagttgaattctttcttctgaggaggcaagaactgaggatgctgcagactcatacagatttgcctcaggtaacatacacacatatatatgtcatttctattacacacacacacacacatacacacacacgtaattaattgtggcatttgcttctgtatatcaggaaaggatttgaaggagtgaacagtaataatgaaatatttggtgtgggatgtaatgaatcatttatttataaaatgcaattcaaattcatgttaaaagatcaaaatggttttacactaaaatggttacacactaaaccgaaaatcacggtcatctttggagagcaatcaggaattggagatgaggcagggttaattcaaacattccattagctgcaatgtttgaggttttttggtccctccatcgccagagagaaggatttcacgttacttctgttgttaaacgtatttacaattacattttaaaatattttaaaaaatcattcttggggtcaacctaagtgattctaaataaaattattatattatgctcctcaacctatatgtcacagggactttggtgtcattgagatcagaagtattaatcatttcatctttgctcttggagagtctcatgacatctgatgaaatattattttagagaattagatgagaagatatttcagattttatctggaataatgggaggtatattggtaaatgtattacattttagggctgaaatgtctttcatagttcagaaactgaagcccaggtggctatatcagatcaagtatgaagtattgaactaagagggttttgttatttaattacaaaaatgaagtaaaactttaaaaaatcttatagtgtactactaacgatatagtatattagggtattcagagaaacagaactaagaggagatgatagatatctaaatatgtctctgtctatatttgtttaaaggaattggctcacatgattgtcaagtctgaaatctgtagagctggttggccggaaattcaggtaagagctgatgtttcagtcttgagtccaaaatctgcagagcaggccaataggctgaaaactcaggcagggcttctgtgttgaaatactgaggaagaacggctttttttttttcaggaaacctgtttgctcttaaattcttcaactgattggatcaggcccatccacattatggagggtgatctgttttactttacttaaagtcaaatgattataaattttaccacatctacaaatatctttacagcgacatcgagactagtgtttgacaaaacacctgggcaccctaggctagtcaagttgatataaaaataactagcatgagcagattccaatttgaactaaattctgtctgctcaagaatatgagtctagtgattgatttttttcctatttccaaagagcagtgatttttaaaatttaggatgactgaagttttaatttgctttaagactcagttgaccagtcatttgaggaaaatctttcaacagtatatttgcaatgtatttagccattctaatcagtagttttgcttaacacaaggtggcttgtgaagtgattctgaattatttcatgatggttgaaaggaggccaactataataaaacaatgcaaacaaattagtgaagctaaacaggaaacacactggtgaactcactgccatcatctggcattttcaattttgcttccaatttaaaaatagctaacatgcacaatgtactgtactgttctacagtgaagatggtcagtaatgaggtgttttcacaattcaatgtaatctctcacttccatctctgatatttcatttacaaatgaatcaagtcatgcaaatgatttcaggataacccccaccccacgagtccctagtcttaatgagttgtgagttgggcatgtaagaatattaataaatgtggaaacggtgactcctggcattgttgctaaactttaatattgcatagatgctgtgggactaaatgtaaatacatcaatactttgttgctgacagattaactgtgggaaagctagtgattatttttcagacttagaactatcagtataattaacaaagggttattcagattattttaaataagacaattatatattacctaaaaatacttagaactagtccttttccatgcatgtggaaaattacgctcagccaagttatgaaacttgctcaaagcagcagacccactccagggcctgcttttcactacagattctgaaacacagaaggaattaaaatgcttgctcttgatagcctgggctgggagttagtgcatatcatcagccatccatctaatgtgattgctaagatgtacaggataggacagcttagaatgagtgccttgacacccacatatggctgcattccatacctcagtgaagaagctgaaggatgctgacacacagtgatgtggagggcattcgggagaaacttttgcaacagtgtattaatgtgattggttttctttttgttttaagctaaacatctaaaacaaatttcaagttaacagtacatacaactcagatttagtattattgtttatcataaaacatattatgttcctagttttaaaaagacccaaactatgattaatataatttattggcatttttgctgaataggtttaagtcagataatagattttaaaaaagcaaatgaggcaatgtatcaaaacttaatgtttcattataaaaatagatacgttcacttaaaaaaaataaaataaaatgcttgctcttacatttttttacataagaatggttacttattcctaccttgtctaccttatcttgcttttgttttcctttctcattgttagcactattttaaaggcgaaaggtctttccctactaaaaaggcattccttcccaggaaagccttgtcaggttgggccattttcattatactctcactacattgcagtttgtctttgggaagatcaaatttaaatcttcttctcattttagctggtctttttctaaatcgcaagtggaatagactagcaacaacaaggagtgcctctgtgatgggggtggtggggctggaggccagggacacagtggaagggagcaaagggctccccaggtaggatttcaaaggcattgaagagtgttttgttaaaagaaaaacaattgggggtcctctcccctcctgcaatgatgcctaagctgcagttgctgcagaacaattttgactacataggcactcaggtcagggttgcactgtggtttccaccttcattcagttatcaggaagacaaatctgtgttttgcagtcattgagctatgctagcgatttatgactgcatggttctgctcttgaattgtactcataaaccgaaaaagtgccaggtgcggtggctcatgcctgtaatcccaacactttgggaggccgaggtgggcagatcacctgaggttgggagtttgagactagcctgaccaacatggagaaaccccatctctattaaaaatacaaaatgagccaggcatggtggcgcatgcctgtaatcccagctacttgggaggctgaggcagaagaatctctcaaacccgggaggtggaggttgcggtgagccaagatcgagccattgcactccagcctgggcaaaaagagtgagactctgtctccaaacaaaacaaaacaaaaacaaaaaccataactgaaaaggtaccagaggtcattgagtcccgtggttttctaacctttatttttttttttggtagcataaaaacccttaagattcttaattgtaaacccaataaaaaccaaacaggaaaagaggtactgctctaatgcagctcctaggctctcttctcagacattgatgtttccttggaggttggtataaaaactactgttactggtctaccctctcattttatcaactcatttaacaaaaatattttgagcaaacaccgtgtagccagcagtatattaagtttgggaaaaacactgggcctaaaatgagtataaatccagtccctagcttatcagaggagacagataattacaacatagtaaattcaacgatacgaaagtacccctatgatattatgaaagtacagaatgagggctccctaattcattctggggacattgagtctgagactgagtctctaagactgagcaaattagcaaggaaggcacttagcttgagtgtggggaagagtataatccagactgaagaatggagtaagcagctagggtatattctggaagctaccccagaaccaagttggaagtggctttatatagcagactgtgcagtgggaactggtgaggaggtgggcatagaaggctctgagccttgtcttgattctttagaagatcagccgttactgaaggcctttaaggagggaagaaacaaagccaaattggagttttagattaacaggaatcatacatttaatgagaacaatgagatgcaggaagacctgtcaggggagtatagaagctcactaacagactataatagcagaagcaagttatcttgaggttccaggaacagtcaggtagcgatacccagtaagactggatgggtatcttgaatctgaaatcttggagtgtctaaatatgcattataatctcatatacatagaaggggattggagagaaaagggattttggaaaaggctaacttaactctgatctttggtcaattcttattttcttaatacttttctgtaccatgaacatatattcattttataaccaagcaaaaccatgattattttagagttaacttttaaactttgctctccttcaattttcttttttaaccaaactggaccataccatatatagagttaagggaggagaccactcctcatattgtcttatgaccaatttctgcctcaaagaaaaagtaggagttaaagaaaagacagaagtgaaatcggtagtcagatagcccggtgctgcattccaggcctggtagttaaagactgacccctgacctaactggttatgttatctatagattccagacattgtatggaaaagcactgtgaaaatccctgtcctgttctgttctgttctgattacttgcagtgaatgcagcccccagtcacgtacccgtggcttgtgaaaagcactgtgaaaatccctgtcctgttctgttccattctgattacctgcagtgcatgcagccctcagtcacatacccatggcctgctcaattgatcacgaccctctcacatggacccccttagagttgtaagcccttaaaagggacaggaattgctcactcggggagctcggtttttggagatgagagtccaccgatgctcccagctgaataaagccctttccttccacaactcggtgtctgaggggttcttgtctgtggctcgtcctgctacatttcttggttccctgaccaggaagtgaggtgattagtgggaggccgagtcagcccattacgcagcttaggcataccctgtggagcatccctgtgggggactccggccagcttgagtgatgcagatcctgagagcgctccccagatcctgagagttctcccaggtaggcatttgccctggtggaatgcctcatcagagcggtgcatggcaggcccccgcggaggatcaacacagtggctgaacaccgaaaggaactggtacttggagtctggacatctgaaacttggtaagactggtctttggaacttgctcactccatttgagtggaagtgtagcctgatcacccatgacgtgcctgtaccggcactttggtttttgtttttgacttgacttggattgcttgatactttggttttggttttgacctggcttggatttcttgatactctgttttgattttgattctggtttggtgtaaactgtaaaagtgtgtgtgtgccctttttacccattctttgttttgtggcgtgtgtgtggtgtgagcgtggtgttttgtctcaaggaaacataggtcaggcacaaagtaagcccaccccactaggaactatattgaaaaatttcaaaaagggatttaggggagactatgaagttactataacaccaggaaaacttagaactttgaaatagactggccaggattagaagtaggttggccatcagaaggaaacctggacaggtcccttgtttcaaaggtgtggcacaaggtaatctgtaagtcagggcacccggatcagttcccatatatagattcctggttacagctggttttagacacccccctcccaccacagtggttgagagaacagcagcataagcggctggcagaggcaaggaaagaccagcagagagacagagaggaaagacacagagaggaaaagaggcaaagacagagaggaagagacagagacaaagagggagtcaaggagagagagagaaagagagaggcagagagaggggaagaaacagacgcaaaaggaaagtcaaagagagagagagagagacagaaagtcagagaaagaaagacagaaagagagagatatacaagtagttaagaaaaaaacagtgtaccctattcctttaaaagccaaggtaaatttaaaacctataattgataattaagggtattctccgtaaccctataacactccaataccacattgttgtcagtgtaaacaagggcgtatcccgaaagcactgaggccactaataacgcatagccttcctatcaaaaatccttaatccagtgacccacggatggcccaaatgcattcaatctgtagcagcaactgctttgctaacagaagaaagtagaaaaataacttttagaggaaacctcattgtgagcacacctcaacagttcagaagtatccttaaaaaaaaaaaaaaaaaaacaaacaaaccaaaaccacacagctatctataccaattctaagttaatttggactaaacaagatcttattaatagcaaaggataattgaaatcccaaacttataaggttttcaacaaaagtagagttagctaaaagttaacagtgtaacatgtattatagtaacttctaatctgtggccttagacagtgtagtccacagacataaaggaagtttgctttggaaaagaatggttatcatctttcaaaaaaagggaaaaaaaggcggagcagaatttatgtaaaaagaatgttatatggtaaattcttgtcctgaaataaattaactagttgtttaaagaaatgtttgtaataagtcagaaagttgaggcatgtcaaagaattgtctgcgaaagttgtgaaagagaaaaaaagttataaaaaaatttatgcaagaaatattgtataatttaaaagtaattaggcctcctgaatgtaaaactattaaaaaaaaacagtttatgtgcaaggtatataagaaaagtaaaatatacctttggtaaagggattataaggaggcataagaatgtggagttttacctacattaaaaggttaaaaaaattgttttgaaggtttaagcaagttttaaaacattaattgtaaaggaaattctgtgtgtaaacatattggctaaagtcaaagaggtatcatccagtttttctgtgatctgaacattaaaataaaaacacaatgggtttttcttaaagcattaacctgctctttaacaaaaattataaaaggttaaaaagagtctatagaaatcttaccttatggtgaaacattaaaaactgaataaatatgtctacaaagttttattaaaactaagtttaacattaataacacactaatataaaaatgaaatttagcttatctggtataaaaatcatacaggaagcattgtcaaatataaaatggtgtttggctttctttggtctaaaaactaataaaaataggtgctaaaggaaatttctcagtagaaaggcatgaaggactacaaagtctactgctgatgtcccacatttaaaacaaaaggtcaatttcttaaaaattatatacttggtttatcttccattttcctttccctcaaaactaaaagcctttcagcacatgtaccacccctagaatttccggtaaaccagcaccagcctgaagatcatgttctcatcaaagggtgaaaagaagggaaactcgagccagcctgggaaggaccctaccttgtgctgctaaccaccgaggctgctgttcggacagcaaaaaagggttggactcatcacacccaagtcaagaaagtggcaccccctccagagttgtgggccatagtcccaggggaaaaccctaccaaactaaagctaagaaaaatgaaactcttcaatctattctattactctttcttctttccttgctctattgctgaccatctagttcttaacataaccaagtcaattttgcttcaaaccattgcatttaatgcttgccttgttatacactgtgggcattcaccaagtcaaagacagctctctacttcagaaaattacctatgtccctcctgactcccctcagctgggctttagtaaattaggaccatttaatccagggagatttcgataaagaccccagtgtcaactgggagtcctgccccccaatgtagagcttttatgccatagttggcccaacgttctgtggaccactaaagagcaaggatagactgccccaaccattttttgtaatttcctaaaatcatacattcattttactagaggatcatagaagttaaagacttaaaacaaactttggcaattaagacaggataccaagatgtgaatgcctggttggaatggatcaaatattccgtctgcacattaaacaaaagcaattgttatgcttgtgcacgtggcaggccagaggcccagactgtcccctttccactaaggtggtcctccaatcaaccaggtgtgggctgcatggtagctcttttccaggattctacagcctggagtaataagtcatgccaagctctctctgctatatcccgaagtctggcaccctgtgggtcagcccctgaggaccatccagcttccatctcccaacactaagttcagtttgtgtgtctcgtgacaaggaggaaacttagcattccttagagacctaaagggatgtagtgagcttaaaaattttcaagagcttatcaatcagttagcccttgttcatccctgaggggatgtgtggtggtattgtggtggacctttactgggcactctgccaaataactggagtggcacttgtgctttagtccaattggctatccctttcaccctggcatttcatcaaccagagggaggaaaaataagacatcataaagtgagagaagccccttatgggtctttcgactctcacgtctatttagatgcaattggagtccatggggaataccagatcaatttaaagcctgaaatcaaatagctgcaggatttgagtcaatattttggtgggtgacagttaataaaaatgtagattgaataaactatatctattacaacaaacagcaacgagcttttcatgagttaaaacaaaaattcatgtcggccccagccctgggactacctgacctgacaaaacattttacactgtatgtgtcagagagaaaaaaaaaaggcagttagagttttgacccagactgtggggccctagccaaggctggtggcctacccctctgaacaactagatggggtttctaaggattggctcccgtgtttgagggccttggcagcaacagctctgctagcacaagaagcagataagctaactcttgggcaaaacctaaacataaaggcccctcatactgtggtgactttaataaataccaaaggacatcattggctaacgaatgctagactaactaaataccaaagcttgctctgtgaaaattcccgcataacggttgaagtttacaacaccctaaaccccgccaccttgctcctggtatcagagagcctagttaaacataactgggtagaggttttggattcagtttattctagcaggcccaacctctgagaccatccttaaacattagtagactgggagctttatgtggatggaagcagcttcgccaacccctgcaaagtgactctgaagaagacgacaagccctgctccagtcacacccggaagctaactggtccccgcatggccaaagaatgaggaaagtcattgcaggactcatttcccttaaaatttggacttgtacagtaaggacttcaaatgaccttcctcagactgaggactattcccagtatatacatcaagtcactaaggtgggactatcaggggaactagcccccaatatttcaatgtagttctttcctattttccctaaatgtcggctggtctgagaaataaaaagaaagagcacaagagagaaattttacagctgggccactgggggagacatcacatatcggcaggttctgtgatgccccctgagccacaaaaccagcaagtttttattatggatttcaaaaggggaggggtgtatgaatagggagtgggtgacagagatcacatgcttcaaaggcaataaaatatcacaaaggcagagaggcagagtgagatcacaaggccagggtgaaactagaattactgatgaaggtccatgtcctgctgggcacacattgtcattgataaacatcttaacaggaaacagggtttgagagcagacaaccagtctgactagaatttcaccaggctggaattgctggaatttcccaatcctaacaagcctgggggcgctgcaggagaccagggcatatttcatcccttatctacaactgcataagacagacactcccagagttgccattttagagacctccccctgggaatgcactcgttttcccagggttattccttgctgagaaaagaattcagtgatatttctcctattcgctttctgaaagaagagaaatatgactctgttctgcttggccctgcaggcaggcagactttatggttatctcccttgttctctgaaaatcgctgttatcctgtttttttcaaggtgcccagatttcatattgttcaaacacacatgctttacaagcaatttgtacagttaacgcaatcatcacagtgtcctgaggcgacatacatcctcagcctatgaagatgacgggataaagagattaaagacaggcataggaaattataagagtattgattggggaagtgataaatgtccatgaaatcttcacaatttatgttcagagactgcagtaaagacaggtgtaagaaattataaaagtattaatttggggaactaataaatgtccgtgaaattttcacaatttatgttcttttgccatggcttcagccagtccctccatttggggtccctgacttcccacaacataggacaaaaggttgctacagtcctattattttatggttaccataagtgtacagggactctaaaaggaacttgtttgtataatgctgttctatacaaggtatgtagcccaggaagtgaccagcctgatgtgtgctataacccgtcctttttcctactgcccataaaaacaggcaaacttctaggcttcccagtctatgcttcccgagaaaatagaagcatagatataggcgactggaaagatgataagtggccccctgaaagaatcatacagtagtatgagcctgctacttaggcacaagatggctcgtggggataccggaccccaatttgcatgctcaactgaatcatatggttacaaactgtcttagaaataatcactaataaaactggcagagccttgactattctggcccagcaagaaactcagatgagaaatactatctatcaaaatagatgggctctcaactacttgctagcagctgaaggaggggtctgtaggaaatttaaccttattaattgctgtctacacatagatgatcaagggcaagtagtttaagacatagttagaaatgacaaaactggcacatgtgcctgtgcaagtgtggcatagatttaatcctggggccatgtttggaaaatggttcccagtgctaggaagatttaaaactcttataataggagttataatagtaataggaacctgcttactgttcctttgtttgctacctgtacttcaaatgataaaaagcttcattgctaccttagttcaccaaaatgcttcagcacaaatgtgctatatgaatcatgacctgtcttgcaagaagacatgggtagtgaggatggaagtgagaactcccactaatgagtgaggttctcaatgtgggggaataagggaggagaccacccctcatattgtcttatgaccaatttctgcctcaaagaaaaagtaggagttaaagaaaagaaagaagcaaaatcagtaagacagcccggcactgcattccaggtctggtagttaaagattaacccctgatctaaccagttatgttatatctatagattccagacattgtatggaaaagcactgtgaaaatcccagtccttttctgttccattctgattaccagtgcatgcagcccccagtcacatactcttactgcttgctcagtcgatcacgaccctctcacacagacccccttagagttgtaagcccttaaaagggacagaaattgctcacttggggagctcggtttttgagtccgccgatgctcccagctgaataaagccctttgcttccacaacttggtgtctgaggggttcttgtctgcagctcatcctgctacagaacttcctgcattttcattaaaaactttattatttgggaacaatactatgcagccactaaaatcatgctttcaaagtatttaaaagcatatgcaaatattggtcttcttacactaaacatcatgatgtggttttcttggatcttgtgtggatactgtaaaagaaaaattttaggaataagccagtgttcatagcatgtcaaatgctctcttgaatggagtaattacaggcagcccaaatgtgctctcagccactagtggtggtagaacaaatgcaaagctggtactcaaagtgactcaggagtatggcaatttttctgtacgtgcttttctaacagtgcctaggaatgatggtttttgcctaaaaacaggaaagttgggtcgtctttattggagctttcttgccatagtcaaatagaaaataatcagtgatgagtatcatctaacaaattgatggctgaccttaatggaacatactcaaaagctatcttttaagcatttgctactttaattagaacaattcattcagtatcactgttacaatattccatgactcttattttcaatatactcaaagcaacttgaaagttttataaattctttactacagtattacccgcttattctgacacataaaagctctgtagttacacactgttaacatgttaatggcacatcttactagcaacttgctgcacttctgttatcaatagaggttatgtgaaatacttggataaggacagcctgattctgtagaaaatatctgttttctatagaacaaaatatctcccagtggtaattcagcaaattaggttcaagaatgtgggtaaaggtaggtgtaatgttggattctgaagatctacctgcagaaacagatctacctacagaaaggcacgtagaattactgttaggaaacctaagcagccttagcaccatggtcaaggttttaaaaacctgatctgtaactgttatgggttcatttcctaatgcagagaaactggctagtacacacagtgtagatttaatgtgggaaatatgacaacttggaaatgctacccaaagataaaaatctaaagactatcaaaatttgctgttttctaaaatcatacattagaattttgtgaagtcttctgaatgacacaaaaccagatgaagggaatcagaccaaaattacctgagtaaggccatttcaagtgcctaacaaagatggtcaatattaacttgaaaaaccagtgtttcctaagtgttcctgatcagaattacctgaggtattccttacaaataaattctgaggcccattctcttaaagattctggcttagcgggtggtacgtctggattgaaggctaagaatctgtaccttaagcaattctaattatcaggcaagtttcgaaaatagggctaagcaggagtgtgtgtgtgtgtgtgtgcatgtgtctgtctgtgtggaggggggagcggggaacaggaacaaaggaacaataccagcactgtctggtcccctcattcaaatactgcctgaaaaactacctgagaatgagaaacattcaactgaagttgaggaattatctacagaacactgtttatttcaagtccaaaacacaaattactcatttttcttaacagaccgcataattttttctgcatgaatatttagggtttctctattcacaagtacagtttattactagactttaggcttgaatgattcatatatatagatatcagtttactacagaggacatgtacttttaacattttttgtttagaaaatattttacataaaaacacaaagcatttaccaacactccacaaccagtcttcagcaaagatttggctgaagataactttctacaaaacactccaagactgaatagaatgtagtattttacatactttagcttattgttgcagttaaaagctcccccttgtttgatggcttctgcatgtatctacaaagcagaagtcttaactggtgacctgttaaataacattgcctttttaagtgaacttgtccccagcccggaacctaagtagtcataatgaaataaagtaattgatatatgaggggcttttagtaagggctttttcaacctaataaaataataatttagtatctatcagtgcaatattcttttactgttttgtgttcaataaccacctggagtgctaattgtctagtataatcagttggcatcaaaatagaaagtaaaaagatgtacatttaatataccaattcttacctgaataatcttggatttctggagaatgttccacaaagtggaatttcttcctaaagttatgctgaatgtggtacaatgtgtacaacttggttaaccagtgcctgcttttcatttccaagatttttccttatcttgaatcaaatgcacaatcttacaactgtatcataatgcactggcttacagttctgtatataaagtccaactcaagcttattttggtttattgtacatgctttattaaaatggtacttgtatttacagtatctgcagaaagagtcccttccaaggcctcacacattcagacacatccatactgacacccactccacagccccatgcacccacaccagtgagatgtggagggtcagactcctaaaattaggcagctgttggggataagagttgatttgtttttcaatttttttgaaaacagaaaagcatgggggaatgcatttggccattacaatgctaattgagtttgtgtatattacatatatggcagttaacactgtaatattccttttacattctatatacacagaatgatatcaaggttttatggtcaacagaatattccaacttcagtcttaatgctgcttgtagtgatttctgaattcattataggggctttccctaaaaataattcaagtctatgttaagtgaaataaggcacaattaatattgatttgatttagggaaagggaaggaaagagaagggataaaaactggtttcaaatgatctttctgttggggaactagctctgacttaaacccacctgaaattccttctcctaatttccaaagatttctttataaagatatttttcttttccctgacaaagccaaaaagaaaagtttgggaattcacattttaatgtttcagtagcctgaacaactcaaattgatgtgtacccccacctcccctgatcaggtcgcctccctcacccatgttaaaataaaaacacagtatgtgacacaggagtcccttgatgtttcttgaggagatctgtacacttgagtagcaaatacatatctggttgtcttcaatatattttaaaaagaaagaaagagaaagaagaaaggaaagaaggaaaaaaggaaggaaagaagtaatattgtgactttcttgctctttaaaaaaatccctgtctccttcttttcaggatgatgaagccccactagacattacaaacaactgcaacaaatgagtttggcagcataaataatgtctagttattcaaatcttcatagtgagattaatttatcttgtacacaatttgttgaatgtttttcgcagcaggtgaatcaaacccaaagactccggacagtctgtgaaagggagtaagaattgcagttctgaaggcccctgactttggttgtttacaaagttcaatcctgtttattgtgatccttggtatcttcttcatctgtatattctgatggttcttctcctggttttaggagtctgcctacataatcatatttttctgaaagatacatcaaaagaaaatcagtggtgatcaaatttgtttcactattccattatacagagaaaaggcatttgtctgttttagaatcatataaaatatgattattagaatattatctaaatattctaaaattgcttcaccatggctggtctttatacacatgtaaagcctgaacaaaagaaaacaggattagggaacttataaggcttgggaattctttgcaagagggtgttctgtaccagtgattcttagttggatactgcatcagaatcacttggagatcttttttaaaaatgagtaagtccaggacccatctcagtacccagctaaaccagaacagctgttccaagggacccaggggtcagataaacagctgggacagcatcacacaagtggtaaaaactgatgttatgagggcataagaaaggggaaagatattttttatctacatttcgagtgttaagatctgtaaaatcattttggaataaattatagtattgaaatcagtaatcaactcagttttaaatataagcctgtatttttaaaaaactaaaccttaatgaagaagctgactgtaagtatcacaatttttgaggcttagaatttgtaacaagtcatttttttaaatattgattttcaaaataattatcacatgtaacaatcatatttttatttagctattttttgcaatttctttttttggacaagtctcactatgttgcccaggttagtccttgaactcctgagctcaagggattcccatcagcagctaggaccacaggcatgtgccacttcacccagctttagctatctttaaaaatattatcaaataatgatggcaatgaaaacggatgacatccttaggctcttaaagcatgtaaaatagtatatattttctttgaacaaatatttaattttccaaagaatccaacaaaataaaaatacctttaaactgcatttcccattctcgaacactctccatttgtactgcattcaaatctgagagatcatcatattcatctctaagtgcatctttatctaggcaaaatgtggccagtcctctggaggcatccctaccagcaaatattccatatggacccgctggaaaaaagaaaataaattatttagatcacctaacaatattttagaatgtctcaaaggaaaaagtaaaaaaaaaaaaaaaaaaacacaacaaagaaaaaaacccctcataattcacatttgtatatacccttaatttcaaaacatgtacagatactagatggaataagaaaagaaatttgttggaaatctgccttttgacccaagtaaagcttttcacttagatcttaaaaccctcaatttcaattacttcagatatccccaaacttaatattcaaaatgaagactgtgaggtaatgagggagaagaagaaacttaagtggttaggtttagaagccagtctgcttgaggggaaataatgtttactggttgctgttaatagtggcatcaaaaaaataaaaataatcaacagaacatcatgtattatgtaaagactcagctgaacttgaatctgtaacatttttctttctgctatccttatgaaggttgtaattctatgagaaaagagactgtatcatctttgtggtcccagtgactagttcagtgctcaacacgcatttaataaatctttgctgagtggtttaataaaaaaagacccatattcaaaataaatcatctgactaccataatatatatacaatgatctatataaactaggaaaagtcattaaggaaaataatagctcttacttgtcatgacttttggaaaacagaggaagtagctataaggaataattcttctggactgacacattaagcaataattagcattttatccaaggaattgggtaccattctctctgaggagaaatggcatgactgatgtgttgacaaaaaccattcccaaggtttgtccttgagaacagcaatttgttcatcaattgaggatttgtatcctcaatgcctagcactgtgcctggcataaagtaggaacgtaataattttcttccaaatgacttagctgtagttccgaataaaaagaaactcaagattctgtaaacagattcacttatggtaggcaaagacactattatgaacaacaacaacagagtggtgaaaaacagggcttataaataaaagaacaaagtatgttctgataagtaaacaagcagaaaaaactagaaattccttgatttttaaatgagcgaaatgattatattcatatataaaagtatttaggaaactgaaagttatgtgtcaaaaagtctctgtaccttctgagagtagaaatcgaggtttcacttaaatagatatctaagcatttatgagtattaatttgagttgctaacagcactgtactataaagttaaccagatgtgaaattcattctctgaaaagtttactgcatggaactagaagtagcattagcaataattttaagagtagcattcataggtattgatacagtaacatgaaagtaaagctaacagttccagtaaagtacatttgtattctgcttttcttattcttattgcattttccatattgctacatcgtatcacatgactatcaacaattatttatcattgaatggttatatattatcccactgaatggatgtgtacctgtaatttatttaatcagtcttattaacataggctaccattttatactttcaaatgtgtcttctatataagaatatggaacacaatttaccactggccaatattcgtaaccttcaaactttttctatcatctcaactgacattcaaaagggtattaaccaggccaggtgcggtggctcatgcctgtaatcccaactctgtggcagcagtgttgaggtcagcagtttgagaccagcctggccaacatggtgaaacctcatctctactaaaactacaaaaattagccggctgtggtggcgcacgcctgtaatcccagctactcaggagtctgaggcaggagaattgcttgaatccaggagacggaggttgcagtgagttgagatcatgccactgcactacggcctggccgagaaagcaagactccttctccaaagaaaaaaaaaaaaaaaaaaaaaaggtattaaccagttatgtctgtgtgtgtacatgcacatgtgcgtgcaaaattctacacactttgtggcaatgggtgttttcaggaggacaaggagagagacagagacagagaactagtgtgtttaaaaataaaaatttctaagaaacaatgataaaaaaaatctataaacattatatttacccttaatgctgactagaccaatgcttataaacttaaaaaagcaaaaagtgaaacatacaaaaggaaaaataaaactaataaaggccataacaatctacaaatggaaaattataggttcaatttttaaaagaattttccagcaacctcacttttctctctcagagtttcccaaagtggaagggacagactgccttccccatttggcagataaaaaacaggagcggaggcattcagtgtgatttgcctaaaattactgacagaactgagagtactatttccactttcctaaatcctccagtgtacctcaagaaaacacatagaagactcacaagcccaaagatggagtaacgaccatgaaaactggagcattttactacttacaaaatttcaagggaatgaaaattttagaatacttattaaatcaaaatggaagagaattaacaaaaaagctctacttaatagcttttctaagcattctattatagtatttatctccatggcctgcaaacattaatctacttcaggcacttcagagtataagccataaaacacatttaaatgatacaaaggagagaagataaaatcattataaaaacagcaatcagaaagccctccatctttgagtatattaatatataccagtgcattctctattaatttctctaccaacttccctaagaaagcttcaacactgaatgaataataataataaaaaatttcataaaatatgctctttctggggtactgggggtagggaatgattgacttggtaagagtgaacttgagtcaacagttaataatccaagccaaattccagacaaatgatgttctgttgactcttgaatagaaaagaataattcagtgattaacatattcccccactccctaaactatattaagctgtcttctccatatgtttagaatttccctcaggaagcatttaacttctgcaaaggtctttttagtaataattttctatgctctttcctgtaagaccattaaaaaaattttttttgttgttttttgagacagggtcttactctgtcacccaggctggagtacagcggctcaatcatatttcactgtggcctctacttcctgggctcaagtaatcctcctgccctaacctcccaaatagctgggactagaagcatggcccaccaggcctgcataatttcttttattttttgtagagacaaggtctccctatgttgcccagctgatcttgaactcctggcctcaagcaatcctcctgcctttgcctcccaaagtgttagaattacaggcctaagccaccatgcccagccttctgtaaggccattaaagaatataacattaggaactaaagttggaactggatgggttattctgaggaaggatttgatgtctaataaaaggagatttccctgcattcataatacaaccaggagcttatctgaaaagtcagcaataccttcccattccgttatccccttacataaaaaacctaaatatttaccaattctaatatttggtaagtatacttggctattcataatactaaaacaatagggagctccccaaataaagccaatttgaaatggtttaagtctgttgcatggtataatttatttatttgtattagtatttttttttgagacagagtcacactctgtggtgtgatctcaactcactgcaacctctgcctcctaggtttaagtgattctcctgcctcactcagcctcccaagtagctgggattattgggtgtggcaccacgcccagctaatttttatatttttggtagagagggggtttcaccatatatggtggacaggctggtcttgaactcctgacctcaggtgatccgcctacctcaacctcccacagtgctgggattacaggcatgagccactgtgcccagcctaatttatttttaaaaaggctagtttacatgatctggttattttttattattaaggctcatttagacactaacagttcagtagtaactagaagaattaaattctgttgctttatcaaatattaaaatataatgctgatccaaaaacagcctcccaattttaagcaaattcgtgctacaaaaaatgaacagcattattcagtcaaagcaaatactctgaaatatacttacataacaaatattcaaggacatcattttaaagataaattttatttcaaagctattgttaaatataccaacaagaggcaggcggatcacgaggtcaggagatcgtgaccatcctggccaacgtggtgaaacccagtatctactaaaaaatacaaaaaattagtcgggcatggtagtgggcacctgtagtcccagctacttgggaggctgaggcaggagaatggcgtgaacctgggaggcagagcttgcagtgagctgagatctcgccactgcacaccagcctaggcgacagagcgagactccatctcaaaacaaacaaacaaacaaacaaacaaacaaacaaaacaaacccaacatgaagtactatactagtcagaattcagatttcatttagttttcagtgtcaatccaacttgtggtcaagatattttaaagttcaataaacctatttgttaccgtatcctaaaactgcttactttaatacaatcagttagaatgaggtgacatattcttgaaacagcaacaacatatgctcattgtaaaatgttttaaatattaatttaataaacagaaaattccaggaggaagtaaatatgtagtaacagataattttgtgattattaggatgattatatagctaccttagtgtttctaaagggatattttaattattctcacagtttaaaaaccatatctctcagagatgaactttaattaattaaagtttatcaacagtgcagttttcaggcctgttttgacaataatcttttgtgattataaattgagtaactaataacacttagtattgggtaatttatttcaaataagattataatcagcctatcaacaaatgaggcaatatgtaaaagtgattaactgaactaataaatttttttatgcttaggtccagtaagtcccaagacttttagagagaatgcagtatggtaaaactgaaataatacctctcaagaagacagatacttgggttctagaggatccactcacaatcaacaagtctcgatttccatagtccttagatccctcaaatataaattaggaaaattattttacctgcctgaagttgagaccaaactaaataatctcttgaatagtatgattctataagtgactgaaagtgcaatcttgcttctgaaatttgagctactgtcaaaagcgctcagcaacattgtgaactgagcatatggccttaactccagggtgcatgggtaggctggggtaaagaaaagacagaaaaattaaaagcccaggcccgtgccacttatgggagtggggcctgagtttatgcaacccatgcagaatgaaaattccaaggtgaaaaaatagtatgaactcaaatatctataagaattaatgaacactaaagataatacttcaagtattaggaaaaagggattattcccctgttggggaaacatgttgggacaactagataaccttctgttaaaaaacacaaccccttgggaggccaaggcgggtagatcacgaggtcaggagtttgagaccaacctggccaagatggtgaaaccctgtctcttatactaaaaatataaaaattagccgggcacggtggtgggcgcctgtaatcccggttactcaagaggctgaggcaggagaatcgcttgaacccgggatacgcaggttgcagtgagccgagatggcgccactgcactctagcctgggtgacagagcaagattccttctcaaaaacaaacaaacacccaccaccccaccaaatttggactctaatttcacatcttaaagcaaaatcaatttcaaatggaactaaaaaactgagaccacagaagtactaaaaaaactacagatttttaaaaacaattttaagtgcataaagtctttaaatataatacataacttagcagctataaaagaaaagataaatttgaatacataaaaccaaaactttgtgtggttcaaaaaaacaccataaataagtaaaaggacaaactagaaaaaatatttgcggcaaaggctgatttactttataaagaacacctaaaatctgtacgatcaatatgatgattgaaaaactgcagcagggctgggcgcagtggctcatgcctgtaatctcagcactttgggaggctgaggtgggcggattgcccgaggtcaggagttcgagaccagactgaccaacatggagaaaccccgtctctactaaaaatacaaaattagctgggtgtcgtggcgcatgcctgcaatcccagctactcgggaggctgaggcaggagaatcgcttgaacccagcaggcagaggttgcagtgagccgagattgcatcattgcactccagcctgggcaacaagagtgaaactctgtctcaaaaaaaaaaaaagagaaaaactgtggcaaaggatatatgaataaacaatttgtagaaaaggcatcataaatgactcaactttttaaaaagaagtccaacctcattaagtaaatgagaaatgtaaatttaaacaaatattgagataccattttaacctctcaagagtgacaaagaccaagaagcttaataccacgtttttggcaagaagtgagaaacaggcattttcatcaagtgtaaattggtccaacctctctgaagggcagtttagaaacaagaatccaaattaaaaatatccataccccaagcctcggtaattttatttccaggaatttactttataatcataattttacacacatgtgtaaaatgacatgtacatatttattgcagcatcatgcaataacaggagactgaaaacaaatgttaacagtggactgttaaattatgacttattcataaaatagaatattatgcatgtattcaaaagaataagatggctctctatactgatgtcaaaggctcttgtgatattaaaatattgtgaagggtatgcatagtatactataattagtgtggggggaaaggaagatatccacatgcttgtacttgcacccaaaatagctctagaacaatacgtagactggtgctttgctgctatggaagggaacatggtggctgggactagttgtgggaagtagacttatttttcactgtatatccttttgaattttctattttgagcatgtattacttaatttaaaaaatcattgttttaacttacgtgaggccctattttgcaacatacccaaagcactttacctctttcacaacttagggctcatggaattttacaggaaatactccaaaattaaaaaaagtaactactgaagataataagttcacaataaaaaatataaactacatgaagaaacaaaccatcatggaggagtgggcacatataacagatacagaagcagattaaagaactaaagtaaatttgcttaaaattattaagaaatggtacaaaaggaaagattaagagacattaagaatagaatgaaaacctaatgtatatctattaacagttccagaggaaggaacagagataatggaagaggcaataagtaacagcaaattttctgggaaaaaaaaaaaaaaaaaaaaaaggacaatatatccacagacttgagtagagtttggtacatggtaaataaaatcaaatccatacctggacaaatcctagtaaaatagcaaaaccccaaagacaaaaagatctcaactacaaccaaaaggaagaaaaagattaataaaagtaaagagaaactacaagccgactcctcaccaacaagtggaagacagtggcataacgctactcaagagttgaggtataataaggtcaatttacatttttttttgagacagggtcttgctctgtcacccaggttgagtgcagtggtgttatcaaggctcattgatcttctgggctcaagcgatcttaatacctcagactcttgagtagctggggccacaggtgcatgtcactatgcctagctaattttttatatttttgtaagagacagagtctcgccatattgcccaggctagtcttgaactgctgggctcaagcagtcctcccaccttggtctcccaaaaatggtaggattataggcatgagccactgcgcctggcccaatctacaattttatattctaaacccaaactattattcctgagtgaggaaaaataaaaaattttttcctgccagtgaaaaactataggacacacctcactaaaataaaaagtgaaccccaaagaaatgagatgcaagaaacaacagtgaattaaaaaaatgataaccatgttagtaaatttaaacaaggactatattaaaaagataataatttcatcaattttggggtggagtttgaaaaaacaaagtgaagctaaagtctaatagtgatactgtggaaaacaggatgggggaggaatcagagttaaagctttctaaccagggcctcaacatatgactatgtacaacgcaggggatactatccatatttgtagtcatggcagttttgcttatttattaagaaataatctgtcaaatgtcagtaaagtatcttaaagaggcagctttttcaaattgacactaaaatgatgtttggctaaaattcttatattgttcagaagcataggatagtcatctatagcaaaaacttaaggaaatcactaaaaggatagaaatagaatacatccaaatcagtagaggagagaaaatggaagaaataaaaaaatcaatcagagaaggaaaaatagtgggaaaagaggcaaagaaaagtaaggtgaagagaaatcacaaaataagatgatagaaataaacctaaatatacccgtaatcacaaaacatatacactaattaagctattaaaggacatagtgctaatattaaatgaaaaaatccagctatatgtcattaatgtgagaaaaataaaacaacacagattgactaaaagggatggaaaatgaaatattgtgttaatactaatcagataaaggctgaagtaaaatctgaaaatcaacagtgttaaagaggtttctagtatgatcagttctagatctactgctagatggctttgctcggtatagaaagcatagtaacaatctcacttcagaacattctcatacccaatctttgtatggctggctctgttaggtttttgcttaaatgtcgagccctttttctcgagaatctaacataaaaaaggtaaccttgcttagccacttaatctaaataaagtcctttgttaccctctattcccattctattaatttcttttatagcatattacagattataattacatactgaaatccttgtttactgcctctcttccttaatagactattaactccatgaggataggaacacatctgttttgaagactcagttaactccatttctcatctcttaagcttttactgtaatgaaatccagggaagtcttcctcagtatttaaaaatggagctgaaatcctattattaaagatcctgagactggatataggctccaaaagaatacaggagttatacagtcatgtctgtcttgggtgcacagggaaaggagtggtctatgtcagagtgttgaaaaaacaattaaaagaacttgaatggctaattccagatgttattaaatctactcctttcttccaccctgaataacagcttctggtttcaagctatccttttataatatgctttaggatttaacacaaatacgattccctcaaagattaaaaacaacgggatgatgttgaattcagagccaactaagtagttataatagaaataactagtagaaatttgagcagaatataaaaaatcatcagaaaacctagctaatccttttatcttactggtaggtaatagatgcatatgggcattagcccaaacaacaaagccagttggcttcaaagcaagaagctgggatgagaggtgggcagtggcaactttaggacatccatgaagaaataggtaagattgggtccagtttttatgatgcaactctgcaaacacagagtttccaattctgcaaactaaagtgttaaataaaagtgaacaaattgaagataaagtttaaaatggaggaaaaacacttcaaggtacatgtgttcttttccccaacctcctaaatattaggcatctcatggggttcttcttacgtgacttttttctttcagtggaatttaaaaggtaagttggaaaaaatatagctttggtatatgtcaaagaatactccacctggaataagggagcagcagtattgcaaggttcaacaacgcaaaataaactatcaaaaagtcaagtgtataattttttgccattccaaaaaaataaaagcactgttttggtaaagttccattgcagtaatattaaataaaattgttaaaaattatactagctgtttgagtcttcaaaacttatgattctgtaaacatgtgaaactgaatagactatgttgtaatacaatgggaaggattgaagctatgaaaatctggatttaatttttagtgttgccacctactagatatgtggctttgggcaatctcatagggctgtttgaaaattagcgatactaagctcaataaatggagtttcctccttctcctcctctgacctttagaatcagtgttgttttcaacaactctctgggaagacagaaatactctaagaggtgccttgttagtgcagtaggtggcacgccagtctcacaatatgaaaatatacaaagtgcactgtccaaaatggtagccatggtgggctcagcactttatatgtggctagtgttactaaggaactcaatttttaattatatctaattttaattaatttacttttaattagccacctggggccaccattttgggcagtataacataaagccataaaagcattttttttttttttttgagacagagtctcgttctgtcatccaggctggagtgcaatggcgagatctcagctcactgcaacctccacctcctaggttcaagtgattctcttgcctcagcctccccagtagctgggattacaggcacccaccatcaagctcagctaatttttttttgtatttttgtagaaacagggtttggccatgttggccaggctggtcccgaactcctgacctcaggtgatctgcccgccttggtctctcaaagtgctgggattaaggcatgagccaccgtgcctggcctttatttttttatttttatttttttttttttagtagagatggggtttcaccatgttggacagtctggtctcaaactcctgacctcaagtgatccgcttgcctcagcctcccaaagtgctgggattacacgcgtgagccaccgtgcctggccgaaaggcatgttttttttgaggctttaaatccttggatttatgggaaccagggaagagtataaagaaaaacaacagtaagattctctacaagtttatcacaggatgcagtttactagaaatagtatagataagctgtgtggtaatatccatctggatttattagacatacatgtaatccaagccaatttacctaaaatacctagacctcagactccccacctgtagagcaggaatacttaccaacttcactgaggaattatggagataaaaaaattaatggatctgatattgtgggtgcttaacgaatctggttttctttctcctcctgtattcagttttttacatgaccaaactttcctcacctgctggccaagtgcctgatctgttactaaatttaatattggcaaatacagttaatgccaactgtttgccaaaatgtgtatactccaccaaattacactgtcaatatttaattaagagcctgaactttaaaaatgtatgactaaaaataaacacatgtttagcattatggaaaaatctcacaaaatttaatcctaaaaccattattgtgaaattagggtagatattggctaggcatagaaactaacaattactgcttctgaattattctgctacaaaactgcttaatttatgaggatgaaaataaaaattaaaagcaaaactgaacttgtatctgttttatagccagaaatttggctttaagattttttgaaaagtactacttattacattttctattaatatgcaatatcaacatattctaagcccataaaatgatctggctttctttaaggttcctttcaataataaaatattcaaatatctgttatgttgttgatcaactgtagaatactaactgtatatcactcttaggctgttcaacagaacctaggaactggcagaaactaatctaaaactgacttctccattgtaatctcaagagcctccctcagtgcacataccataaaaaagcaatctaccacctatgactcttaatttttaatttttttttataccgagtctctctctgtcgcccaggctggagtgcaatggcgcaatctcggctcactgcaacccccacctcccgggttccagcaactctccctgcctccgcctcccgagtagctgggattacaggcacccgccaccacgtctagctgattttcttgtatttttagtagagacgaggttttgttatattggccaggctggtttcgaactcctgacctctggtgatccacccgcctcggcctcccaaagcactgggattacaggcatgaaccaccacgcctggctttaatttttaatttctatcacagaacaaacgtttgccactggaggctgccaaactgtttctatgactgtctctcttagctattttcagatactgccaaggcataatgtgtgaggactaatacgattctttgtactaatactttgttttcttcagtggcagttcagacagggtacaaaagctgatcttttagctgggtaaggtctatattaaaaatttaaacctgtacaggatttctaatcacttaacacattttaataccaatgggggaaaagcttgaactaggtataaaatgctgtctaaatccttgatttaaaaaaaatttacttcgcttggcctgtttaaatactgtactttggccctgttctcttgtcccacgtgtgcttaagtaaacaaaaatgtattaaccatttcagttgatataagtaggcagacaccttgtgttcacatttatgtaaccagaagcaaaaactctgtaagctatgtatttacttggttggattaaatgtgtatatatacacagaagtacaaacaactaagaaataaattacataattcaacaccaaaaatctcctatttcttatccctattccaatgaacaaactacaaaccaaagcacttctaaaatatcttccagctatcaagcactgaaatcagaagtatatatttttaagtgtcaataaatcttatacacctacagattaaattaaggagaaaaccagcttacttccagactgccaaccctatgactttaaggcttggaggtactctctccaataacaggtcactttaggtctctaatttaattatttattcttattgtagtcaccacttttttttaaagcttagtattaatcagtgcacaaccaggatgcacaatgttgctcaactgtatgatataccaacaggttccatgagtctggggtttattaacataatccaaaatgtatgctacaaccacactgtaaaaaaagggcgtctaaatcaactaccctacacaaagttccctgaaaacaaagttctctcaaaacaaagttctaaaaatctttaacttgcataactggcacatgggggtataaatctacaactcttctaagttttttctccttagttctgctaagtgaaaacacaagtcattatcaacgtgtacttgaaaagagaaaaaaaaagaaaaaagaaaccagagacacgcctgctgggtataggagctccacccccaaaactcaaggtgaatatccttaccagtctttaataagctctgcattctggtctgttctcatcccacataccttgttaatcatggaaagcaactccgaactaaaactggtttaaagagagtccgaggtgttgcttatacgtctggacttcagagactggagggttgggactttacatgcccctaaacgtggccttacggagtaatacagcgagggaaaaaaggagatcagtggcaaaaaaaaaaaaaaagggggcaaggaaaagaaaacggtgaattacagagcccaaaactttagtttaggtcccaacttcagaaatctcccttccctggtgccccatccatcccaggaatcaggagactcaaaaaaggttaagggccagcgttgacctgtgacaactaaaacgattttgaaaaatccagccaaagaaacaaaaaaaaaaggctgcgaggagaaatgggatggaagaaagatgaatgctgagagctggtctctggggcgccaccggggaccctggtttcgggggaagaactggaggtgcccgtagctgcggggggacggtgtgtgtgtaggggcgggatgggccgtcccaggtgcggcggccgaggcgcgggggtcccggagacgagaaggctgggcaaactaacccggtgcccagaggcctccctgtccgaagggggttgtgcttcagctgcagggggtccttcccctccccttccaactcctcacccgggccgtagaacttgctgcctttggtcacgtcgaagactttcccattgaccgcgagcaggatgcgcgggttgcgggagccgtcgtactggcgcagctgctccaagctgaagtcccgcttcttcatgcgaggcagagaggtggcggggctctcctcgcccgccccggccccggcccccagaccccgccgcccccagcgcacccacagccggtaggcccccagcagcaccagagccaccagcgccacgttcagcagcatttccccgccccccgtcagaagcgccaacgccgccgccgcccagcctcccccttccgctgccgctcccgcgtcgcctggactctcgctgccgccgtcgttgctgctctcgctgccactccccagggtgcctagcttcacgtccccatcaccagccgccatcactgcccgccagcgccttcctcctcctccccgccccctgccctccccaaccccacggccggccccgcccatctgggggcctctcagccaataacgtgagaagagggggcggggtcaggccggctcctgattgggtgttgacggggtaacgttgtctcggatctcccgccccctcccttctttcgctggccgcgcacgcgtgcaacgccccgcccacctcgccccacacttccctgctctcactccaagcctccgctaggttaagtagacgagccgggcgggtctgaagaaaagatgctacgacggccgcgcggacgctcatgggcggggcgagaccacagcgcgtgcgcgggctcctgagcgccacgcgctcgcctttcgttcgtaacccctgcgggaggcacgccccgcccagtctccaggctctgcgcgtgcgccctggaatcgcttcccttcctaggcctgcgttcgcgtccgcaaactcccgcctccttgcgctccccccgcccgggagcttcacgtgcgccttggcggccgcgggggcaggtccgggctggacgcctggcggaggacgcgggcaggtggcttgtgggaggctggggcatagttgagctgcaaggcgcaaaccgatgaggggcgtctgcttttcaccagggcgccgtcgcttttgtcgggaaaccggcagcgtaggcgcgcagaccgggaagcggcaagaagatttggccacgagctggggtcttcctggaacggagagaaagcacggaacccgcaccgggcttctctggcatcggcagtctacgtgctcctcgcgctggcaccgagcagccactccccgctgggtttggcaaaggctgctcttgtagaattttaaaggatttagagtctcattattccttgaatcataacttctgcggccgtagggaagtggacaggttgaggtggtctttctattcgtcattcactcttatttgcaggttctgtttcatgtacttggacgtcttttagcctctcacaccttgaaattctagtgtgaaaaagtgacctctgaagtctcacgcactcaactcgtttgacgaactcgtttgacgtgttctctcttgccctttgttgtctgttgtcttgagtctcatagaataggtttgaacctttcactgtcggttttgtaggagtcactgaggatattgacgaggcaagtgacagggtcgacactcttgtagagaggctgtatagcaaccaggtgtctgaaggattagaggctggggaaagagtgggaaagcagttagtaggctagggtatttgtgcgtgaggtgaggagactcagagctaggggagacattagagcaggggttggcaaacattttttgtaaagggcccgatcatattttaagtctctgccttaactactcagctctaccttgtaacgagaaagcagccatagacaatacttgaatgagtgtagctgtcttcagtaaaactatggacattgaatttttaatataatttcaggtatgaaatattcttttgatttttaagaaaatcattgaaatatgtaaatttttttttttttagttctggagaggtgcaaaaacaacttataagccatattgctgagccctgcattagaggtacctgagggagagcgacacaattggtagtaaatgaccatatactctatccttcaatatggaacacttttggaagtaaagtagggcattaataattatagccagagaccaggagttatatcagttttatcccaggcaaacctaaaggaatagtcaccttaaggttaagggttaggagaagtcaaaattgctttaggacttggtaacagaaaatgggaggtgccagtgatggaaataggaagataaagaagaaactggttttgaggagaagatagctgtagcagtcccaagagctgtatacagttgagacaacattgataggaaggaagaaagcaccccagaagcaggccactccttatatcttattgaccagaactgggctattagctgtccctaaagcagtaacagacaaggagcatgggacatccatgattgcctagtgtttatctggcttttttaattcttattcaggactgtgttgagcattgctggacatttaccatctctggttccttccagctaaatgtcagtaccacacctcaggcattgtgacaccgtaaatcaaccgtttttccctcccaccccccagaggtgtggtactggttgagaaccagtagcttagaccctcaggatttaccttggggctgaattagtgtgtgtaggtttcttttccagttggtttggagggaagagaggaattggacagtattaaagttctgctgtcaaggaagtgggctggggaatgttgggtagctaaccaacattggctgccacgtgaagtaaaaaagttttcctttatatccttgataaaatagtgtctcgacttcttcacacttgaagccttcccaaaaccccagcttttttgattctcattgtaagccccttgaactggactagttggaagttcttattttccaccctaagtaacaagctcttgtcccaataggatactcttgctttgagtactgcaataactttccaattggtgacttgccgtcagtcttttcctatttcattcctacacgaagagactagaactgtgttctgatttcctttgctcagacaccaatctccaggggtgctctgtaatttgaagaggacaactcagaaagcactcaagggcctccataagtccctgagtggcttccctgccttcccgttccccagcaaacaatcccttggataccctctattaaatgatacgtttccccttacaatacctagtcccttgccccatatatgctatgtgtattgcacagtctaggacttgactcatgctgtttcctcacggagcatgcccttcttatttctaaccatacaaattccatgacctatccattctttcaattctacttccacctgaggcctctatcagcccacattaacctaccttctttgaatttctgtgtgttccttacctgtaccacccattttggccttttattttatgctcttcttgactattctgttattgaaactgtcctttagatcccaagatttctactttttccctgcggatgcttttttattttttttatttttgacttctttctaccctccttttcctcttacatccctgctttgcctagaggacatctacaagaatcgtcatgtacattcttttctcctgttgttagcttttttcccctgacacttcatctatttactgatttacttgtaaatctctggaagatattagtactagccaccaaatatttctatttctttttccacacacgtagatttggatttccctactccttttacctcaagaatggccaatgaaatgtgattggaagtgacttgtgtcatttccaaataaaagctttaagagcctgtggacatttatcctgcgctgtttcttcctgccaacagtgatgaaatattttaattatctattgtcccatgacaaagcaccttaaatcttaatggtttaaaacagtcaccattttattatgtgtaacagttttgtgggttgactaggctcatgggcagttgtctaatcttgctcagggtctctcatgtggttccagcctggtattgtttggggctggagtttttggaggctcaactaggttgctagagtagctgagcttttctatttacccatgccgttccaaagactctctgattcacatggcttcttcagcagagtagcctgacttctttcttgcatggtggcttaggattctcaaatgcaataaaagcaaaaacttcgaggttttgtaagtcttaggtctggaaatgacatgttgtattggtaaaagcagttacagggccagctcaattttaaggggagaggaaataaacacttgataggggtggagggagagtgacaaagaatttgtggccatctttattacaaaaatttttgtcaaccacagagttacaggaaaatgtggccatctttaatcactactccaacgatgtttcaaattgagtgggcttccatcagccagggtctcggagacaggacaaagtggaaaacagctcccaaataacatacctaggtatatgaataagaaatacatctctgctgtcctgagtcacttagctatttggagttgtttggtatcaacttttgcatactaatataaaaattggtactggaaatagggtggtgctataacaaaaatctaaaatatgagtcactgacatatataataattgagttagaaatactagtggttggttgttaggcagcatccagctttgactcacttatgcatttcccagtgaacctagctcagaagtttgcaccatgatattcaataaataattcttaaataagagagattgtttcttgtaatttttccctattttagggaaaaactttttttttttttccatatcacatttttcttgaaacattggagtgccacgaacatatcatttgatgctctgtttgagtgccaccagtgagtttcccgatgtttaagtttggctcgtgggcagcccaccttcttcctctccactttctcttgggagccatcctgctcatggaaagtgtgctttctcctctgctacctcacacaagtttcaaaggagcttgctcctgccaggggaggcttggggtaagccaaacagcatcagctccccgggggaagggaaatttcaggtttggagctaagttcacttccagggagtgacaaagcctgtttgaactttaattcacagagtaaaagagttcaatgttggccattaatgatttggactttaacatgaagttggtactgattactttgggccataatttagaaggacagagtgatttaatctctgaacttttaatttctctctggaaaattaatactgggagagggttaaaatcaaattgagaacatcttgttggttcttagttattaaagtatttgatcacattttagaaattctgataactttgggcaagctgacaggacatagtttgagatggcgatagaacatattgtgaattacagccttggatacagaatagcattggaactgatttaatcgataaattgttctgacccattcagggcattttggggacagactctacagtttactagtggccccaggacatcctgcaaaagaggtgaaatcagtattggagaagtggtctcatgaagatgggagcacgactactacaattgactgctgacttctcacccaaggaagtaactgtatcccagcctaatctcagtggataagcccacagggttaaggtaatggtcttcatacttttgctgacacacccctaaaatagtttttaagttgacatgtaaaatattttgaccttagtggcaaaacatgtaattttttgcgtaatataaatgtgaatattttaaaataaaaagggttatgttacctaaaatgcaatctaaatgaaatctaaatccatagaaaaggaatactcaccatcatttattttcacagaaattttacattatgccttttcctatttgaatttgtattttcattctacttccctaacataattttattttaatgtattttgtgcccaaatatattttattgcttactctattattcttttccacaataataagttgtttataggctgggcatggtggctcatgcctgtaatcccagcactttgggaggctgaggtgggtggatcatctgagctcaggagttccagatcagcctggccaacatggtgaaacccctgtctctactaaaattagctgggtgtggtggtggacacctgtaatcccagctacttgggaggctgaggcaggagaatcacttgaacctgggaggtggaggttgcagtgagctgagatcatgtcattgcactccagcgtggatgacaagagtgagactcttatctcaaaaaaaatagtttgtaatttaaaaaaattcctatgactataaggttctaaatgtcagaaatttcttttgaatggagttatcattacaattattgttagtacataataatcataactacattataaatttttacaaataattactaaagagaactaaaattttattggaaatatatctctcaacgaagtgaatggagctcccttctcaattacttcatgtatttataggtaaatgtaactttttgctaggcaacaaaatgggaaaatatgttgggtgataattaggtatagggcttacacaagcaaataaatgattgttgttaaatgtgttgtttaaaatagaaaacaatatatctaaatctaagtctattacatgaatggtaggaatgaataatgaggtgagaaatgtttaacaaataacactgagcagacatattttggtaaaaaaatgaatatagatttactgtattcaataatcttttggcaaaaattaattagaatattttcttctaagatctgaatatctattaaagaaaatgagaaacattaactttctagttatatatgttcctttttcatgtaacattgatatattgaaaggaaatttggaattttttacattcttttccttgaaatcatttggaatttgcatctgagacacaggagaatgagattttacatcaaatgctctcattccggagtaagtgtgccttgtagctaattggtatttcccagaatgattttcacaaatcttgcatatccaaattctgagatgtatatgtggagcatggaacctgactgtgagtttgttatctggatgaagtagggtacaacctcctttagtatttttgtttgctctctcacccgcgttctttgacatcatcaggaaatggaagaggaaatggcattggacaaaaattagcacagcacccgcccttgtcccagtgtatgtatactcagaacacctcaacatagaccaaaatacccaatttctagcaccaggctcttctcttaactgaaatatatataaggaaagccaggaaatcctcatgtaggtttcttataccctgattaaatcaaattttgatttcaagacagtatttggaattgttcctttgtatgatgccttagaggtttttttgcacaccagagcaatttgctatagaaggatctgggatggataagaagatgcctgtcttttataagcgggaaaagaatgattttttttttttttttttacttgtcactgacttgaagcttaaagaatgatttttaaaaggagttgtaaaaatagaattgatgtgacatctcaacctcagtcatatttcaggcagctcaattttgggaaagaataggtgaaagttgaataaatggaatagatttccttaaaatttcctatgtctgtattctccttagaaagtacccatggaatcacagggtagacttatgccagagtgaagactactaaattaagagaataaaattgagtggggaatgtgatgtagttacagggggtgctgttaacactcctggcctcttgggtcaccccttcctcttctccatgaagtaagatacctgatggtgagaaactgtgagaaaccttggcctctttggccagtcttactcttggggccaggcttctctcaggaatcatgccttctggcctatttctttgggctgcagattttacagggataggcctgtggagtgaggggaggggaggattgcagttgccctgcactaccggttagcacctcagtgtaagcctgcctcatcctacagtttggtgttgggaggcccattgttgccatgcaatctccagcatcagctttatcagtagccgtggtagtttttggctgtctactcttttgtgttagactgaattatttacagatctgtgaaacatatacaaaatattgacaagctgtacttcgttttgatactgagtgaaagttctccagtagaacaactgacttttagcagcatgcaggtgcagaaatttctgatgagaagaaccaaaagatcataactttgattctttattttctctcctctccagtatccaatgcagtctctcaggtggtttataccttggtgggaaagaggagtgtggtttactcccaagccctaaatactctcagttcttaacagtactgtgcatattaatacaataagtactgtgaattttcctaaggtcactttggctatgaggatatgttcaatcctgctttttccctttaataatattttatatacatttcatagatttgtacatagtaattatattttcaaaatgttgttttgtaagagtctgttactgggacatatatataaagcatcaaaagagttaggttcaggagaaagaaaattgctctacagccttaaacagttagttctttgagattcactattgccggagtttcacagaagatgaatgaatacattaaggtttgactctaaggaagtcagcttgccattctgtttcttcctgtgctgtaagcagcctggcttgctaagccttggttttaacattcataaaactatgatatgaaacacggccatcatatgagaaaataagactaaaaagcaaaataaagacgtgattactgtaatagaagctatgtgcctatagatctctaatatagaaatggtgctttttaaagggggtacaaatcgatgttgttttataagtacttgggtctttagaaaatgcaatctgcttttcagattgcaaaaaacaaacaaacaaaaaaacccctcagaagctaagagccttagtttaatgcaaaataaactgtttttgactcctctataataaattggcacacataattcgagtattgtcatgcagaagcagaaattttgactagctttacattgttatggttgctgaatgaaagatctgcagtagaacaactgacttttagcagcatgcaggtgtagaaatttctgatgagagaaccaagagatcaaaactttgattcttctttttctcttctttccagtatccaactgtcaagttccactggccttccaatatattgtcccaaatctgactgaccaccttccatgtttatagctactatcctagtgcacgccatcagcagctatcatctgaaccatgacaacagcttcttgactggcgtcttggtttccactcttgccttcccagagttcattctctgttattagccatttaacaatataaatcagacctaccacttcccttcctatacttcactaatgtctttgccttgcaattagaataaaatccaaactctttatcatggcctatatgacctattctataccttccctttgattgctctcaaatcgccttccttgctcattatgatccagtcatattgattttctgtctttgcttgaatactccaacctcattcctaacttagagattttgcatttgatcttcctctgggtctggaattctctaccccatttctcatggctgacttgttctcatcactgaagtctcagctcaaatattctctcctctgagaagccttatcctgaccacctgtctaaagagctctcacatcctctcccccaactttaatcattctctatcctgcttaattttcttcatagcatttagcactacctgaaattatcttattttttacatgtttattatctgtctgtctgttagcccctagtagaatgtggaatgtgatttcacggtggtagagcttttactgtcttgtttcctgctctatcctcaaagcttagaacaaaggttggcatttggtggggattactaaatatttgctgaataaatgaataaatcaaggccctgatgtacccagaaaaggcctttcaaggggctttgatcatactaatttttcatggttcagagttgtggcctttcattttgaatgctaagaaatctgcttttgccagcacatggaaattttttttctccaggaaagaactttcatgaactgagttgcaagagtgacatataaaatccctaagccaatttattagtttctggtgagcagtataactgtcacatggactcagagttgcaccaacatgatgtgttgaaaaatctctgcctatgggctgacatataaaggatagtgaattgaatcagaaagctttttgaaaaacattgaatactagaaagggaaattagttagatggctcatatatttaaaagcattcatttatttcacaaatatttcaagatctctatcttttgtgtggtgtgctaggtattgaggagtcaacagggaatcatatcaagtaccagtccttaaagatttgcagtctagttggggaggctaacaataagctgacaattataaatcaatgtcaaaatatttttttaggataatcttagggtaatatgggaggatttagatgggaaactgagccttagggaattgaggtgaactctgaggagttagtgcagcatgaggagaaagagcactgtgtgcagaagctgtgacctgaaccaaggtgtggacccggagagggcagagttttctaagaaacacaggtagctgagtgcggcggtagtgaagagctgtagggtgaggtgagaaggctgcagataaggctcatggacttaggcttggactttatccctacatagagtaaagaggagccactgaaagttttgtttcagtggggaggtagaatctattttttaggttgccggagcacagctgatattttgcattcctttcttcctaagaactttccatgaatatctggctaaagtctacactccctcccttgaacacatgacccttcctttatatgtactctccagccttatatcctactgctttgcagcacatgatctgtgctccagacacaccaaacttcctggtttccagattcactcccgtctttaattatgcctttgtatcccctgcacttgtgaagcatgctcgtctaccccacttccaaaaaatgttactgaatcatttttccaaatgacggaagtaagacatgttctttgtaacaagccaaaggacagagagatgtggaaagaaaaaattaaaactttctcctttcctctcaccaccaccaccaccaccaccaccatacccatacacacagagtccactgtataaaacagtttttttttaacttaaatagattcatgctattcattttgtgcagtctctccgtctcccaacagaatctcatggacatcactctagcacctgctgggtgccaggccctgtgcctcacctcatttaccctacaactaccatggcactattgtccccagtgggtagacaaggaactgacatgtgattaatttgcccaaagttgcacagctagtgattgtgggagcagcagctggaacttgggcaatctggcttttgagtccaaagtgctaccactgccttttactgtctcccaaattaatgctatttttgttctttttaataactttacaatattcgtatggatgtctggaatatattcaattatttctcttgttgatgaatgttgaggttattttttgccactgcacttctccaaggagggacttgagatcaaagaacatactatttttattaagcatggccaaattatattccaaggattatatagcccaagcaacatagaggcatatctgtttccttatattcctgccagtcctgggtgatgctgatatttttagttttttagtttgttcgtttgtttttttacccctggctgtgtgatcagtaaaaacaatacatctttattttgatttgcatgttttctgactacaggtgagattgtgaatttttctgcatgtttttgggatgtttgcatttcctgtttcatgatttgtccatgaatttcctctcctgtctattttttctgttgggttgtttgtccttgatcatttttggtggagggtatggtatatgtgtatgtggagggatgtttataatataataaataattttaaccctttttctcacataggttcaaatactttctccttgtctatattcattcaccttttgaatttgctatgggatcttttaccttatagaagtgtttactttttatgtggtcaaatctgttagtcttttccttttggctttcctggaattcacaggttttaggcatttctgttcattaaggattgggacacttggccaaggctctccctggaggtgcttgatgggctttgaaaacttttgtctcagactcttttacctttgtttctacttcccagtctccttctgagagatctgttctttcttggaatttgttattacattcaactagactaaagcaaagtatgtctgggctgggaatcatttgtcattgtaaaagtgtgtttgcatgtcttttctctgattcactatgttttaattttctgtttctctctccttgttttaaggagtaatcatcatgctccatttcgtttttgagccatcttcagcctttgagtccttaagctttttggagacagtttgtggagaaggtatgcccttgatacaaggcctatggatagtgatgacgattggttttgaggctgtggatttgagaatgagttagtctctgtctttgattataactgtataatcctgggaagttgtaataggtctccaggcccttttccataaaataataatactgctctgaagctactttttgacagtgcaggagaggactctaaccgttaatttaaatgtttcgtccttgttggtcgcatttcaagaatattttaatttcaagacttgtgcttacgccttcacaaattaccttggtgtacccctcttttcattcactgttagcccatgaaagaaggataaaatttgtttgccttaatgactggtgtcttttatagagtctctagaatgaactgcctatttcactgttgagaagagaaacatttaaactcttcgtggaagttaaatttggggtcattttacacaaaccatggctttggtccaaggaactgagatagatcatgtgagttgggagtggacaagggaaagagtctggcctgcattgtggtagatttttaaaaatttaaatctttatgtttaattgagaaataataattgtatatatttatggggcacaatgtgatgtttcgatatatgtatgcattatggaatgattataccaggtgagttaacatatccataacctcacatacttaccattattttctattgagaacatttaaaatatattcttttgacaaatttgatatataaaatacagtgctataactatgattaataatacataataataatgctactgtatgataaatttcaaaaaattattcctccgtctaaccagtctaactttgtatatcctttgaccaacatctcctcagccactccctagactcccagcctctggtaaccaccattctctacttttataagttcaacttttttatattccacatgcaagtaagattattcagtatttgtctttctatgcctggcttatttcacctagcatattttcttttggatatgtccactttcttttgtccattggtggacacttaggttgatttcataacttggctattgtgaacactgcagcaatgaacacgggagtgcagatatctctttgacatactgatttcaattcttgtggatatatgcctagaagtgggattgctggatcatatggtaattttatatttagttttttgaggaacctccatattgttttccgtagtgactttacttagtggattttgaaatgcacacagaatttgttccaggtttattaatgggctcatagaaaataaagcaagaagagacataaagttattacccaggtgtcccccatgccctcaggctggtgaataacaaaaccaatcagtgaaggcagtttgttgaattgctcagttgataatactcttggatggtagctaattttaggggatttggggataagtactaggattgagaagctaattggacaagtggatctcaggagaactcatggctgacccattgatctggttcattctttgcctcccatctccatgagatttgaggcagcatggcccccctgctcttagctgtggatctgttaggtaagaggagatgactacaccaactccttgcttaaaagtctttctgtcccttatcctcaggccttgaaagttttaggttgtatgcagaaattaaaatcaattaatatatttaaatgctatgtgcaagacattgtatgggatggtgtgtgtgtgtgtgtgtgtgtgtgtgtgtgtgtgtgtgtggaagagagaggagagagggagaaagagaagagagtgctgtattaggtaaggcagagttcttgcctccaaggagcagaggttgctaactcaattgcctaggaggccgggtagattcagtcagtcacatggctttgcatgtgtaagaaaaacaacagagttagccagataaatgacatcagattcttacttgtgtcactgacaataggaggtggtgggtgctatggcaaatgggagttgcacaccctatgtaaagagagcagcccatacaaagatctagcatagtggtgttcaaagtatgggtccctggacctgcagcatcagaatcacctggaaacctgttagaaatggaagattttcagccccgtctcagcccactgattcagaaactctaaacatgggagccttgcagtctctgctttaatacactttggcgatttgagaaccactgttgtaccatggtgttgccttgtgggaatttagatccagtgttgctagatcttttgatttttttcaagggaagctataaagctaaatccttatggaatctactgatttttaaatattagaagttgtacaggatatatgtaattttggggagcatgagaagtgggaagaggtaccctgtacaggccaaactgcaggctaaagaaaccacatctgtgagcctcgtggcctccaggcctccagtatgaacttagaataattaaatgtctgcttcattgttggactagagcaatgattttcagagagagagagaggagagagagagagagagagagagagagagagagagagagagagagtgagagtgagtagacttgaaaggcaaaagggggcttgtaaaggctgcacagaatctgatccttccagagcatccctcaggtatgttaataaggaaggaaagaagcccctgctatggctcttgagcactgtggattataaactgtgttcacatctgttctttcatcaggtcctcacaacattgtgcaacaagtgtgaaagatgtagtctccatttacggctactgaaataggctgagagagggtaagtgatttgcctaaggtcacatagcttgtgaggcttaaatctgagactagatacctaattctatgctttctaaactagagtttctctctcatacatagttatgtatatttatgtgtgtttgtgtatccaaacaccactaattcctgaaaagatctggtgtggctcactggtgactggtttttgtcctgttccttatgactgagcctcagctggtcccctccctggggtggtgtgctgcctcaggccccagattttcttccttttttcttctgtgaactccttagtaccagttgtccctcttggaacctttctcccacaccagttctgctcctggactctgactactcggggtcccagatttccctgttctggcctgtcttgccaccgaccgaacctcactgggacactggttctagatttgtcccctgtatgggtgatatgtgacccaggcatctgccatctgcaactagactgagtgtcctgactcattttccataggctgctgagctgccaccagagtaatggctttctgacatgtggcaagtttggataataaatgatgtatattattatattaggagagctagagtataggattctttcaagtattttacctcatctagcttaaaatgcaacaggcatgtatccagatagcactaccagaaaaattttagtagtttgaaatttctggggcctgttaaatatgatattgatgaattctgcattgtgctgggtatggggtgggcattgtgacagttttagatacagtcttttgaaggggctatttcttccatgttcggaaaccaagtgctggggagggatgatgggggagagctggtggttgctgagtgtccaggtgtttacaacaggaccctgcgtgtgcagtgaatcagaaactgttcagtcttctctttcctcgccctcaccccaaaccatccatgtaactgtctgtgtgttgaggggggtggtgttgggggtgggagagagatctagtgactatgaaagcactagggtgcagaaatgtcttggtacagcgctgctgtggatattgataggaggaaatagagaaggtaccttttgcaaggacctcacgtagcccagggttggcttctattagttagtttttttttttttttttttatcagagaataacagatcactagtgggaagggtgtgtttcagccttatcttggatgcttccttactttatttgacttaattcagaaactatgcaatagttttgtgtgacttttgccatttccttttcacgtaatgagttttatttaaagtcctcataaccgtttttttgttttgttttgttttctatggtaagagtaatcaaatgagaattgtaaacagttttggggccatttttactcgacaaaactgttctcctgagccagacctctttctttctctgaaacacttaggggcaggagaaccagacttttataggagaaatatgaattcttgtacattgtcacaaactggttaataaataatttaaaagcagaaagggtcctattgaaatattggactccaactttgtccagtagacatactgagtaccaaggatttctcagcttatttgaacaaatgtaggaagatatttaaaatttccctcagtgaccacatagaatgtcatttctctatctgcttcaacacagagctgttgggtagaaagtgaaggctgaaggtcacctggaataataacagtaacagcttatttatattgttttgtaccaaagctgttcatatatgtttgtgtgttgtgtgtgtacaggtatatccatatatatgtatacacacatacacactacacatgtatatatatatatggatatacctgtacacacacaacacacacacacacaaatacacctttaatcctcacaataatgtatgggtcaggtacaattattatcactattttacacatgtggaaactgaggcacaatgatgttaagccactcttctaagctcacacagctagaaactgatcatttgcatccaggcaatctataccatatcagttcccttgacatattcttgcaggactcactgaggatcaaagttctccaatcctggaacctgtgctaaagctaccccacaggctggttctgttgtgtgagacattgatgctatcactcaccaatctgcctagaccacagtagctgacatttactgagcacttactatgtgccaggtaatgtggaaagtactttgtatacatcatcttaccaaatcctcccagcagacttatgaagtaggggctgttttacatatgaggaaactgagacctgaagaagttaagtaacctgctcaagataaatgctagtaggtataggctcaagatttaccactatgctcttctgctctcttgctcaggagctgggctcctaactttgtgctcccagtaaggactctgctagtgcacattttctctgtgtcatgacttttgctaccagcctcctgaagtcaagggttaagggtgctttcgagaggagaaagcctggcttaacagggaatctggaagagaggtgacaggaactcttcccttcaatgggatctgagcagtgcgttatagtgagttcctgtgggggaagggcattgattgctaaaatgggagctcttaaatattcattatggttggttacattttggccttcactcttaacaattactatttgattccactttatttaatatatgacctttatttttcttttatttattcatttggccactgttgataccttgaatattttagctgcctactatagtcaaagagctctagcagaattacttgaaaatagaatcaattcatctaaattagccatcaatattatgttgtaaaagggataattatagtaatgccattatataaaatgaaagtataaatatatataatagattcaacatgagaataatagatgtttaattctggcatcttctctagatgtctcttatttcaacactccttaagctcctactctctgctagccaccctgggaggtgctgggattataaagataataagccatggaccttgtcttcaagggatatgcagtccctgctgggagacaattgataaagagctatgagaacactaagggcggatgcaacccagagcagaggaggtggggtggaaatgctggccaggaaggctacttggaggaggtgatcccagagcatttaatatttcacactggtgagagcaggaaggcttggtagctcagcacacggggtctggagtcaggggtgttcaaatcctggctctcttgcttgcagttaagtttgtttactgtggtgttgcagtttctcagctccattatactcttcttttttttttgagatggagttttgctcttgttgcccaggctggagtgcagtggtgtgattttgcctcactgcagcctccgcctcctgggttcaagtaattctcttgcctcagcctcccaagtagctgcgattataggtgctcgccaccatacctggctaatttttgtatttttagtagagaaggggttttaccatgttggctaggctggtctggaactcctgacctcaggtgatccacctgcctcagcctctcaaagtgttgggattacaggcatgagccaccacacctggcccattatactcttatggaaccactgttgtgtatgtgatctgttgttttactgaaacatgatgtggcagcacatgactgtagaaggaaatacaaccacaggagagggtgtttgggctaaggtgtcatgatgtcatggaagagtcttacccattgatgtccagagtctcatgaaaaattgaaggatatattctagatgagtgtttggagaaatctgatggactcttgggaaagtaaattataaaattaaaacatatttttttttcagtaaagtgtaaaactggtcatcctccacctgaaagagaatactaaactttaaaccaaaatataaaaagaaagattgctagttgttttttatctaatcctttttggtgaaaatattagtttgaaaattgttatctaaggtccctgccatcatttggaaagtcaagtgaaaaaagaaagaaaaagtcttctgaacattagtctgaattccaaacctcatcataaactctgggagaaaggtgaaagttcagcttttcctattggcctggactggaatatctgcctttctcttgcagttatatctctattagcaaattgtctggaagcaaatatactttagtcagctgtggtcaaacatgaaaatgctcatgagatatgcaaagcagggtagcctgagctcagccatgatggctgagaacagccttagtctgtctgtctgtttgggtgcctgactgcctgcactcagctacagagcagtggggctgcaagtcctcgtggtttctccttggggcttttatcttttccttttccctcacttagccaggattccccccaccatcacagggctggtcttagcccctccctctgatatcagccattcccactccactttcagcagcctagcatcctgtttgtgatcattctcccagtcccaccattaggcagttgctctaccccttccctctatcaaagcatgaaaggaccatgaggcccagatgcaatggttccaatgtacatttctatttccaccagagagcctttctgtcctggggtgcctggggctaaccacaatgcgtttcctcaaggctctggccccagccttaggcagtgaaaaagaccaaagcctacctgtaccaaggaaattcctgggctgttggcctcttccaccctgctcttacttcctaaccctctcaaccctaacttctcccttctctttacctcagaggcttctgtggcatattttaagtttttccagaatgtccagtgctattttaataagcattgaactccattttcatagtgtatgaaatgctttttccaaaattgagacatgagtctcagtgcctcttatattgttttcatgtctgaaaatgaagtttatgacagaggaatgtgttgatggaatataatatcttcatgaatagaagcattagtaaactggctcagttgtcattaagaaatactttcatttgctttttgacaaaatagtcatgagtgaatagcaagtaatacattaaaaactgctgatttcttattgcactcattcatattaaaataacaatacagaaaataaatatagaaaaacttcacttacaatcctatcgctccatataattactgttttattttcctgtgttccctttcaggcctaggccatgtattaggaggctgctgaatggggctctgaatacagctagctccgtggtaaaggaattcttgtgaaaagttgtgttccatttgtgtattgtacttcaaactagctctgggcactacccacattttaacttgctgtgttaaccagctttagtttattatctcagaactctggctgcaccattatagtagcaacattcatcttttttttggcagtggtggggcctttaccaccagcatatcaaggaatatcacaataagctccacgacactagattttttttttttgagacggagtctcactctatcatctaggctggagtgcagtggcatgatcttggctcactgcaacctctgcctcccaggttcaagcggttctcctgcctcagcctctcgagtagttgggattacaggtgtgtgccacaaatctggctttattttttttatttttttttatttttagcagagatggtgttttgccatgttggccagattggttttgaactcccggcctcaagtgatctgcccgccttggcctcgcaaagtgctgggattacaggcgtgagctaccgtgtccggtcaacactagatcttaattgcatatttccaaaaggttagtgagtttatggatattaataggccttcgtacataagagctgaattccctctttatctgggattcttatgttctgttgatattatggaaagttctcagctcaagacaggcaatgaattgggcctgaagtcatactctatcctctaaacggggcagcaatgcatatttccaagctcaagaaagaaatgactccctctggcctctccccctttctaattttcttcctgaaattgtagacgtcttatcttggtatttatagcatatgcctgattacaaaagtaatctgaagtgttgatgaaaaacacaatttcctggggcctttccaggcctattgaatcagaattctgtggaatggcttggtttaaacaggcaccttgggtgatttttacaatccaggcagatttggaaacagttgtttatttgaaggcaatccatagctaccagctcacacatgtgcttagcacacttttgaggaaaagtagccagtcgttccatcctcgggggatcaatggttgtgtaggcctttgtccttattccatcctaaatacggcatggtcacggctatacaaaatgtaggacggggtggcaggccaatgtgggaagataatcttctctgtcaaggtcattatacataatactgccacagccttcactttgtaattgggaattatattccttatctaaattataatttgtacatgatgggtgtgtgtgtgtgtgtgtgtgtgtgtgtgattttttattatgctttttttcatgtgatcactgggttttaaattcagtttactgaaaaaatgctctctcatcaatcactgtggtattaatttgaaagataagcagattttatgcaactctaggtcatggccaagatctggagtgatattccctgaagtaggctagtcccatagttgtgaaataatggggcttgttttggatgtatgcttccttgctggattccccactcacccagattgatccaggccctcctgctgtctgccagaagcccaccctttttactcacctccctacccttcccagcagggccctattctcccaaatcacccttccttccctcataagttcatctcttgagtcaaaagataaaataagaacaataaaacataacccaactctcctcctctagatttgatgatcttagctggtagaaagaaagggatggatgaaacaaactcatgccgtagcaggaatgactgatggatcttactgcattagcaaatggtcccaaggacatttacatcttaagacatgattgttaaactaaaggaataagtctcaaatacagtgtatcagacagtttaaaaggagagtgaggtgaaatgtggggcagagggatctttaaatcacacaagggccatagttcactgctccccgaggccagctgttgctcttggaaatgtgttgataatggcatttagccaagaaggccagggaaacatttgggtctggttaaagggcaagccccggtctttcgctctacccttcgtctctctcatctccaacagggcactgcatgggtgtgctctctgcacggtgggttgtcatgggagcaaaaggatcatctgccagagcaggggccaccccagcagagggagcatctgtcctggagcagtgcaggaatggtgcaaacccagagtcagggcccttgacttttcattattgaaggctattgacttgtggactaagtggctgtcaggtatagccctttcacgtagacagaatcaagaacctttggca

SEQ ID NO: 21 - DNA, 6588 bp, Homo sapiens
tcagaataatataccagtttaattaataattcccttaacgccctttgaaaatgtgaatttacaggctgggcacagtggctcacgcctgtaatcccagcactctgggaggctgaggtgggtagatcacctgagctcaggagtttgagcccagcctgggcaacatggcaaaaccccatctctactaaacatacaaaaaattagccaggcgtggtggtgtgcacctataatcccagctacttaggaggctgaggcaggagtatcacttgaacctcaggaggcagaggccacagtgagccaagatggcaccactgcactccagcctgggtcgcagagcaagactctgtctcaaaacaaaaaaaaaatatatatatatataatatatatataatatatactatgtatattatctataaatattaaaatgaaaatgaaaaatctaatggacagctttaacaacagcttagacttagcacaagagaagactagtgaatagagacatggatttgaagaagatttcaaggttgaaaggaataaaaaagaacaatagataggctgggcgtggtggctcacacctgtaatcccaacactttaggaggccaaggcgggcagactgctttgaactcaaactccacaagtttgagaccagcatggccagcatggtgaaaccctgtctctactaaaaatacacacacaaaaaagtagctgggtgtggtggtgcttgagcccgggaagtggagtctgcagtgagctgagattgtgccactgcaccccagcctggaaaacagagccacactctgtctcaaaaaaacaaaacaaacaaaaaaaaaaaacagaaaagaacataaaagatacatgggacaatgttaaagtgtctaacatatgtgtaactcacacagagaaaagaacaaaaatgagaaacaaacactatctgaagatatagtaaccagaattttcccaaactgacaaaagacatcaaacccaagatttaaaaaaattcctagctgagcctagtgactcaggcctgtaatctcaacaatttgggaagccaaggagggaaaactacttgaggctaggagttcaagaccatcctgggcaacatagggagacccccatctctaaaaaaatacaaaagttcactgggtgtggtggtgtgcacctgtggtccaagctacttgggaggctgaggtgggaggatcacttgagcccaggagggtgaggctgccgtgagctgaaatcatgccactgcactccaacctgggcatccaagcaagatcctgtctttaaaaaaccaaaaaaaaacaaaaaacagcttcctaaatacttcaagcagatgacaacacaatatccaccacactacaaaactacaccacaatataattgggatttttacatttcactgcaatataaaattaggcacaccacagtaatctgttaaaaaaaaatccaaaagcagctaacgggaaaaaatacctctaaaacaatatctctgaaggagttacaatataagtgacaaactactactcaatggaaataatgaaagccagaagacaaggaggggatatttgctaagagaaaataactgccaactcagaattctattctccacaaaaataaagacaaaattttgtaccctttaaaaattaagacgtaataaagatattttctaataaaacctaagataatttattgccagtggacacaataaaataaatactaagtaagttctttgggtacacagaaaatggttccagataaaagcaatgcaatgcagaaaataataaggagcactgtaaaaggtaaatgtgtgggcaaatgtaaaaaaaattcactacttattacaataagaaattaatgccctgtggggattaaaatgtggaattaagatacatgacaacagagctgggtacagtggctcaggcctgtaatcccagcactttgggaggctgaggtgggcggatcacctgggatcaggagttcaagaccagcctggccaacatggcgaaaccccgtctctactaaaaactacaaaaattagccggcatggtggtgcatgcctgtagtcccagctactctagaggccgaggtgggagaattgcttgaacccaggaggcagaggttgcagtgagccaggatcccaccactgcactccagcctaggcaacagagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttgggaggctgagacaggaggatcatctgagaccaagagtttgagaccagcctggccaacacagtgagacccccatctctaaaataaaacaaattagccgggcatggtggtgtgtacccgtagtcctacctacccaagaggctgaagtaggagaattgcttgagcccaggagtttgaggttgcagtgagctatgatcacaccactgcactccagcctgggtgatgcagtgagaccttgtctctaaaaataaatgaatacattttttaaagattctattaagatccggccgggtgtggtggctcacgcctgtaatcccagcactttgggaggccgaggcgggtggatcacaaggtcaggatatcgagaccatcctggctaacatggtgaaaccccgtctctactaaaaatacaaaaaaattagcggggcgtggtggtgagcgcctgtagtcccagctactcgggaggctgaggcaggagaacggcgtgaactcgggaggcagagcttgcagcgagccgagatcgtgccactgcactccattctgggcaacggagccagactctgtctcaaaaaaaaaaaaattctattaagatccctacaattttgaacaagatataaagaagctaatttcagattcaatgcaataagtaaataatgtacttgttattgtctaaggcaaccacaagaagaaaaataaatgtatgtataatgatcatgttataaaaggaaaaactagaataaaaatgcttgattaatccaaaaaaggcaggagaatgaaaaaagtaagaacatattaagcaaacagaaaaacactgggaagacagcagatttaaacccaaatatgtaagaaaattaatgaaatgtagatgcataaaatacatcaattaatagacaaaaatgactgggcacagtggctcacacctgtaataccagcacttcgggaggccaaggtgggagaatcccttgaggccaggagttttagagcaacctggcaacacagtgagacactgtctctacaaaaaatgcttaaaaattagccatgtgggctgggcgcggtggctcacacctgtaatcccaacactttgggaggccgaggcgggcggatcacaaggccaggagatcgagaccatcatggctaacacggtgaaaccccgtctctactaaaaatataaaaaattagccgggcgtggtggcaggcgcctgtagtcccagctacttgggaggctgaggcagaagaatggcgtgaacccgggaggcggagcttgcagtgagccgagatcgcgccactgcactccagcccgggcgacagagcgagactctgtctcaaaaaaaaaaaaaaaattagccatgtgtggtggtgcgcacctgtagtcccaactactcaggaggctgaggtgggaggatcacttgagcccaggaagttgagccatgttcatgtcactgccctccagcctgaggcaacagagcaagaccctatctcgaagaaaaaaaaaagatcttccttacccacactggggatgggatgctgtttccattactggaggcagcctagtgcaggctgttgcagtacaagcacagtaagggaagtattcagagaagagcagcccagcatgtaccaggcaaacctatcaggaatctaacattttctctcagccttccactagtaccattctcagcaaaaccactatcatcttcaatgtggacaaatgaaatagcctcctagtgggtcttcaaactatccatcatgcccttattcaatctattctctgtagagtggtaattatttaaaaatcagctcatgtaggccgggtgtggtggctcacgcctgtaattccagcactttgggaggccgaggcaggcagatcacaaggtcaggcgttcgagaccagcctgaccaacacactgaaaccccatgtctactaaaaatacaaaaattagctgagcgtggtagcgtgtgcctgtaatcccagctactcgggaggctgaggcaggacaatcgcttgaaccaggaggcggaggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgtctctacaaaaaatacaaaaattttccagcggtggtggcatgcgcctgtagtcccagctacttgggaggctgaggtgggacgatcacttgaacccaggagttcaaggctgcagtgagtcatgatcacaccactgcactccagcctgggcaacagaacaagaccctgtctcaaaaaaaaaaaaaaaaagccgggcacagtggctcatatctgtaatcccaacactttgggaggccgaggcaggtagattacaaggtcaggagttcaagaccagcctggccaacatggtgaaaccttgtctctactaaaaatacaaaaattagccaagcacggtggtgggcacctgtaatcccagctacttaggaggctgagacaggagtatcgcctgaacctgggaggtggagattgcagtgagctgagatggtgcaactgcactccaggctgggcgacagagagagattccatctcaaaaaaaaaaaaaaaaagtcaaatgccttctcctatgatatacaaaccattacatgatctcgctcttgcctaacattatcttgtttctacacctttcacttaccttttgaataagcatcttaatcatcttgggcttcttgcagttcctcaaaaatacaaagctcccctcagcccacccaaagcctttgtatttgctgttctctgccaggaatgccgttgctttagatattcatatggcctgggctcttttttcatgtcactattcaagtatcacctcctcaaaatgtcctgaccaccctatttaaaacatccctatctctacttgccaacttccattctcacccaggctggaatgcagcagcgcgatctcggctcactgcaacctccacctcccaggttcaagcgatacttctgccttagcctcctgagtagctgggactacaggcatgtgccaccacgcccagctaattttcgtattttcagtagagacaggtttcaccatgttggccaggctggtctcgaactcctggcctcaagtgatcctcccacctcagcctctcaaagtgctgggattacaggcacgaagccactgcgcctggcccttcttacttttcttaatacttgtccctacctaatattatgtattgatgtacttgtttacttcatgtccttactcctattaagatgtaagcaacatgattgctgggacccatgattctcattcacatctgctccactggtgtccagcacaacacctagttccaactaggcactcaagtatttgccaaataaataaaggaatatatttctagccaatgaaagacatatcaacctaatcataatagaagctagaaagaaactgggtcctaaatatggactgaactctgttcccctaaaatttgaatgttgagccctaactaactgtatgtggagatggggcttttaggaggtaattaaggttaaaggaggcctagaggaggggtcctaatccactagaattactggccttgtaagaagaagaagagggccaggtgcagtggctcgcgcctgtaatcccagcaccttgggaggcagaggtatgaggatcacttgagcccaggagttcaagaacagcctagggaatacagggagatctctgtctctataaatttttttttttttaaatagctaagtgtggaggcatgtgccagtaaacccagctactcaggaggctgagacgggaggattgcttgggcccaggagttcaagactgcagtgagctgtgatggcaccattgcactccagcctgggcaacacagtgaagccctgtctcaaaaaaaaaaagaagaaaaaaaaaggaagagagtgacctctttctctctctgtgtcatatgaggacacaacaagaaggcagctgcctgcaagccaggaagagagacttcaccagaacctggcaccctgattttggacttccagcatctagaattgtgagaaaatacatatctggtgtttaagccacccagactatggtattctgttacagcagcttaagatgata

SEQ ID NO: 22 - DNA, 100418 bp, Homo sapiens
ctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggtatgagtcacctgatggttttgtttttcaggatgaagcctctctgttatttatttcctgtgtctcattgatgctacatggtctttttgtcttgcaggacaggctccaatagatatccctccagacaaccccaggcattacggacaaagtggtttctttgcctctctctgttggcaaggtatttacaagtgtttctttaagtcacatggtttgatgattatgtatttcttctgtaaagatgttggccctagaagcagactacattaaagcagcacttagaggtcattcaatccaggcacacggactcccacctgtaagcccagcactttggaaggccaggataggaaggccaggagttcaagaccagctcaggcaatatagtgagaccctatctcaacaaaaaattttaaaaaattaggtgggagtggtggcaaatgcctgtagtcctagctatgtcagaggctaaggcaggaagactgcttgagcccaggagttcaaggttgcagtgagctatgattgcgccactgcactgcattctgggtgacagagcaaaactccatctctaaaaaattttttaaaagacatcattcaagtttacatccttccaattcattcccttttcaaatcaggcaacttccctactttcaactcagtagatgctcttagactgatgcaaaaggccattttaaactgaattctcccttctctctgctgtgtttttggtcacgtcattcctggactgacaaataagtgtgatttgtttatgatctccctttagactgctgcctctgtaatgagattaacacaggattctatcttccgctgtcaactaaatattataaaaatatcaaatcagcattccccccagggagccttaaccactagcagggcagaactgagcttaccctgctgcagagaaagcaaacacttggcctgtatatctctgctcttgctttaacagccataccagaaataagggctcgattactaggttcttttctctcaaacctggagatattttcagaatcctcctcaatataacacttccagctgctgccagcagtagcctgacgttggcatcctaatcaatacccattggctatccttgctttagagctggctgaggctaactgtgagattcagtgtagacgtgggtagtcagtgtttgggtatgaaaggcatgggaaactggctatggtatggtttatctgaaattatcctgattgaccttcctctgttgtgtgaatgtaagataatattcccatcgcctgcaggcttcagtttgatgaaaaagttgttcataaaattccgttgaattgaaagactcactttcagaattttctttcgagaaatggaactagcaaatcctcaaatttggaaaacccagtggtatctggacagtaggtagatttcttatcccctgttggcctttcttacctcttattttcctcacagcgagggcttttaatacaacttcactctttcctctccactgtcattttagcaaataatttagagataattcctgtagactctgaaataggttttagtatagatgcacagtctcttgtctgaacctctcagagccaggtatgtttaggaatgcagaactttttggattttagaaggatgatatgctacataaagtgatgtaacttgacatcccaagtgatatctcagataataacctataatcaaacatattaatatttctgcagtagaacatataaacaatagccctaagtgagataaatgaagactataagtatcttcatattcacgtctgtcagttttccaccaactgaattcatgccaaacttaggaaaatcttttccttttcatagcttattacattttataatttggaataaaggatgtggatccatacttgacttggaatgtgggtctatctggcattaaatatcaaatttttgtgggaagatctatctcagggagggcttagaaggtcactccttccccagaggaggcctctttcctgctgctcattttgtgctgaaagtacccctttcaagctggtataaggacctttcacagcagagctcttcttttcactttttaaatgtgtggttcacttctgctccagactgttagagaagggatttgcttttggctacaggacacatggagaagtaaagacagtgagaagtgtcagcaaatgactagcagataatggtttgtactaccctccccggccaaagcacctagcatagtgcctgaaaaaaaaaatcaacacttaggtactacttactattgattggagtgatttataatatcatctcatgtatttctcacagtagcctgtgagttaggtactatttatttatttagacacagtttcactctgtagcccaggctggagtacaatggcatgatcttggctcattgcaacctctacctcccgggttcaagcaattctcatgcctcagcctcccgagtagctgggattacaggcacacgccaccatgtgcagctaatttttgtattattagtagagatggggttttcaccatgttggccaagctggtttcaaactccttacctcaagtgatcctatctcagcctcctaaagtgctgggattacaggtgtgaaccaccacgcccggccgttaggtacaatttgttatccccactttgctgaggaggaaaccaaggcacagagaagtaaagtaacttgcccagtgtcatagagccagtgagtagtgaagctgagattcagtcctaggctggctccagagttcctgctccttacccctatgctctactgcctctcagatgctcaacaagtggtagttgaatgtaacgtgaaatacatcaagtgttccactgattagggtctaaaaacactgtttgctcagggctgaatccttctgtctttctggaattatatacatatattataacaaaaaccaacaatgctgtggtcagcaactaatctcttatggtatactggccttcctcagatcagaaatcggagaagtcattctgtgaggaggaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtaattttttctatgttgcactgtgcctctcagatttgaattctaacctttgggccaaataggtggaattgaactttcctaataagctagacttttctgatttcactgtaagtcctttagaggaggtctgtatctttatttaaattgagagcgtaagagaaaatagaaatattgtccatttgggtagcacactaaggtagtgtaagagtggacgtttgagcttcacactcttacttctaattttctttgtttagcacttcaacccctgagctgcattagtctgcttaaacatactgattgatgaattattattgataaaaatagctaatatttatgaggtatttactatttgccagacatggaatttaatactaaacattatttaattcttacagaaactcaataaataagggctatttttatccccattttatagttgaggaaatggaagcatagaattaaatcagtagcataggtttatatgactagtaattgataaggccagtgtccaaacctaggttatttgactctagggctttccctctgttttcctataacggcttcctgaagttatagttttctgaatatatgtgggctatccagagaagtgtttggttatttgaaaatatgtttaagtgactcatgccggaagcacagcttcctagaacagagcagttggtactaggtaaggagtttgagccccttgaggctctgttagtttcactgtctcattgccagagactcaaaccttctactatgagtcatctaggattttttgacatttataagacagtgtagttgggtaagcagagatccagcacagctcctgaagaacccactcaaattagctgccccttggtcctgtcaccattaaccaagatgacttcacattaggaagggtaaagagaaatgtctcaactcttcaggcctatagtatcctataggaacattttttttccccaagcgtatccttcccagaaggctctgggctggtcttgacttgtgatagttcagctggaggcatccttcatgagtgtgggtctcagaattacagagtattggtgttgaggctcaagctccaatgttagctattggtggacccaggatgtgaactcaggtgccctgaatcctatgccaatgctatttcatctgtacttcacttccttccatacagttttaacttgccaaagtgaaaaaaagctctgtcaggaaaacagtttccaagatccaagatatcagtactcgataattgcattttaagactgtgcacctggtgtgactctcatgatttcattcatcatagtttcaggcagctagtggaattccagtgccagaaggggccttagacatcagttaattctctgcctcatgttatagacaatgaaactgaggcttagatgtattgattgacctgtctgaggatacccactggattagtggcatacccaggtctagaatgcaagtattctatccccccaagaggaagtagaaagaacaccaagtctagagttaaagacctggatttgaatcccaggacttaactgtctgtgtaacattattgaaaaatcttctcagttgtaaaatggggataatagttacatattagcattgttgcaaagactaaattttgagctcttgtcttgtggtgttgggcagttttagttattggagaatgcccctagtttaacataaattgatattttaaatgtactgagtatggtaagaagggataaggctagataacaaataaatcctgctcttaaaaccgaggtgggatatatggcttaatacgttttcagctaagacttcattggcataatgctctcctaacaactgctgggcagattagccttgtgtagcagcaatggtatcgactgtagttcatccaacaggtaagtccagactactcctttgtccacaaagataggaaattcttggagtccactgttagccctacaggaagtgacaattctgtgacatttagtgaatgaactcatgggacaaataaatatattttcccattgttttctaggtgccacctttgacccatttggagcaccttctaaaccatcaggtcaggatttgctgggttcttttctgaacacatccagtgcttccagtgacccctttctccagccaacaagaagtccttcgcccacagtacatggtaaggaaatattttatattgtgttcagtggaacatagttttctgcaagatatcagtaagtgctcatatataaaagcaccctgtgggtgcttttttgataaaagcttcctcacacatctctgtttttgaaattaacaactcaccttaacatatcaaaatctctgggctgtcttacaggacagaaacctgcttaactttgttttgctctgctttcctatttgactatggtatccttttttgcattagagctacatggacagaatcataaatgacccttgattgtaggacatatgattattttatgtaccaataagaaagaaaaaaacactgccactatgaaatgattggaagatacttcttggttagagaaatctttgaaatgtgggaaaatatgtcttaaataaataaaatatgttagtagtccacaaaattggtattccaaagaacaaagtttgggatatgatagccactagttacgtgtggctgttgatgactctacatgtggctagtctgatttgagatacactccaagtataaaatacataccagatttcaaaacttagtacaaaaagggcatgtgaaacatctcatcaatatttttatattgatcatttattaacataatatattgaacatactgggttaaataaactatattattaaaaataatttcaatagtgtctttttactttttaaaatgtgactgctaggaaatataaaattacatatgtggcccaaattatatttctatgttagagacttaggttgtatagaaagagtaataataatcacatccatttataaaagtgtgtcacttaggtaacattgattaaaaccggaggtctgcagtgagggataaataactttgagccagagagttgtagctcattcctgatgtcgaagtctattgaacattattggccacaacctagaaggtgacgtattgttgaaggcatcctgagcttgcttggagaatgcagtccagtcatcagttgactttgggaaaccatgccaatgcaaaaggaagatgacttttgcaacactggtgaaactgaaacttgactaaaaaagattccaggaacaacttttgtggttcatttccaactagtctttaatctcaaactatttgaagtgcatcctcaggacaatatacaagaaattcccctcttacctctgagtcatgctcacttgagagagtctcctgattggatgttgactacctgtaggagaaaagatgcaggaatgtagagtagagttggttttctcactcatttaaaatgttaagtcatgtcattgctctgctcaaaatgcctccccattttactcagcatgaaaaccaaagtccttgaaatggcctgtgtagcctctgtatgctctagcatctcagtgcccgtgacctcatttcccattctttcccactttactctctgcattccagctgtactggcctctttgctgttgcactggctgtttcctctgcctcatactcttccccaggcatctgcatggctaagtccttcacctccttcaagtgtttgctcaaatgtcaccttctcagtggagtctactctgattcctccgtttcaaattgcaactcgtctccctgccctactctacattcccctttctgttgtgcttagtaacttccagtatatgcagtaattaacttatgtgttacatttttttgtcatctctctctctctattagaacatgaattccacaaaggcagggaattttgttttgttcattaatgcatccatagtgcctaaaagaattaccggcacatggtagctgctatctatctttccaatattaaatataaaatgaattaactcatttttcccatcaaagtttctttgatgcacagtgatagtgtcataaggctatatgttttcctgattttaatactttgaaattattgttttaataagagtactaccctttgtgtcccatggacgtgggtgttcatacttggcagcttggcagttttggatccagttttctgtttctgatgagctgattagaacatggtgtttataacccagtttaggccagttagtactcctttgttttgtggttacatttctcattttggtctgtattgtactagcgagtggaaagaattttctcctctccttgttgggaaagcaatgatcatttcactgttactgaatcaactccccgtcttcacataggacagaatataggtgacactcagatgtctgctttgggaggtcagacatcctcagggtacttcccccgggtttctgcaaggcgtcgccaatctctcatgaaaataaaaaaaatactgcctttgggctcaacaaatatttattgaacatctattctgaagagaataatcacttgggacatgatgttggaagaacaaataaataatcataataaaaggcaaaatagagactaaaatattaggtaattacctttttgaaaaaatatattcctgtttctctaacagaccttaagtttcttgaggatagataatgcatctttcagtctctgtcccctgatgtggtgccttgcatgtggtaggtagtcataagggtttgtgggtttgattagcaacagggttgaagttctgatacctacttctgcgtcttaattggatgtaagactaggatcagagcttaaaggaaatcagatagaacgtactagcaaaaccgtctaacttccacctcagtggaatgggttactgtgtaaaaatagaagggataaatagaaaagaaagaattattattgctgataatggcatatcctttttaacttaatgatgggaaggtactagatgacttggttggtactaagtaaacaaaacaaggaaataaaaggtttggaatgctaatcttgatgccttctggtggtgatggggtgtgtgtgtgcgtgtgtgtgtgttttaaatcccagttgcaatgtcagtttagtatttgcattttaataattgatttgtgtgggcaaaacctagaggtgcctcagaaagaaattcttcatcatggcatcctgtttcctatatagattttatagatgtgtaaaaaacttactacgcacatgtattcctctagtacacctgattccttttagccaaatatttcttttaaattatatgtttggaactttgagggggggtcagaatgatttattttgaagctgtaatgagtttattttgagtaccatagacacatccctgacaaccagcatagtgatgatgtatagccagtgcccagtacatgttctgcatgactcattattctcaactcatgtcacagcagaggagaaaacaaaatgtcagttttgagtggattatgcttctatacttaatgcttagcaaaggtaaactgagcttaaggtgttttcccccttttcttattgcacactgactctgtgttaaatttagaggtgggacacacacacataagatagttctttcctgacttcgagggactgacaattgaatggagacagacacatgctcaatgataactcaaagcgtgtggatatggaggtaaaaccaaagtgagacaaagaaggagcagagacaaataatatgtcgtttctgtcaagcctcatgtgaacaaccagaggtgaaggcagaacatattgaatgttgcagagtgtggcaagaactcagaaggaggagtggatatcttgggatcttgctggggccatgcaggcttcagggatggaatggcattatcctgtgtgaactcagaaaagtgggttctgagctctcttgttctcattctttttcttttccccatttgcagcttctagtacgcctgctgtgaacattcagccagatgtttctggaggttgggactggcatgctaaaccaggtaaaagcaggttattttctgtacacatttatataattgcaaaagcataatccttacccaagatgaagtgagtactcacagagtattgtggcctacctgtgtaatttgtgtcactttttcctaaagattcatattctagaagagcttttcccaatgcacttgatgacatgatagtgctacttatcatacaccatttaacttttctaaatttcatttgctgaatgtcttatcttgacaatagaatcagacggatataaatatatatcaaactctatcacttagaaactcttgggtttttttggcaagtctgagcctcagttttcttatctgaacaatggggataataattttggtcccacatagttgtgtaagtttaaataaaaaaaacttatataagaatttctggcacagtgtagatgctgacaaatgtgaatattcttccttctttacaaagtacttacttcagggtgggatttgtctgtcatcaacaaggtctcctcctcatgaccactatggcatttatggagctgtcttgtgtgactgctcctgacattgagcaagttaagtgcacgcgtgcacatacaaacacatacacaatgggcttatcacaacaactttctgaagcagttgctgtttcctttttttattgtagcaaccccttccccacaacgtaacatttaccctgccaataatttccaagtatacaatacagtattatcagctacatgcactttgttgtgcaacagatccccagaacgaacccacctccccactgaccttctcacataactgaaactctacactcactaaataactccctacctctgcctccaccagcccctggccaccacccttctacatgagtttgactactttatatacctcccataagtagaatcatacagcatttgacttttgtggctggcttatttcacttagtataatatcctcaaggttcatctgtgttgtaacatgtgacaggatttccttctgtttttaatttaaaaattttttttggctggggcgtggtggctcacgcttataatcccagcactttgggaggctgatgtgggaggatcccttgaggccaggagttcatgaccagtccgggcaacatggcaaaaccccatctctacaaaaatacaaaagttagccaggtatggtggtgtgtgcctgtagtcccagctacttgggaggctgagatgggagaattacttaggcccaggaggttgaggctgcagtgagccgagatcacaccactgcactccagcctcggtgacagagtgagaaacctgtctcaaaaaaagatttttctttaaattgacagataaaattgtatgtatttgtcgtgtacaatatgatgttttgaagtacacatacactgtgatatggttaaatgtagctaattaacaaatgcatttcctcacatggttatcatttttgtggtgagaacatttaacatccattctctttggatttttcaagaatgtagtagatcatcattaactagagtcactatgctgtacaatggatctcttgacttattcctcctttctagctgtaataatatatcctttaaccaatgcctcctcatccctgccctacctccaaccaccccagcacctggtaaccaccattctactctttatttctatgagaccaacttttttagcttccacatgtgaatgagaacatgcagtatttgtctttctgtgcctggcttatttcacgtaacataatgctctctaggtttatccatgtcatctcaaatgataggaattcttcctttttatggctcaatagtattctattgtgtatatacaccatattttatttatccattcatccattaatggacacttaggttgattccatatcttggctgttgtgaatagtgctgcaataagcatgggagtgcagatatctctttgacatactgacttgatttcctttggatatatacccagtagcaggattgataaatcatatggcagttctatttttaatattttaaggaatctccaaattgtttcccataatggctgtactaatttacattcccaccaactgtgtccttttttctctacatccttgccaacatgttttttgttttttttaatagcaattctgacaggagtgaggtgatatgtcattttggttttgatttgcatttctatgatgattagtgttgttaggatttttttatacatctgttggttttatacgtctgttggttttcttctggtattcatctgtatgttttcttctggtaattccatagttttgggtcttacatttaaatctttaatggattttgagctgatttttttatatggtgagagataagagtctttttaccctgttgccttcttattctgttgattgttaccttccctgaacagcagtttttagcttgacaattgtcccatttgtttttcttttgttgcctgtgatgttggtttcatattatttctcttttttaaaactaatggtaaaatgctgaagctcaaagatgttaagcaagattcccacggtcactcaggaattggcaaagccagaatccagatccagacctaacttcgaatcttataggaaagagtgaagtcaggtgacatgaggacctggaaataaaacaaacactggaaataatagttcacacttgtggcctggaaacagcatttgtcttttctgtggtctgtccttgttcaaggccaccattcacccaggtcagggaaacagggtctagcaacttcttagacattttcaaaccctgtcctaatttgcctaggagacaaataaacagtaactctggaattctgaatttcacaattcagcctcaaacaactaactcattttcaatgaccttatttccttttcaggaggctttggaatgggaagcaagtcagctgccaccagcccaaccggatcctcgcatggtactcccacccatcaaagcaaaccccagactctggatccttttgccgaccttgggacactaggtacaaactcagaagatcaagatacaaataacatttatttatagctataaagcctcaaatctcagtctttggtgttacagcaagctggtattgtcacctggaacctcaaatagtgtgtattcttaagctatcctctgaaacctgagattggctttttaaaaaaggaaagcgataatcagatgtggggttagaaatcatctttattgattcatttctccagtgcctaattctggatgtgtagcatgaataaagttagagctttcaggggctcatggcaacagagtttggctgcgcaaaagtaatgcgtagggaaacagtatgagacagggctggtcagatggatttgtgccacatgatgccaaccttgcagaacactaactgtgatgcggtgatgttacctgtgagatcttcacaccgttccccttctctccattaactgtggtgctctccggtcaatttgtaaaattctatacagaaaatagactcaagtatcgtatttccagaatattttcaccatatgttaatagatgttacaggataagtgttctgagagcaggtgagattgggaagcactggtttcagtggattttgattaccactaagagggacacagtatccagagttctcaaactgatttcaccaaggagcctgttttcaaggaggggttcactggactactatgttctgaaacattttcttcctcctttttccttcctcctctagggcagtgcagatttgttaaataagggtggggtagccctgacacaaaggtttatcttggctatattgatagtctgtgatctcagaaagccctactgaggcatttagagccagatggagggaatgtgagcctggctaccgttgttgtctgtaactagtgtcagcatctttatcttccattctgtactatttagatgtttttcccttttaagaactctcaaaattattttatgcagtcattttcttctccacctttctttgtatcttactgaaaatttcaaattttaaagtaatattatatcagatgaaattttacttcaataaaatctcatttattatttatttttaatgcatttaatgcattgattcatccaacaagtatttaaggcacttttgtgccttctaggtgctaggactgttttagtaaaaaaaataaccaaacaaaacaaaactcctgccttaataaaacttacattatagaaggggaatcaaataataaattaacaaatatataatgtcaaataatgaaaacaataaaaataacagttaatagttattggggccttactatgtgccaggcactacttaaagtgttttacatatatcatttcatttaatcttcctcataatcttttgaagtagtgactgttataatcctcgttttacagatgaggaaacagggacacaacaggttaagtaacatgcacaaatcacaagctttcaacaccaagaagtctagctctggagcttgcactcataaaaggtttagaggttgatgtagctgagtgtgggaaggggtatcagttcagttcatccagtcaatggttttctacccttgagcattaattccctcatttcacaggtatttttgagtacttattatgtggtaggcattcaggatgtaataaagaatcaaagctgatgatattcctgttctttgaaacttgcactacagtgggaggaagaaactttaatcaaatgtaaaatatccgctactgtaggggctacacaagatggagcattttttaaaaagctccccaggtaattctaatgcacaatcaaggttgagaactactgctttgcttttaatgaggactgcagtggtctctggatttagctaccactttgtatttctgtaagttctctgcttcaatagcattaacaattagacttgctgagcatggggagaaaatattctagaagggtagacatcagagagtcctgcaatgttgatgagccccatgagtgcggggtcagcgtctgctttttcaccactgtatctgcagcctggcatctagaggatgctcagtagtgtttcctaaattaatgaataactggcagtgtggtaggcatatggcaaggttttcttagttctttaggcttttctgtatttaccaaattttaaaataaaaaaaacacatatgttcagaacagagtaagcttccttaaatataaaatgaaaccccagtgtagaatgaataccaagttttaggtgtatgttcccgtgctattggcaggagggctctgggacataggaagaaggaattcatgctgctagttatggaatgagtggggcaatgccaagcttgaagacaagccctgtcattacattttcctatcaccaagtgtttattgagccctgaagatgtaccaggcatgtgcttattagcatatgagcttacattattttataatatataacgtctctttgtttgcttaattgtgtaatactttcctatagttgttgtgtctttacagtatacctgtgatatagacatagttttgattaaacagatgaagaaactcaggctcaaaggagtgagttttttttacccagctttagaagagcaaagattctctatatcctgttttcagctatattcttagtgcccagcatagtacatgacacttggtaatgctcatcaaatagtggtgaattagtgtatatatgtatgaatgaatgaagaacgaatgcaagaatgaatgacagagctgagactcaaactcagattgatggtaagtccagtgatcatgatgcatttccagcagggaaggaaagtggagccccaggatcagaatagggaaagtatctatagaaagaagagatagtaagggatgagttgtagtgaaaggcttagcaattaggagaggaattaaggattactgagtgcagtaaatgaacatgacatttggaggtaggatgcacatagtctaatcccagctccattaattggctgtgtgatcatgagtatatcaggaaacctctctgagccttaatttccttatttttaaagtggagccagtgatactacttacttcctaagagtgttgtgtagatctgagcagtaatgtacataaacacattttgttaactctaaagagctatataaatattagttattttattattgttactttagacttattacatgaaagggtctttggacatcagcacatttcagttttctcattttacctctttaaatgcaagccacagctggttttcatattttggacatagcccagcttgtatgcaatgagtgcttaaaagtttggagattatggaatcaagattctacttaaattcctggcacaaaataacatcattttcaaagcttgaataagatcctttgtcctgtttaaagttatcagaatgttgactgtttttgctctccttcagtgaaatgcaagtagtatgaagttaaaacctacttgtgaaatttcaaaacatctttatttactcttgggcactaaccatgctttataacaaaaaatgatgaatcctaataattgaagtttaagtagcaccttaatgagtggactgttttattccccattcttgtcatttggtggttttttttaaattttattctagtgaagaaacagaatctgctcagaagatggaagggtggggaaggatggcacagtgggaagagccagggttcttttgacctggaggcaaagatccagaatcaagtctcggctcagctacttgctgtgtgcctctgagaaaaatcacttaactgctctgacctgcagtttgttcatctgaaggaaaaatgaggccattaaaacatacctagaaatgttattgtggggatgaaggaaataatatgtatgcctgcaattgctttatctatattaggaagattacttatgctgtcagtcaagggaatgactattaaagccactgcaaacagtgtcttaagacacaagagttagaggccactcaaaatagttttaccttctttatctctttttttctttaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttgggtaaggataatggtatgggacctagctatggggcagcctgtctatgttgtcatactgcctgaatgtgtctctctgaaggtgacagtattttctgggtagtttcaattcagtagtttctgagggaatcttatagttgtagagataaaacatgattcctacccccaacgctgtacctggaggctcctaggttgactatgctcctaacttttataccattttgtgaccgtgggctcacttggctgtttatctccagactggaaccagatggagggcagggactgtgtcttagttgccatggtatcattagcacctagcatagtgcttggcatagggtaggcactaaatgaatgttgaagggatatgagtggagaggtagatggatcttaaagctgttattcctttggaagaggaagtggaagaaaaagttggggaatctttcaagcacattggtcatatttgccctttggtcccagttggtggactgcatgtgtcttggaaaacttggtctttcttatgctctgcttggtggattcctgagatcagcggggtacctatgatggtgccaacacctgaggctggaggatactctggataggatcttgacaatgaatgaaaagtaatatttttgcataggaaggatggttagatttgagtttattaaaagcctattttggtacattttatatttcagctgattttgtcagaccctccaatgaagtacataggaacatggtgagggaagaggcctttctctctatggaacatggaaaggcaattcttatgctcttcctaatagctgtagctaacatttattgagtccttactgtatggcaggtgctatcctaagcatttttcatgtacaggcatccccctttatttgtggttttatttgcagtttcagttacctgaggtcaactgcagtctgaaaatattaaatggaaaattccaggaataagcaattcatacatttcaaattgtgcactattatgagtagcgtgatgaaacctcgcactgtcttactccatcctgcctaggatgtgaagcatccctctgtctagcacatctatgttgtattctctacccacccattacttacttagtagccatctcggttatcagatcaaaaaaaagagtactgtatatatagggtctggtactatctgcagttttaggtgtccactgggggtcttggaacataccgcctgtgaataagtggagggactcctgtattatttcttataatcttcaaaaccaaccgcatatcataggaagctgtgacacagatcgatgaagtaatttcctaagtttatacagcttataagcgacagagccaggattcgaaccctggcaatctggctccagaacccctgcccttcattgctaccctctactggctagaacacaggtgctcacaacaccagcatgttaggaattcagttgtcggggatatgtaacatcatgtttgttcttgactagcagggatatttcctggacaattccatagagtcatgccaattcccctccatttttgagtagatagatgtggggcgagtgacttcaatcagcaaatacttatggagcatcttcagtgtagaaaacattgaggatgcagcagggaacaagaaacaaaatccctagtttcagagcacttacatttcagtgtgtgcaaaaacaggtatgtgtatgtcttacagtatagagatagcaaatggttttcaactcaaaaactgattttggttgatttgaatcgactgtatggactgttatgttttggttctattttgttttaacaagcatttagatagccaggcactgttctaagcattttaaatgttaactaattcattttcaaaacaagtccataaggtgagtaatattcctaacaccatccccattttatggatgaggaagttgaggagtagagataataagtaacttgcctagattacatcactaataagtggcagagctggaatgcaaacccagggagttggggtccaaagtctttgttcctagccaccatgctcggctgcctctccaaacaaattgagaaagattaagaggctacaaccagacttggagagaaagagcaaagtgattgactaaaatatcaacagaatatgggcagagaagtggtagcatgcatgaatttcaagtaccaaaccgagatcccagtgccaacactgatatgagttagttataatctggagggataatgagtatcctcatctaaagagaaggtacagtggaaatggaattggatttggcttcatgatccagcctccagttttaaccttgccacatatatgattctggacaggttcattttcttcatctgtagaatggatgcaacagtctcttaccctactcacagggtaagcaagcatgagggttaaggactgaatgcatattaaaaacaccttgaagactccagatgctgtgagataatgatacagcattatgtttaagaatgaaaactgtaatgattttcaaaaattatattgcagaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaaggtgagtgaggcccctgacgcagcttgattatcctatatgacaaagtcatgtgataaagtcatgtgtatggagctatcgccatgagagtaacctattgtcttagcccattcaggctgctataacaaaataccataaactaggtggcttataaacaacaggattttttttttctcatagttaatgaaggctgggaagtccaagatcaaggtgccagccattttggtgtctggtgagggccatcttcctggttcatggatggtggtcttttccctgtgtcctcataggcagaagaaagaggtcttgctcaggcctctttcataaggacactaatcccatttataagaggtctgtctcatgaactaatcacctcccaataggaagccctaacctcctaataccatcacctctggagttagaatttcaacatagcaattttggggggacacatacattcagaccatatcacctataaaaggcatgatagtagatttctggtggccactctatttcatttggtctttgcagctgtgatttgagtacagctgtgccctttaatagcaaagtagctctgaggaggttgcacacactgtttactttctttaataaaataaatgttattccatgatatggcaatatagatttcttttgtttgcctgttcaaatgagcagtggcactttctaagaggtgattttgttattcagatggcattcacattctaaagatgagtcattagaatttgctggtaagaagaatgcattatttatgttttctctttctgctttgagagcttttttattaaaccagattgactgaagcccccaggatcttttctctaccgatagagaaatatttatgtacctgagacttaccaattcctgcaacattagacctggagctttggaaagtagaggagagaaaggctgagggaagtgtggctcctgtcttccccattgtctccctctacttttaaccaaagcagttccacttttctctctttctgattctggaggtttaggtaaaattagatttgaggtttttcctcaaatcaaatcaacatacttttttcctcaaatcaacatactgttttagcatgtttcagcattttgtttttttaagtttgcaattcagcgaatctaacccctttgtttcacagctgaaaaaaaaccacataacttcatagatgaagatgttgtatggacaggcggatgcggattagctgggaaacagagggtggttctgttgatgagtggtatgaggtctggaagagtttgtaaagatcaagagaattggaatgctcttcacagatggagaggttgagttcctatgtgacaaaatactaaatatgctgatactacaacaaactgaaagaggaggatgtaatctgtctctgtattaaagcatctgcaaaaccagtacttaaacagcaagtcaatcttaacacattctgaaaacatataccaccgttctgtataatttcctgacagatttgttgcagatgtatataatatacatctaatataacttagattctttgatacattttttagtacaatgtagggtctttcatttgcatgtttttcactccacccaatgtcacagaagcttaatatttcttccaaaaactttgtgcttcatctcaataaccgttgttcattaggcaaattcggacagtttcctataaaagaaagctgtttatttcatttaaaccatgtttgattatttaattggtacagggtatgtaattgtttgggagggtagctgtcattaatgtgactaaaccattcatccagcaacactcacttagctgaactcctgttaggtactcaatgctgatacagttttatgatccctctgacttaatcacctcatttgttcaaactgtgaatgttcatagttcaaataaatggctaaatgggtcaattcacgtaacaagcctttttgagctctgttctgcaccaggttacttatttggttccgagatacagtgatatataagaaataatacttttcctcaaacagctctgcctaatggcaggcaaagagaaacacacaattacaataaagtgtggtacatattatggtagaaatatgtttaaggtagagtggcccagagaagtttggcccttttttaaggtttacttatttagtgcagtatctaccctcatggagtttatattgagtataactctgggggtggggatgggagagaaaggaattcaaactcgcaaagtctaacagtgtgaaatttctcagcacccttttgaaagatgatagagttaaccagggagacaaggtaggagattgaggaggagaagcattccaggtagaggaaacagcctggatcatacaggttgccctaagtgttttgatgttgctggagcagaaggggtttctagagtcctagtggaaaccttctgaactagtaagtaagcatttgaatttcttaatcccctttgtgtttacagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagtgggtataacctgccctgttgtgtaacttgtcaggtccttgcttcattatcttatgagtatgtgttttactttaaatgtgctggttcatatggcctatttttaataaaattaagtcaatgagctaaaatcagatatttaaacaaatagttatactttatgaaatgagaaagacgatatcaaactatatattacaggggcttatttagagagagtaagatttacccagtgattaatttttagggctcagaagtaaattgtgtctgagtacggtggctcatgcctgtaatcccagcactttggggggggcagggtaggcgaatcgctcgagccctcaagtttgagaccagcctgggcaacatgacaaaaccccgtccctacaaaaaaaataaaaaaattagctggtgtggtggcataagcctgtagtcttagccactcgggaggttgaggtaggaggatcacttgagcctgggtgatcaaggctgcagtgagctgagatcgctccactgtactccagcctgggcaacagagtgagaccctgtctccaaaaaaagaaaagaaaaagtaaattgtgtcctggcttacaatagtaaggacaggctaagagctggacagaagaaaactcctttcctttagagatacagcagtatagttagctaggatggtaatgaaaaagcttcagaatgtagttggtaaaatttgtgagaatcaataaaatattcagaatggaattaaatttgccctctcttgattattactacattgattatgtcagtttatgttttcattgaagtatatatacatctaagggctctaccttgtcagaaacttcaagtaactcatggacaaatgaaatcatcatataatacatagaaacattcagcaagaagtgagtcatcttgctgtcacatagactataccagtcatatgacatgaagctatgatcgaagtgccacttgggaacacaggcttgaatttgatgcatatgattttcatctctccacatttttttgtactagtctgaaaagaagaattaatgagaagcaatggtagtgcttgaattttgatgaatcaaaagagaaggagaaacaagagcccagaaaaatccacaaactgtattccccattatgactctcaaagaactttttagaaatgggaaaatgggagttaaaaacagtcaatagagatgggctgtcatgaacctttgtcatttggcagatacgtctggagaacagagatacgtcttgtgctgcctgataagctctctgttgtctacttcttgatggattactactacccttgtgcatttctagggggaggtcattatggggaggttatagtaatttgggtcagatatagtagattaggctgaaaaggagaaatggccaaatagaaaaacatttccattgcttagagcccatatattggcagtgaaaaatttaatattaatgaaattttggtctgtggtatctaatgtgtgtttttgttttctctacaggctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagtttaacatctgatatgtcttctatccatgtacaatattttaaatggattttgtggagcagggagatggaataggagtttcccccacccattccacacatcagcctggtaatgcagtaactgcaggaatagttcacctccgcctcactaaaacaacaacaacaacaacaaaagacaaaatttgaattccagaaatagttattgcagcaacaagtcagtctccctgctggaaacacctatcagggaagctggctcaagtagcagattttgattattctaaagataaatcatggtttttgggaatagtgatacatgttggtttgagattaaaagactgggtttaaatcctagtttttccatttatagacttttttttttttttaagagagtcttgctctgtcacctaggctgaaatgcagtgggtctgtcacagctctctgcaacccctaactcctgagctcaagtgatcctctctcctcagccctcttgagtagctaggactgcaggtgagagccaccatgcctggttttttttttttttttcagacggggtcttgctgtgttgcccaggatggtcttgaactcctggcctcaagtgatcctccagcctcagcctcccaaagtgctgggattacaggcatgagccactgtgccaagccttacagactcttatattggacaagtttcttgaactgagtcttaattttatcacctgtaaaatagaattctaacaaccctgcaatggaggaattaagaactgtgtatataaactcttaacaagcgggtactcactaaatagtaattattgttattgttactgatagtaaataagacaaagtatatcactgtaggtgggtattggagctggaattacatggaaacctcatattctagggagtgacacaagtaggaaaaggcaacccaaagttacttttaccttggtccttattccttatctccttgggtttacagagatctgtctacataaaatggcaaagaggtttgcattgtagtttctgtaaagggaatagctatgtaaaaagaagtagtgattgagcattaggaaggaaaaccaacatttacggatttcaattagtgttgcatcattcttgcatttaacttatgcactgacttgcaagcctaccccagtgtagatataacatcctggcatttatcttgtgtgcactgccctaggtgttaccatatatatatatatatgttttatatatatttttttctcacttaattcccccaaagattctgagacaggtttttgtaaatcttacctcaggaagctaaagcatggagaaatttacccagagctggagcttgaggctatatatttttttttttctgaggatagggagagatgatactgtgtatggtaaacttattaatatttgttaattcagccaacattttgtgtatactgtatgcaagatgctaatagatatgctggagaaaattaagacagtgaatggatttgatgccctgtgaagcataagaggttactgttatttctaattactacaagaattcttgcttcttggtgcataagatctactgtggggaatagtacaagtgctgaccatctgactttagagctgaacagtttgggacttgatctcagcttccctattcactggttactgggagcttgttttcctatctgtaagatagaggcaataaaacctagcttatcatgcgagactattgaatgcaaggagagaatattaaaattcatcccagtaagtccactgtagtcctaggcagcatgacagaggtcacagatcttacaagtaacatatcaatggcaagttggggataaggatttggtttttagggttttactttctgtttttgatgactcttatttttgagaaaatgtggaaggagtaagtagaagaacagtttttttcagtgcaacatcaggcaaaagaaaagcagatttttttcagatggttaaagcctatggcaaaatagctaactttctctttaaggtgattggtaacctggaaaggacagctggcgtgggcagaaaacttgttcaagacaaacactgtcccagcattttttaaattccagacattaccctggggcaaacacctcaactttttctttcataccaccttccaatatcttactcctgagcctagggtgctcaaaccaaactctgcttctgatgtgttgtcagttttctctaaaatcacttatcttctgtgggactggagtcaggctgatgtggaaggctcccgcaaaccctatttaggctctctggagacagaatgggtggttggaaatggaagggggaatgagggaaatttaaccccatagaatatcttccccatgagagtagcttagcactacacgaagaaagctaaaaaccacagacttccagggcttgtctgatacgcaggttcccttgagtgctctaataggtattagaaataatatgatagggaaacaagctcttgtaggggaggaagaatctttttctctacctatcttaggttctccggctgggtccttgtgcattagactggccaaagacagatgaacaaaagtaaagcaagtttatcaacacgtgcgttgttcatataggtaacatgggaatactcagagataagcaactcaaagatttggttagaacttgggtttatacagcatattagccaaggaacaataaatttttaaagaaatgacaagataaaggatcttgagtctctaggggcagcaaattgtcggaaaacaaatatatgggagactagttgcagatgaaggccaaatactaaggtttatcatgtagatttttcttgtgttgtctccaggctgacaggggtctaaaattgtctctggtgattaatctttgtctttcctggtagagcaggaaggaggtacaccttcgtaaacttatatcctgctttttggcaaatagagggagggcagagtgcttttctagtaccgtgtacctatttgcttcttcctaattgccttcagctcaaaataatccttaaaccaaagtggcatacactgccaatgctcttgagtagattgaaggctccaaagtaaaaagtgctgtactgtagtattggatctccaagcatcagcagtgagtcaggtattacaatgctgttttcagtgagtgtgccatccgtctatgaggagaaatgagaggagctagaaaaataaactgacagctagaaaaatactccactgaatcaacaaatagacatttcttgaaacagtaacatgctcaatgtgcaattttgaaaaagtaaactgagcaaggatcatgaaacatgatggtggtgagaatttatacttctcaggtagccaggggaagctaggtttccacagattcctttgtctttcagtccttttgaaaacggagaaaaagcaagagaagagggacggcaccatcaggtagagtggatctcagctagaatgaggggaagtggcccagaatccaacctcctccaaagagctgtgtgacaggcaagtcctatcctttctgcacctctttccttaaatgtaagttgaagcatttggaccagactgtttcaatgatcttctagattgcttttgccaaaacagaactctccattcctgtaagataagtacacaatggctctcagagatctaaaaactggccttggttacctgcaaactttgaggccccaaggcacaaaaataatagctttttttttttatttttttttttaaggttcatgaaagcttcggacacaaaagcttatatggtcttcgtctctataaataaaccagggagtaaagaaaaaccccgctagtttcagtaaagcgttgctattaagcaaagcaaacctatgcaaatatcaagttcttaatgaggagtgtttcctaaggggcctgtcctctggtaccccgcctctcctctgccacagtcatgtgaaggcagacaggcacacactcgcacactagcacgcacttgggagctcagggaacataacactggttagtgagtcggtgtccctctcccatcgattgcaacttttcccctccttccctctcctgcctctccccactttctacatctccgttctcaggaaggctcagggaggatcccccgctgcgtgcactgcgttctgagaggccggggagagactctgggcccgcggtcggggcggagccaaggtcccaacccacattgaacgggcttgaggattacttggagggctcaggatctaggaggagggcccagggcactgggttggggttactctgggaaagctctgtgggaccaggtgggaccttagggctggagatggactctgcgagctgggggcggagttctagactggcaggagcggagttctgggtggcgggggcggggtcgggaccagcagggacggcctctgagagttgggggcggaattctgggccggtgagggctggggcgggaccagcaggggaggcctccgcgagctaggggaggagctctgcattgtctggggcggggcttcgagtagcggtagcgaggtctggagccgcaggcgctgcctccgcgaggtaggggaggagctctgtactgtcaggggcggggctctgagtagcgaggccgggtctgaactatcaggcgcggcctctgcgagctgggggcggggttctgcaccggcgggggcggggttgtgagtggtgggggcggggtctggagcagcaggcgccgcgtttgcgagctaaggtcggagttctgcaccggcgggggcggggctctgcgtggccggggcgggctcgggatccgcggggcgactcccggtctggcttgggcaggctgcccgggccgtggcaggaagccggaagcagccgcggccccagttcgggagacatggcgggcgttaaaggtacatcgcggtccccggctcgcttgtcgtgtggtggggttgccacctccgttccggtcaagcctggggctgcgccttccgcgcgccgttggggaacggcctcaccacccttcccgcctctccggttcgggaggcgatcgaccgctcccttcgtcccttggggtgtgggtggagcggcgtttcgggggagccttggccctttttgcaaggccgctggccttcctgctctccagtggcggcaccagacccctccccagcctgagccctcggcgagagcggcgccctccacctctcctgagtttttaaacaaggtttccacttcttgacgccaccctaacgcctttcttctggttttctgcccctccgcagtttcctatttgccacaaaggaccctttgtctccagcgttcttagcattgggaaacttaatcctctttttcctaatgatttttccaactgggcagagttgaccgcgggcgggtgtcaatggaaagcacccagaaagacggtgtttctcgcagtcgtggagagtagattacgtgtaattttaatactgctttcttcggtgttttctctgtttatggacagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttggtaggaaaacattccatttctaatctgtcgaatagagtagcatgacttgtttttatattggcttttatatcatccttgaaatttgcacccaaagatatccccagttaacatctgctataaacatgtagatagtatatatacgagtacgcctctgttcactatgaatttatccgagtatgtgagctgttagcagcagacattttatcgttatttctggctgacttttatacttaatatcagtttagtaaacatggtttacttggagagtgtcgactgtgttatatatccatttgaagccaatgccgaaaacagatgaaaagtagtgtctcagtactacacatgatcagaaactaccaaatcatgatcacgtttatgtgtgaatgtgttagaaaattgtgatgtagtgaaaaaaaaggaagtctgaaatggaaacggactaagggaaggaagcattttacagattgttcaacttttattgaggaactactgtatgccagagacttaggatacaaagataaatgagaagttattggtgggtgacagagctggaaataattatattactatgtcagtgtttatgttgggctcagatgcggtgggagaacagatggtgggttggattttgtcctccaaaaagatgtgttcaagctctaattccctggtacctgtgaatgtgatcttatttggaagtagtatctttgcagatataatcaaattaaaatgataactggtttaaggtgggccctaatccaatgactggtgtccttataagaagaggggaatttagacatagagacatacagggagaataccatgggaagacggagacagaaattggagtgatgcagctacaaagtcaggagcaccaaagattgttggcaaccatgctggcaaccactgagtgttaggaagaggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagaccaaaaagaatcaaacagaaagatggttgtgaacgttgagaaactggtatcagaacagaaggaagaggtctgcagtacctagctttgacaggcctcatggaggagggggtactgccgatggtcaggcacagaggagaggagcaaagcctgctgggaaaagatcatctgaatgaaatagtatgtggtatttgctttccatccacacatgggcattttccattaaagagtggaaatgtaaaaagatatgttaaaattgacagtgtttctttgtcccttaacatgtgtatactttcagatgttttttaaaaagcactttggcaccttcctattaaagagtctctctaaatcttctctcaagtaaaaggaagcaatcaaaaatgttcattggcttaattaattagtttaatactaattatgagtattatggacttttttcagaagaaaatttggataagatagtctcctatgcttttgatttctacctttatcaaagaacattgctaaaatgagtagatacctgagtcagtcagcatttatttggctacctccttttgccaagcactttacatagattatctcatttaattcccataagctcaataaggtggcaccattatttccattttacaggtgagaaatcaggttcagaggattagcttctacccaaagtcataagaccagatggtggcagagttaagatttgactcatgtttgtgactcagagctcaagattttgtaacaaccttgatactctgtttctcactcagcagcacaacaagggcaaatacgttcctactcccgcagagactagtgtccaatagatacagggaatacatattttattcagtgcacactagttgggaattgtttcctacaaagacatgaaaacaatcttcaaatacttgcagtactgtggtttggggaggcaaaatgatcaaaggtatatattacagggaggcagttctggatataatttaaagaaggagggctttcaacatttagaagctgttggaattaaatgacttgccttgggaggtagtgagttttccttcactggagttatgtggaccaactggctgccctctggtgacaaatacagagggaattcatccattggataggggttaggtactggaattacttgagacctttgtatactttatgatttcaaggtggcagacatgggtcattgtcttaatcagtttgggctactataagaaatatattttagactgggtggcttaaacaacaaacatttagtttccacagttctgaagactgggaagtccaaaattgtggtgcagtcagatctggtgtctggtgagagccagcttcctggtttgcaggcctgctttctgctctcacattggagaacagagggagagaaacacagagagagtgtgtgctctactttctctcttcttataagggcactcatcccatcgtggagaccccaccctcatgacctcatctgaacctaattatctcccaaaggtccacctcctgatagcatctcacggtgagagggatggagccgggaaggtttcaacatgtgaatttgaaagggacacacataatgcagtctgtaacgggtcaaatgtaacctcaataaaatgagtaaattgctacatttgcttgaatttgggacctttttttctttcttttttattttagtaaatgtttttattgataaatgattcacataccataaaattaacattcttaaagtgtaagatttcatggtttttagtatattcagaaggttatgcagccatcactactatctaattccagaaaatttactcatccgccaaagaaactctggacctattagaagtcactccccatttccccaaaccctctagtgcctgacaacctctactgtgggaactttaacttttggctttatttttcacagctctcgtggcattatccttcagtggggctattggactgacttttcttatgctgggatgtgccttagaggattatgggtaagttatcatttcaaaaagaactattcctctttctgtgtctttgtcactattagtatgggtgttagagagttcggtcaatttagcaccaagttctaaccagtgagttagtggagcccagtttatgaacacagtccctttgtgggtcaggtgtacttttgcagagggctctgttaaaaattgatgtattcattccataagcatttgtttaacacctactctggactagctggggacacacaaatgaagagagagtcctgtcctcaaagaggaggtaaagttctagttgtgagtgagagacaggcaaacggtctagtcagtaatctggcagctgcagtggagatgccagcacagtacgctggagctcggataaagtgcacctgagtttcagtgggacagtcagggaaggctgcatggcagaggttgtatctgagccaagactaggtggatgaataagagtttttcagggtgatgagtcaggggaggacattccaggcagagggaacattctacacattttttcattcaaccattgttggttgaatgcttcccatgtgccagctactgttatgggaactagggattaagacataagaaaacaaaggtcctgctctctcagagtttgtgtttcagtgggggagacggacagtaaacaacaaaagtatgcatactgtcagaggtagaaatggtacaaaagatgaagagcacagaagctgggaagacagtggtcagggagggcctctcagaggaggtaaaaagtgagaagaaatgtcaagaaaatcagcaagcaggccatacagatctctagggaaaaagcactttaggcaccaggaaagctgaatgctaaggcccggagacatgaaagtgtatatagccttttcaggaaaccacacatggtacattatggtacagcataaattgtagtggagtggcaaaagaagggttagtcaagagtgtaaaagtcagcacttagggctctatatgcctgccgtgtagaggaggttccattttatacatcagacaatagaacctgggaaaatatcttgagaatgggtttggaggagggggttatgttaaaatgtcattcttgccataacgtgagactagataggaaagagctgagactgcagtcagggagaatagtaggggactactatcataaatcaagcaaaattgagggctggggcagtaggaatggaaagaaaaggagagtgagttaggaaaccaaaccaaccaacaggttttgttcatcgatgtcaggattcaacaaggagggagagttcttagatgtctcccaggtgattggcttgaacaactagatagaagatgatgtgattaggccaggcaccatggctcacgcctgtaatcccagcactttgggaggctgaggcgggcagatcacgaggtcaagagatcgagaccatcctaggcaacatggtgaaaccccatctctactaaaaatacaaaaaattagctgggcgtggtggcacacgcctgtattcccagctacttaggaggctgaggcaggagaattgcttgaacacaggaggtggaggttgtagtgagccaagatcgtgccactgcactctagcctggcgacagagcaagactttgtctccaaaaaaaaaaaaaagatgatgatgatgtggttaagacctattgaagtgagttattatgacagtgatgaattcaaatccatcaccgcagtcctggccaactattacagaaattgtttaaacccaagagggatccagatataagcggtcacttatatttgtttagagccttcacagcaattactttattctagcttttggaatgtaatacggtattattatcctcatttctcgctgggaaaccaaagcccagggtagttaaagacttacccagattgaacagcagtaagtgacagagcccggccgtggtggctcatgcctataatcccagcactttgggaggcaacggtaggaggattgcttgaagccaggagtttgagaccagtctgggcaacaaagtgagaccccattctacaaaaaactaaaataagccaggcatggtgcctgtagcagggttgggaggctgaggtgggaagattggttgagcccaggggttggaggctgcagtgagctgtgatcacaccactgcagtccagcctgggcgacagagtgagactttgtctcttaaataaaaaagtagaaaaaaaattaaaatggcagacatggaaatggagctcatgttctgacgcccttgaccaaacgtttttccactattccacaaccaactgtaaatctaggagttttaattctctgtgatacactgtctttgtaaggtaagaaaatgactcattactgctactacaaataagtttgttttctatctttattttaattttttgttttttagagatgccacaacacccagctgattttttttagaagtttttgtagagaccgagtctctctgtgttgctcaggctggtcttgaactcctggcctcaagtcatcctcctgccttggcctcccaaagctgtatcttgatagtgaaccaggattatcatctatattggaagtcagcaaactgccacatataacctgctacctgtttttgtaataaaggttttattgaaatacagccatgctcatttgtttatgaattatctttggctgcttttgcattgctctgccaattatctttggcagagttgagtagttgagatagtctttatggcttgcagatcctcgttatttactctttggccctttatagaaaaagttggcccacccctggcctatgtatttattgaattgtatatatttaatatttacattttatatataaacaaggtttcttgtacattaatatttctcttagttggatatcggtggcttactatgaatgaaaacatagagtcagattgtttttcacaaaactgtcactgtattccaggaaaaattaagagttcttggctgtggatatgtaaggtgacatatctattccaaaccccttcccctctctgtgtctcctttctcactgttgaaagaagggctttgaagtagagaatgtctaagggctacttcccacaatattgtttggtgattcttgaaacatactatcatccctctagtttaaaatcaggggtccaaatccactgtttccatcctgagtcctcttgaaggacacattcccttcttgccttttggttgcctagatctgtggctggaatgggaggctttcattagtgtggcttcatcccaactcctgcttgtaggtgctgtctgggcgtatctgtgtgattacagtattgtggtgatatgaattattgtagtgtatatataaaaatgagcagagactttttttttcttaagaaatgaagcataagaaatgtctgatggagaaaaaaagattatttttgaagtactgatagagaaaatactgttggaaaccagatggcaattttttttttataattgcaaaatgttgaaatttgggaggaaaacagttttgttttgtttttgcattacactattaattgtgagctcttataatgaagatcaaagtacatctaagcttttcactagtgagcatatttattttcatgccttccgtacttaaaatttatttattattttattcatttaacaagtataaatggagtacatcattctaggccctggagataaatggcgtttgatcaagactaatctatcagatgggaataagtgttgtgcagaaagttcaaagagggtggtatgttcgagggtgacctggggtacattagaatagatgaccagggaaagttctgcttttagaaaggaatctgtcagtttagatcacatggtatgaaggagtcagccaatgagaagatcatggggaaggacattgcaagcagggggcacagctagcgcaaaggccccaggataacagctatgagctcaagagtgttcaagggacagaaaaaaggctggtgtggctacagattaagcaaatgaagggaaaagagtacaaaatgaatggaagaagtagataataccagaccataaaggctttgtaggctagggcaaggaatttagggtttattctaagctcttaaaaggtttcaagcatgcgtgcactcaaaagatctttaccgaactagcttttgcaagacactctactatgttctatagggaaggcagaaatgaccaagttaaaattctgtctttaaagaaattgtggctcagtggtacagaaaacagtaaagtttctagggtatatattatatagtggcttcttaacacaatataagctacctacatagtaattttaaaattatcactacttatctatccctggtagaaatcatcttatgttctaatattcacaattaattaattttttgacctaaacatttaaaatagcaatgattttgaaatagtagtatgtctttcatttaaaatgtaactgttacttttctttttggattttgcctgggtccaactgacagcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtggtaagttttattttctattgttttgcccaaccgttgctgagtttacttcagaggcctgtgtctgggacctccatttcatgctcattacttaggctttatactcaaggccgtgtgtttttagtttctctgttcctctactttagacctgcctaacagtagttcggccatgccttcagagtgctttctttatttctcttacaacttttagccagacgatatgatttcttactttttctactttaagctattctctggaattgttcttaaattcctgcctcttaaatcttacagtaatccacagatactatgctagcagtacttttctagttgcaagatgaagatatttcaaattcttctcctgcaaatgggatcatggactcaactctcaactcagtataataggtatatgttgagggacaactgtgtagcttccagaaaatgcagtgaataagttgacatcttcacttccaagacaaaaactttctttttgtcttcagagtacacattgtaggtataatttattcaattatttgctattcactgtctttcctactatttgattttattccctccaattacgttctattttaattttatgaaactcttatttgaggcattgaatatcagataagcgcaagtcttgttcattcaataaatatctttgcaacaactgctacttgtaaaacaccagaaataagaaataggtactgtctctgctcctgaggaacacagaaactagcttgctgggtaagtatactataagtgtactaagtgagacggttgaagcatgatcagaatgccataggggcaccaagaagagagaaattccgactggcatttgatatgggcctctaaggataaatagcatttgtattgaggtaggatggctgttgtatggaatgacattcaagtgtaagaatgcagtatatagaataaagaagaatccagtgtggtagagctaaaagaaagttgttgaggttaaggctggaagggttgtgaaacctgattagcaatggtcttgaaccccatgccagtttgatctttgtctagataatggggaaagattgaaggtttttgaatacaacaagattgtcatgactttatttttcttgtgctttagaccagcccttcttaagcgctgcagtaaatatttatattttttcctttcaatactgccatcatattttgtgaagaaactttcattgatgtttctcttgcttaaagtaaaacaaaaaatgcccactagagggtactctcacccccaaatgtgcttctgtaaaaccatctacaaaccatctactaagctggaaagcagttttcagttgtatgaagactattatttaaagtcttttcttgcctagaaaagaaacacacaaatttataactctacaatttttattttccatgaaagaagttgatgtgtgcagaactttcagtacccaatattgtaattgcactatttataatcttaccacttgagttttacttaaggcaatcattgtcaattaaaaacaagtagagaaatatgtctaattgggaacatgttaaggatgataccagacttaattaacaagcatcacagaagtaattagactcattactgaacagttcattgtctcctgttacattattaagccttttagcagctttgtgtaacatttcattggatgtttctaatgcagaaaataatagggattgcaaagagtacaatatgaaggaagtaaggatttaatccttcttttcttgtctttcagatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaacaaaggcttttatgtacattattaaatgaaaaagtttatattttactttgcggtacgttacatttggaaaggagatcagcaagttaattttcccagtgtttttgtctgtataatcttaatgtgaatctgaccagtttgaagcctgtacttgctgtagttgaagagaaacagttcaggaatgttgtgctgactggaaggaatccaggccttaatttctgtggctgacactccccatggtggacatggaagattggaaaagctgtattggaaaagaaaaaaacctgacaccttaagaaaagtgctctacatattttgaagagtctttttgcacactacagaaaagaatgcactaatagaaagtagtctttaaggaataatatgtcctccttatgcacaaaacatttgggaaagatctgatgttttactagtggatttaggcagccagattgtaaagaaatcaagctagttatttctttgcattgccaagctaagtgtaaagttaaacttttaatagaaatagaaataaaaatttgataataccaacataactataaaatggccataagaaaagtcagttcccaaggaaaattaatagatgaccattttgaaacatttatttgtggtcaatacgaggcacataggcaaagtggtcttaatcctgagattgctcatttggagaagagcacacttggagactgcacaatctctcttcacttttgattatatctttatcaaaattgaataattctaagtgtttacacacttcggaatgaatgactagatattaacttaagtgtgtgcattcatttttcccctcagaataattaaataataaaaccatcagttcaactttagctggataatcattgcacttatcaatttaaagcataaatgcctctgcctcaacactttcatttcctctgtggttgagagacaaattatatcaccacactctgtaaagtttcatgatttcttacagccttctcctcaaaattgtatgcttgttcatctgacaaacccagaattctccagtacttccaaccatccctgctgcagccttgccatttgtggttccttgacagtgctgctgttaaaatccacttaaccactgatggaaatgagttacgtgagttctgaacacaggttttaatcggattcctgattaaattaatggcagtgagtcttaggcttgatttattcaagattccatggtgtggaactgacagttgctcagctctttaataaaatcatgtatatatgtatatattttgagatggtatctcagtatgttgcccaggctccctgggctcaagctatcctcctgcctcaacctcgtaagtagctagtacttctgctggaaacatgcaaatgtccattaactgatgaatggataatgtgatatatccattcaatggaatgtttttcagacataaaaaggaatgaagtactgaaacattgctacagtgtggatgaatcttgaagacaatatgtgaagtgaaaagagccagtcacaaaaggccataaaaggtcacaaaaggctgaggcaggagaatcctgaacccgaaaggcggaggttgcagtgagccgagatcgcgccactgcactctagcctaggcgacagagggagaccccgtctccaaaaaaagtttatatttcagtgtaagtagaaaaaaactaggtaaataaagtatatgatacggtaggcgctactggaaaaaatatagtggggaaggaggataagtagtatttgggtcattgtggttttagatagggtggccatgaaagcctcacccaaaagaggcaaagaaaagagccatgtggattttagggtctccttctgttgcccaggctagagtgcagtggcaagatatggctcactgcaaaccttaacctgagcgcaagggttcctcccacttctacctcctgagtagctgggattacaggcacgggccaccgcagctggctaagttatttattttttgtagagatgaagtttccctacattgaccaggctgctctccaaccctggcctcaagcaatcttcttgcctgtctcagcctcccaaaatgctgggattactggtatgggccatggctcctagccgcctttttttttttttttttttttcaaaaaatattccaactgaggtttggcatttattgcttgagaaataaataatataaataaaatagcttgatttaggaaatgaagttgtgctagctggaacactggccaggttatggccacgataaagaagagaccagccgggcacggtggctcacgcctgtaatcccagcactttgggaggccgaggtgggcagattacgaggtcaagagatcaagaccatcctgaccaacatggtgaaaccccgtctctactaaaaatacaacagttagcagggcgtggtggctcacgcgtgtagtcccagctactcaggaggatgaggcaggagaactgcttgaacctggtaggcggaggttgcagtgagccaagattgcaccactgcactccaacctggcgacagagcgagactctgtctcaaaaaaaaaaaaaaaaaaaaaaaagacagttgagctagagagtaaataaagtggcccctaatacagtgggtatagattcatgaagtggcagtagctgaactgtagctactgttaactttgaggactaattaagacaatgtcaggaaaattttctttttcttttttctttttttctactctgtgtttcttcattatctgaatttatcctcatgcaggttggaaactgctgaaagcagtccatttttatgagctcttttattctaagccaaatcagtcagattacaaaccccattgtattttagataacccaagtgattattcaggtgctcaaaagcttttagagaactgctaaacctcatgtacttctgggcagtatcagcaattaaaagagtttaattttctaggtgaaactgattctggtttggatttctttatttggactgagagatattttaaccaggttaaaatattggtgcaaagccatctctgatgagacttaaaatcataaagctacttccccatgcagttcttgtcaccatttcagggtactgctgggcaataggacatgagttcccattgcttgtgggatcttcagatgtatatccctccagtgaattggactcagtattgttgagacatcaattttccgcaacatgatttatagattgaaagcaatcacagtaaaaatcccggtaagatttttaggagaaattaatatattccctgatttctaacttattacaaagttatacattagacaatgcgatattggagaaaggacacccatataaatcaattgaatagaatcaataattcagaaatagacccaaaaatatatggtcaaatgatttttgatgttaaggaaaaaataaaaacattttaagctgaggagatacaggacaaattatttgccctcatggagcttaccttcaaatgggcaagacaaataatttttaaagtaaaaaataattcaatagtgaaatttgggctgggtgcaatggctcatgcctgtaatcccagcactttggaaggctgaggcaggtggatcatctgaggtcaggagttcaagaccagcctggccaacctggtgaaaccctgtctctactaaaaatacaaaaaattagctgggtgtggtggcagatgcctgtaatcccagctactcaggaggctgaggcaggagaatcacttgaacccaggaatcacttgaaggcagaggttgcagtgagccgagatcatgccattgcactccagcctgggcaacaagagtgaaactccatctcaaaaaaaaaaaaaaaaaaaagctgggcgcagtggcgtgtgcctgtaatcccagctcctagctactcaggaggctgaggcaggagactaacttgaacccggaggcggaggttgcagtgagccaagatcgcaccactgcactccagcctgggcgaggaagagagattctgtctcaaaaaaaaaaaaaaaaaaaaaaaagaaaaagaaaattgacagtagtgaatgctatgaagaaataaatcaggataaaggcatagagaatgacttacagtggtgctatttaaatagggtggatagagacgattggtggctgaatagagctattgaataatgagaaggaatcaacacgatgggacctatttttaggtctactctttcgattctttttaattttaggtctactctttcacttattctttcaagaaatatttgttgagcacctattatgtgctcaacataattatattattctaggtgctggagatagaacagtaaataaaacagacaaaacccccagcccccatggtgcttactttttttttttttggtagggaagcaaaaaataaacttcacaaataagtcaaatggatggtatgttagtggaaatgctaaggcaaaaaaaggaagaaagggatgtagaatatgtgtgagtgtgcgtgtgggcgtgaacgggtgacggtggcttctgtttaagatacagtgcccaagaaaggcttacctagaagatgacgtttgaaggaagtagaggcagttatggaggcggcaatgggcaagatggttcaaaaagagggataagcaagtgcagcggccctgagctggagcgtacctgtgagctggcatgaagccttcagggagagtggagggagataagataatgtgtgtgtaggggtggatggatcctatggggcccagcaggtcattgtaaggcgtcggcattcatttagagatgagacgccactagagatatgagcaggagtggcctgattatgttttattcggattgctctagctgtgttttaattaaaactattttataaagagaggaaaaaacaattttgcttttccaaatcaatcatgtttatgtctttgaaagaggagaacaacaaatcacagaaaacataaataaatgcattttgttcagggacagatggctgaagcaacgagagtgaatcacagagtcacagaatcacagttatgtgcaaagcactcaggaaatagcttggtccctaattaatcattccatgttgttaaactctgtggagataaatttagccagcagtaggtagaatgagatgaattctcatgaaaacatgttttcaatgaagttggcaaagaatgctgtgtaaaccccaaatagctgaaactatgtcctaatagcattgagcttggtgtgccacatccttagcaataaccacttgagtgtctgtccctggggcctgcagatgaggatgttaacatctgatttagcagaaggggtggggagagtgatgggggacaagggagagagtcctgaaacatacaggtggtgaccctaggagctgactttggtgccatttaggcatatttgctttcaggactcacacttccttaggtttaagctatcaataaaaggaaagtggtttctaagtcctagcctttggactgtattcctttaattcatatagtggagcagggggaaagttatcattttaatggctggtagcacaattccgagaagaaaacttttttgtttatttaatcttagataagccatttgagtgttaagagctatggcccacgacagggaagggatttgaaatgttttagataataaagtgaggagaatttgggatttgcatcagaatgacgaaggggaagtgggggaggggtgatacactaacaccagtggagaagaaatccagggaaaaggtgacagaaatcctggccactgaagggctggagcctgaggctaaaacagtgccagggagaccctctggggtgacagcctaagaatttttgataacaaggatattggcagagcagtggtgaaaccctctccccttttcccattgcttctccctcctttgccccagattcccactcaaagcctgtgatacatactgttgttcactgtggtgttcaggtatactgaggggtaggagagtgaagaaaaggagaatggtttgcaagtggggttaatgtgggctgagagagaagaggacagcaaagaggcgtgagacacagggtaaagaaagcattcagagtaaaatggaccaagaggtgagtaggagaataagttaccccaaatgcctcagaaatatttgttgggaggactctgctatatgagacttaagccctttttaaaaaaataaaataaaatgaaaaggtgattcccaaaaggttggtgccttatgaggcttcatctgcataggatccctggtttcacaactccttatcttgaccagactttctattgattccaggtctttagacaataacttaattctttcaaccaactgtcaatcagaaaatctttgaatccacctatgacctatgacccctcccctactccaccccactgatttgagtttgtcctgccttttccaactaaactagtatatatcccacatgtattgattaatatcttttgtctccctaaatgtataaaaaccaagctataacccaaccaccttgggcacatgttctcaggatctcttgagactgtaccttgggccttggtcatttatatttgactcagaataaacctctttaaatattttacagagtctgactcttttcatcaacagctggaatatttgtttcttgatctaatgatgattacacagcagttttaagtttgtgcaagtttatttggttttatacttacaatatatacactcaataaaatatgatatacctcaataaaaataaagcaatgccttccctgcctccaaaaacaaaaccaacctgggaatacaaagatcaaataacagtgcctgcagaagcttagaaaatcggcacagatgtgacatttgactcagttcagcacacattatggagggttactatacaagggagactgcacacagagaccatactcaggagcctgaggatcctgaatcactgacctagagggaagaagtaccagcccctatcttgaggacctcatattacaaggcagtaatagacatgcaaaaattaatagcaacagtctgattctggcaattggctgatatgccaactcttaccacttttcaacattgtgctagatatgtaagtggcagaaagactgaaaaggaataaacagattattatttgcattctatgctcttatttacttagaaaatccaggagaatctatacactattagaaaaaaattacacttataaaacttactagataaaagatcagtatcaaaaaaatcaattgctttcctaaacaccagtactaactaattagaaaatgcactgggcacagtggcttaagccaataatcccagcattttgggaggctgaggtgggaggatcacttgagcccaggagttcgagacctgcctgagcaacatagcaagaccctgtctctgaaaatgcaattttccaaattttcaataggaacaattacataaatgattataatatatatatataattttatatatacacatctatatctgatgttataaagatgtgcaatacttggagaaaaatttcaaaaattttttgctgggtatataagctctaaatatataaaaagatatactatatttaaatactaagggataaagtattaagcattcaatgaatactggaaaaatgattggatgagttcatattggacagagccacatctcggtcttcttttggaatcctttcttcatatagtacctagaatagtgcctgacactgtgggaaaccaaaatatgtcacctcaaaatatacttctttggcgtattttcagttggttattcagagaagtagcagacaggaatagttctgaaaagctgttcttttgggggtagatttgcatctgtagaggaaatctgcattggtgaggtaaagaacagacacagaggctttctctgaggtccacctatctggatcaggaaaaaggaactcaataagaaaaggagactaaagacctgatactttttttttttttttttttttatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgttaagacctgatacttttaaagtttggacagtgaaacttttgctgcatctcttccttctgagggctgctcccagagagacttcatctgcatcacaagacagcctttgctcaccatgcctttcctccccacaccctctcataatgtgttgctacctccctgcaggagcctttaggaccctatttctttctgtagcttaaaatgctattgaagcttcaactatctggcccttctttgattcttcgagtctcgtagtttgtgtggctcctgtgcacatgtgcatgtgataaatgtgtatactttgtctcccatgaatctggctattgtcagtttcttttatagactcagattaacaaactttcagaagggtggaggcgggcggggggtggggtggggagggaaatccctttgctcctacagcaaagtagtagggactcaaaaaatatcgaagagaagaaaacaaaggagaggaaaggaggaagggatgaataactttatttaaatgagaaaagtggcactgagttaaaaattattaaatattttgaattctttatgttattacaatttttacttttgctaacatcctcttgctttattgttgtaataatgtgtgctcatatagtcattaagagtttacaaaactgtgtcaattaggtccatataacaatgaaaaagcagcagcatcactggaaaatctcgaggctcttcaaggttaaggggcttgccttagatgacaaataacctgactgttactcagacccaagttttttgacttcaagggcagcgactttgtactctacagatgccaatctaaatgggctgcaagctagatgtgtaggctatggattgccatcctaattgggacacttttgagagcagaagtaggtgttatccattatgttgggacaataggtgtaaattggtaccatcttgggtacatccaaggtacagtttaccttatctatggctgaaaactgagtttaaattaattcttcttacgggcagcacaagtcaaaaagccctttgccaagctgcacagattgtaaatgctgctcctggctgtgttcaatgtatatttggacaaagtcaataataaataaataaaggtcaactatgaattaaggtaggtttgttagtttgttttttggtaaaaggaatgtcacttgcttagagaggttaatatactgcatgtggggcaaagttgctggtaagtatcattcttccttctgtccttcgaaccccaaatgacacatcttgttcacgtatccactatggtgtaagacatcactgggtgctggctgtaattttatcttccttcttaaagtctttataacgtgaagataatgagtggatctgtgcgaaactcactaccaggatcagccaatacttgtttttctgtggagcttttggtgattactttaactgaatagagttttttttttttaaacagcaaatctttcaatgtattagcaattttaagtaagaatctctaacttgtaacacacactgaacttagagttttgttttttttctacacatgccatttctgcaagtgaacttaagaaatttcaactaatatagaagacttaatcaattctcaattacatgttgtaaattaacctgctaacaggaacaggtgaaactctcttaacattttaaggacataaagtaatcaaatatgcagatttaacacaaaaccattaatattatggggttcttttcaatatttctatgcttaattttaaatcttttttaggataaaattgttttccaactaagaaaagtattgtcatcctattttgtgagataccactaagtcaaatgagattgcgtaatgaccagagatattattagttgaggtgctgactgtatttttatctgatataccaatgagtcttttcacttgggtaaatatgtaggagctggatttctgagttgaatggtaagtctgtttttaactttgtactaaactgggattttgttttccaaagtggctgtacaattttgcattccaaccaacaatgtatgagagtcctagttctgcatgctcatcagtaaatagaattgtcagttgttaaattttagccattctaatagttcctacccttttttagaccatatagggtaatgacattgccatggcatctgtaaactgtcatggcgctagtgggagtgtcttttggtatgctaatacattataattagtgtataatgagcaatgatatcgaacagaggtcactttcattgccatgtgggtttgggtgggttttggccagcttctttactgcaacctgttttatcagcgaggtcccttctgactaatgatgttaagaatcttttaatgtacttatttataatctttctatcttcagtaaaatgtctatagaaattattggtccatttctttattgagttgtgtgatttcttaatactgagttttgaaagatctttatatattctgaactcaaggctttattgtatatctcatttgcaaatatttatccagtgcatggctggtcttttaattttctttttcttttttctttttcctaactgctagatgatgtgggagtcttttcaaatccttagcatctttggaagagcagaagtttaaatttttgataaaatctaatttatcttttttgagacagggtctcactctgtcactcaggctggagtgcagtggcacaatcatggctcactgcagcctcaaccttcagggctcaggtgatcctctcacctcagcctcctgagtagctgggactacaggtgcccaccaccatgcctggctaatttttgtattgtgtgtagagacaggatttcgccatgttgcccaggctggtctcaaactcctgggctcatgtgatccacctgcctcagcctcccaaagtgctaggattaaatttatcatcttttttttttcttggatggatcatagttttggcatcttcttagaaatctttgcctaatgtcgtgatgattttctcctatgttttcttcaaagttttatagtttaaaattttagatttaggtctgtaatacatttgagttaattttttgtaaagggtatgagtgatcaatcaaggccctccctccttcctttccttccttccttgtatattgaaatccaattattccagcaccatctgttgagtcttcctattcatgaacagggactgtctctccatttatttagtttctatttgatttctttcattagagttctatagttttcctcatatagatcttgtacataatttgttggatttataccgaagtagtttggttttgggggtgctggtataaatggtattgtgatttttcttttctttttttttttttttgatacagggtctcaccctctcacccaggctggagtgcaatggtgcaatcttggctcacttgtaactttggcctcctgggctcaggtgatcttcccacctcagccccttgagtacctgggactacaggtgtgcaccaccatacctggctaatttttttgtatttttgttttgcagatatgggtttttgccatgttgcccagactggtctcaagctcctgggccccaagtgatttcattcacctcagcctcctaaagtgctgtattgtgtttttaatttcaaattccacttgttcattgctcatacataggaaagtgattgacttttgtatattaatcttgctctagttacttattagttccaggagtctgttgtttattcttttggattttctacatgaacaactatgtcttctgtgaacaaagacagtaatatatattccttccagatccatgtacctttcatttcatgttcttatcccagtattatctaggatttccaatatgatgttgaaaaggagtggtgagagggaacatccttatcttgctcttgatcttggtgagaaagcctcatgcttcttatcattaagtatgatgttagctgcaggttttttgtagacattctttatgaagttgaggaagatccactccattcctagtttactgacagcttttatcatgaatgtgtgttggagtttgtcaaaagctttttctgcatatattaatatgattatgtgatttttttcctttagcctgttgatgtagtgaattttacattaattgatttttgaatgttaaaccagctttgcatatctgggatgaattccacttgctcatggtgtataattctttttatacattgttagattcaatttgctaatatcttgttgaggattttgcatccgtgttcatgaaagatattggatctgtagtctttttatgtaatgtctttgtctggttttggtaataaggtaatgctggcctcatagaatgagtggggaagtattccctctgcttctgtcttctaaaagagattgtagagagttggtataatttcttccttaaatgtttggtagatattaccagtgaaactatctaggccttgtgctttctgttttggaaggttattatttattaattcaatttctttaataaatattggcctactcagattatttattgattcttgtgtgagttttggcagattatgtctttcaaaaaattggtccatttcatctaggttatcaaattaaatttgtggtcataaagttgttcatagttgtccattattatcccgttagtgtccgtgggatctgtaatgatgttccctctatcctttcttgctttgttgttgttgttgtttttgagatggagtcttggtctgtcgcccaggctggagtgcagtggtgctatcttggctcactgcaacctccacctcccaggttcaaacgactctcttgcctcaacctccccagtagctgggattacaggtgcccaccaccaagcccagctaatttttgtatttttagtagagctagggtttcactatattggtcaggctggtctcgaactcctaacctctagcgatccacctgccttggcctcccaaaggcgtaagccactgcacctggcctcatttctgatattaggaatttgtgtcatctttttgtttttcttggttatcctagctagaggcttagtggttttatttatcttttttttttttttttttgctgaggttttattttggaaaaaaagagcaattgaattgttttgtagctggagagtgcctcaggcagtgaactcctcctggggatgggctgagggcaagggctaagcctcaggtgggtctcctgttccctgtgctcccctgcacagctgcctccctctcggaccctggggcagccgcaggaagggtaggctgggaggggctgccatggctgttcacttgggcaggacatcagaggactcgaacaccagcctcccatcacaggtcttgattttcttcacaactacagccctggtggagctgctgcagctgaaggagctggagcctgtgccagagccaaagctggagcccagcttccctccggcaactacctgtaggtggcaatctccatgtccagggcctatttatcttttttttttttttaaatagcttttagtttcattgattttttttctattgattttctgttttcaatttcattgatttctgctttcatttttattatttcttattctttctttagaattaatttgttcctcttttttctagttttttaaggtgaaagcctagatgattgattttatatctttcttcctttctaatatatacatttaatggcataaatgttcatctaagcactgtttttactgtatcccacaaattttgaaaagtcatgcttttattttcatttagttaaaaataattttaaatttctctgagatttctcttgtgacccatgtgttattttgaagtgtgttgtttaatctccatgtattttggaattgtccggttgtgtttccgttattaaatttttagtttaattctattgtggtttgagagcagatgttgttttaaatttgctaaggtgtgttttatggcccagaatgtggtctatcttgctaaatgttccatgtgaactggagaagaaaatgttttctgcaaaagttggatgaagtagtccatagattttttttttgttccagattaaatgcttttttaaaaaatttattattattatactttaagttatagggtacatgtgcacattgtgcaggttagttacatatgtatacatgtgccatgctggtgcgctgcacccactaactcgtcatctagcattaggtatatctcccaatgctatccctcccccctcccaccaccccacaacagtccccagagtgtgatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatgatatttctagttctagatccctgaggaatcgccacactgacttccacaatggttgaactagtttacagtcccaccaacagtgtaaaagcattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaattactttgagttcattgtagattctggatattagccctttggcagatgagtaggttgcgaaaattttctctcattttgtaggttgcctgttcactctgatggtggtttcttttgctgtgcagaagctctttagtttaattagatcccatttgtcaattttggcttttgttgccattgctcttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagtaccatttattaaatagggaatcctttccccattgcttgtttttctcaggtttgtcaaagatcagatagttgtagatatgcagcattatttctgagggctctgttctgttccactgatctatatctctgttttggtaccagtaccgtgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatgggtatggcattgaatctgtaaattaccttgggcggtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtctgtttgtctgttattggtgtataagaatgcttgtgatttttgtacattgattttgtatcctgagactttgctgaagttgcttatcaatttaaggagattttgggctgagacaatggggttttctagatatacaatcctgtcgtctgcaaacagggacaatttgactacctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtatttgtctttggttctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattggagtagtttcagaaggaatggtaccagttcctccttgtacctctggtagaattcggctgtgaatccatctggtcctggattctttttggttggtaagctattgattgttgccacaatttcagatcctgttattggtgtattcagagattcaacttcttcctggtttagtcttgggagagtgtatatgtcgaggaatttatccatttcttctagattttctagtttatttgcatagaggtgtttgtagtattctctgatggtagtttgtatttctgtgggattggtggtgatatcccctttatcattttttattgcgtctattagattcttctctctttttttctttattagtcttgttagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctaattcttttaattgtgatgttagggtgtcaattttggatctttcctgctttctcttgtgggcatttagtgctatacatttccctcgacgcactgctttgaatgcatcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgcgttctagtttgactgcactgtggtctgacagacagtttgttataatttctgttcttttacatttgctgaggagagctttacttccaagtatgtggtcaattttggaataggtgtggtgtggtgctgaaaaaaaatgtatattctgttgatttggggtggagagttctgttagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaagatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactccgtatccaatttgccagtctgtgtcttttaattggaacgtttagtccatttacatttaaagttaatattgttatgtgtgaatctgatcctgtcattatgatgttagctggttcttttgctcgttagttcatgcagtttcttcgtagtctcgatggtctttacattttggcatgattttgcagcggctggtaccggttgttcctttccatgtttagcgctttcttcaggagctcatttagggcaggcctggtggtgacaaaatctctcagcatttgcttgtctgtaaagtattttatttccccttcacttatgaaacttagtttggctggatatgaaattctgggttgaaaattcttttctttaagaatgttgaatattggcccccactctcttctggcttgtagggtttctgccgagagatccactgttagtctgatgggcttccctttgtgggtaacccaacctttctctctggctgcccttaacattttttccttcatttcaactttggtgaatctgacaattatgtgtcttggagttgctcttctcgaggagtatctttgtggcgttctctgtatttcctgaatctgaatgttagcctgccttgctagattggggaagttctcctggatgatatcctgcagagtgttttccaacttggttccattctccccgtcactttcaggtacaccaatcagacgtagatttggtcttttcacatagttccatatttcttggaggctttgctcgtttctttttattcttttttctctaaacttcccttctcacttcatttcattcacttcatcttccatcgctgataccctttcttccagttgatcgcatcggctcctgaggcttctgccttcttcacgtagttctcaagccttggttttcagctccatcagctcctttaagcacttctctgtattggttattctagttatgcattcttctaaacttttttcaaagttttcaacttctttgcctttggtttgaatttcctcccgtagctcgtagtaatttgatcgtctgaagccttcttctctcagctcgtcgaagtcattctctgtccagctttgttccgttgctggtgaagaactgcattcctttggaggaggagaggtgctctgctgtttagagttcccagtttttctgctctgtttttccccatctttgtggttttatgtacttttggtctttgatgatggtgatgtacagatgggtttttggtgtggatgtcctttctgtttgttagttttccttctaacagacaggaccctcagctgcaggtctgttggagtacccggccatgtgaggtgtcagtctgcccctgctggggggtgcctcccagttaggctgctcgggggtcaggggtcagggacccacttgaggaggcagtctgtccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctctttgagctgtggtgggctccacccagttcgagcttcctggctgctttgtttacctaatcaagcctggacaatggtgggcgcccctcccccagccttgctgccgccttgcagtttgatctcagactgctgtgctagcaatcagtgagactccgtgggcataggaccctccgagccaggtgcagggtataatctcctggtgcgccattttttaagcccgtcggaaaagcacagtattcgggtgggagtgacccgattttccaggtgccatctgtcacccctttctttgactaggaaaggaaactccctgaccccttgcgcttcccgagtgaggcaatgcctcgcccagcttcggctcgtgcacggtgcgcgcacccattgacctgcgcccactgtctggcactccctagtgagatgaacctggtacctcagatggaaatgcagaaatcacccgtcttctgcgtggctcacgctgggagctgtagaccagagctgttcctattcggccatcttggctcctccccccatagatgttaattatatccagttaattgatggtgttgttgagttcaactttgtccttactggttttatgcctgctggatctgtccatttctgacagaggagtattcaggtctccaactacaatcatggattcatctatttctctttgcagttctgatgtttttgcctctcattttaatgtatgtggttaggcacatacatattaaggattgtatatcttcttagagaacagacctctttattgctatgtaatgcccctctttgtccctgataactatttttgctttgaagtctgctcttaatgaaattaatagaggtactcttgttttcttttgattagtgttagtatggtatatctttatccatttgtttttaatctatactgtctatttttaaagctggttaattgtagacaacatatacttgggtctggtttcttcatccactccaacagtctctgtctttgattggtgcattagaccactgacatgcaaagtgattattgatatagtgggattaatacctactctatttgttagatttttatttgttgcccttgttctttgaccctgtttttgtcttccactctttttctgtcttttgtatttttaattaaatactttacatggttccattttctctgttatacttttttccatatctattgtatctgtttatttaaacattttttagtgtttgccctaaaatatgcagtatacatttgcaagaatccaatccttcaaataacactatactgcttcatgggtagtgtttttagtaacaaagtaacccaattctttcctcctatcccttgtgtcaatgctgttattcattttacttatatgtaagcatacataagcatatagatacacataagatatatacataagcatatataacctaatacgttattgctattactattttgaaaactgttacatcttagatcagttaagaataagaaaaatagaagtttttaatttttccttcactttcttctccttctgtattcatattatgcatatgtttatattttgtagttgtttcacagttcttgaatatgctgtcctgctttttctagtctttattctctttgcttttcagttttggaggtttctactgatagatccccagtctcagaaattctttcctcagccacgttcactctactaataagccatcaaagccattcttcatgtctattacatggttcaaaaaaattgtttatatagatgtatggggtacaggtgcaattttgttacacgcatactggtcaagtcagggcttttatggtatttatcaccagaataacatacattgtacctattaagtaatttctcctcacctgccctctcacctcttcccctttctgagtcttcattgtctataattccactctttagctccatgtgtccaccttttttctcagcatccacttacagtgtttacagtgttctcatgtttctttgtttcttttctttttaaatttcgagacaggctacaacagaatccaaatccataggtaaagcaaactactcatgtaatttcaaagctgaagttgatagtatatttgtacccaatatgaatggttcacctgcatgagttttgagttctcaaaggccagtagcctcctttcccttttatgcatcttgagtacacttgagttagcctatgatacatgaatacctacaaagttgaggcctataaaacttacatggcaagcaatttgaaatgtgccaacaatgtgatactggagcaaccatagtgctgagaacagctttgactactgcaggaaatccacaaacctcaaatttagatgaaaacatttttgaacttaattcatactgagggacaaattatggtaatagtggagggaaagtctttttatgtgagatacaggaggctcctttagctctttcacctcctagagtcaccatagtggtaccttcatttattccttctcaaatattcctcccatcttcatttagatctgagtttcaggcctatattattttccctctttctgaagaactcttgacatttctttcaaggcatgtttactgacaacaaagtccctcaattttcatttgagaaaatctttgtttcccttttgaatgaaaattttgctggatacagaattctaaattggtgatttatttctttcaacactttattttactctaccttattcttgtttgagtcgtttttgaagagaattccaacgtaatacttatccttgttcctccagtaggtaaggggtttttgttttgtttttgtttttttgccttcctatagcttctttaaggattttcttttgtctttgattttctgcagtttatgtatgatattcctgggtgtagatatttcttggtatttttcctgcttggcattgtgtgagcttcctgaatctttggtttggtgtctgctattaattttggaaaattctcagccaatgtttctttattttttctgttcctttttttctcctccttttgttagtcccattatacctttattatccttctgtaagtgttccacagttcttggatatttgcaccatttcttttcagtctttcttctctttgctttgcaatttggcagtttctattaacatatttgcaaactcaacaattcttatctcagccatatccagtctactgctgagtccatcaaaggcactcttcatttctgtgagacagacataatctataggtgaaaggaactgatgtaaatacacctttagtgtgagattttatgcttatctggctaagagctctgcatgtattcctgtctgtctcccaaagtgtagaaagattttttttgttgttcagtttctcttaggacaacaggtcgttgtccacagtatgtgactcagcacccttggatgatgaagttggctaagatgttggcaggcagagaatcacccatggtgttgccagtggtagttaccgagaagccagctggggtgctactgaattctctggggagctgacctctgagagttgcccttcagggtgctggaaagactagctgggaagtgtacctgtgaggacaatcctgaaactcacttggaagctgccctatggtatgctggccaaactcactagaaagccacccttaggagtgccagcaaagctcactggggaggcatcttctacctatctcacatgccactggcagctatgtgcagcaagaacaaaccaaaaaagcactcaaatcaggaagtggagctccttcttccctcagcatctttctaatgccctctactggcaaagcttaccattgtccaactaacaaagggaaatgttcacaggatccagctctgccatcccaacccaggacaaagaagcgtgaatttataactcaaatgtaataaattaataactggcagaactgcccattacacataggatatattccaattctttgccagcacctataatgatttactctctacctatttcttcaacattattggaggtccaccctgcctactttccaccattttagccattctctgttatttgcacactccaagctcatcttacctcagaacctttgcccttgctatactccatgcttggaacaagtttcccctatatctttatataactagctctctattaatatttgggtctttgttaaatgtgacctcatttgaataatctaaaatgagcccacatgcctataataccttctgttgttttgctgtttagttttcttcacggtacttatcactaaattatccttttttttttttttactatgttcttatccacatagtaataagccaagtaagagccagaccataatctatattacatatcagcaataagaagagtacccggcaagtagtaagtgctcataaaaaatactatatagttgttgaatgaatgagtgatctctgttttatagctgaggactgaagctcagagagagaaagtaactttcccaaagaacacagctagcaagtgccagagtcaggagtcacctcaggtcctcctgatcacagtgctctgattgtcatggctctgtaccaccacctccctgagtgctggaaagagtgtagctgaggtacatgttacagtggagtctctaaaataattgagcttttgttatctcattacccatttttttctttctatggatctggctctctactgtgtgtgcatagatacagatccatgtactcgtgccccctactcagaataataatgtgttaaatatctttcaaagaaagaattattagacaaagtcatggaactcttcaccaaaaagatgaccttcaagaggggccatgcgcgatggctcacgcttggaatcctggcagtttgggaggccgttcgagaccagcctggccaacatggtgaaaccccgtctctactaaaaatacaaaaattagccgggcttggtggtgtgcacctgtagtcccaactacaggagaatcgctttcacccgggagactgaggttgcagtgagccaagactgtgccactgcactctggtctgggtgacagagtgacactctgtctcaaaacaaaaacaaaaacagaaacaaaaacaaaacctttgaaatactttgtaaaattagaaattgggtattgagaaaaataaaaatacatcaaatggaagacaggaacctagatcccatttttttcttttctttcttttctttttttttttttttgatggagtctaactctgttgcccaggccagagtgcaatggtggaatcttggctcactgcaacctccgtctcctgggttcaagcaattctcctgtctcagcctcccgagtaagtgggattacaggcgcccgccaccatgcctgccaaattttgtatttttagtaaagatggggttttaccatgttggccaggccagtctccaactcctggcctcaagatatccgcctgcctcggcctcccaaagtgctgggattacaggcgtgagccaccatgcctggccccagatccagttgtctaataccattcttcagtaaaataaaccagggctcttaggagaagtggtcaattctagcactggggcaggaaatacaaacataggcctaaggtaccagggcataaggaagtgttcagaaaacaaaaaaatcacacaacgatggggatatgttaaaaggaactgtagccagagaagggttcctaatggctgaagacagaaaaacttgagcaacaaagtcaacaaaatagtattggattataaagtataaataaatatccacgagtctgtccatactgatacaaataaatgattgaataaataaacaagtagtggagaataggtggatctcccatacagaagaatcccaaaaaatttatgtagatactctgtcctcaaggaggtagagcataattccacattcaagtgtgggttgcgcatactgacttccttcaaaataatacagttatggagagaggaaaaactaacttcatagtggaaaaatctgacaaaccccacctcagccaggggatcaaggtcagcatcaatggtatatatttttgatatgatgtgataagaaaggcatattatttccatagtcttcctcagcaaaccccaaacatcagcctaatcgtgaaaaaatcatcaggcatctcccagttgaagggccttctataaaatacctggccaatactccccaaatctgttaaggtcttagaaactgttttttaaaattattattatacattaagttctagggtacacgtgcacaatgtgcaggtttgttacgtaggtatacatgtgccatgttgttttgctgcacccatcaactcgtcatttacattaggcattactaattagggttactaatgctatccctctcccatccccccacccgccaacaggccccaatgtgtgatgttccctgccctgtgtccatgtgttcttgttcaactcccacctatgagtgagaacatgcggtgtttggttttctgtccttgtggtggtttgcttaaaatgatggtttccagcttcatccatgtccctgcaaacgacacgaactcatcctttttatggctgcatagtattctatgatgtgtatatgtgctacattttcttaatccgttctatcattgatagacatttgggttggttccaagtctttgctattgtgaatagtgctgcaataaacatacatgtgcatgtgtctttgtagtagcaagatttataatcctttgggtatatacccagtaatgggaccactgggtcaaatggtatttctagttctagatccttgaggaatcgccacactgtcttccacaatggttgaactaatttacactcccaccaacagtgtaaaagcattcctatttctccacatccttccagcatctgttgcttcctgactttttaatgatcaccattctaactggcatgagatgttatctcattgtggttttgatttgcatttctctgatgaccagtgatgatgagcattttttcatatgtctgttggctgcataaatgtcttcttttgagaaatgtctgtttatatcctttgcccactttttgatggggttgtttgtttttttcttataaatttaagttctttgtagattccagatattagccttttgtcagatgggtagattgcaaagattttctcccattctatatgttgcctgttcactctgatgatagtttcttttgctgtacagaagctctttagtttaattagataccatttgtcaattttggcttttgttgctattgcttttggtgttttagtcatgaaatctttgcccatgcctatgtcctgaatggtagtacctaggttttcttctagggtttttatggtgttaggtcttacatttaagtctttaatccatcttgagttaatttttgtatatggtgtaaggaaggaatccagtttcagctttctacatatggctagccagttttcccagcaccatttattaaatagggaatcctttccctatttggttgtttgtgtcaggtttccccattgcttgtttgtgtcaggtttgtcaaagatcagatggttgtagatgtgtggtattatttctgaggcctctgttctgttccattgatctatatctctgttttggtaccagtaccatgctgttttggttagtgtagccttgtagtatagtttgaagtcagatagcatgatgcctccagctttgttctttttgcttaggattgtcttggctatgtgggctcttttttggttccatacgaactttacagtagttttttccaattctgtgaagaaagtcagtggtagcttgatggggatggcactgaatccataaattaccttgggcagtatagccattttcatgatattgattcttcctttccatgaacatggaatgttcttccatttgtttgtgtcctcttttatttcattgagcagtgatttgtagttctccttgaagaggtccttcacatcccttgtaagttggattcctaggtattttatcctctttgtattaattgtgaatgggagttcattcatgatttggctctctgtgtgtctattattggtgtgtaggagttcttgtgattttttgcacattgattttatatcctgagactttgttgaagttgcttatcagcttaaggagattttgggctgagatgatggggttttctaaatatacaatcatgtcatctgcaaacagagacaatttgacttcctcttttcctaattcaataccttttatttctttctctcgcttgattgccctagccagaacttccaatactatgttgaataggagtggtgagagagggcatccttgtcttgtgctggttttcaaagggaatgcttccagtttttgcccattcagtatgatactggctgtgggtttgtcataaatggctcttattatttttagatacgttccatcaatacctagtttattgcgagtttttagcatgaagggcggttgaattttatcaaaggccttttctgcatctattgagataatcatgtggattttgtctttggtcctgttgatgtgatggattacgtttattgatttgcatatgttgaaccagccttgcatcccagggatgaagccaacttgattgtggtggataagctttttgatgtgctgctggattcagtttgccagtattttattgaggatttttgcgttgatgttcatgagggatattggcctaaaattctctttttttattgtgtctctaccaggctttgctatcaggataatgctagcctcataaaatgagttagggaggatatcctctttttctattgattgaaatagtttcagaaggaatagtaccagctcctttttgcacctctggtagaatttggctgtgaatccatctggtcctggactttttttggttgataggctattaattattgcctcaatttcagaacctgttattggtctattcagagattcaacttcttccactggtttagtcttgggagggtgtatgtgtccaggaattaatccatttcttctagattttctagtttatttgcatatagatgtttatcatattctctgatggtagtttgtatttctgtgggattggtggtgatatcccttttatcattttttattgcgtcaatttgattcttctctcttttcttctttattagtcttgctagcggtctattttgttgatcatttcaaaaatccaactcctggattcattgatttttttgaagggttttttgtgtctctatctccttcagttctgctctgatcttagttatttcttgccttctgctagcttttgaatatgtttgctcttgcttctctacttcttttaactgtgatgatagggtgtcgattttagatatttcctcctttctcttgtgggcagttagtgctataaatttccctctacacactgctttaaaagtgtcccagagattctggtacattgtgtctatgttctcactggtttcaaagaacatcttcatttctgcctttattttgtaatttaccctgtagtcattcaggagcaagttgttcagtttccatgtagttgtgtggttttgagtgagtttcttaatcctgagttctaattttattgcactgtggtctgagagacagtttgttgtgatttctgttcttttacatttgctgaggagtgttttactaccaattatgtgatcaattttagaataagtgtgatgtggtgctgggaggaatgtatattctgttgatttggggtggagaattctgtagatgtctattaggtccacttggtccagagctgagttcaagttctggttatccttggtaaccttctttctcgttgatctgtctaatattgacagtgaggtgttaaagtctcccattattattgtgtgggagtctaagtctctttgtaggtctctaaggacttgctttatgaatctgggtgctcctgtgttgggtacatacatatttaggatagttaggtcttcttgttgaattgatccctttaccattacgtagtggccttctttgcctcttttgttctttgttggtttaaagtctgttttatcggagactaggattgcaatccctgcttttttttgctttccatttgcttggtagatcttcctccatccctttattttgagcctatgtgtgtctttgcacatgagataggtctcctgaatacagcacactgatgggtcttgactctttatccaatttgccagcctgtgtcttttaattggggcatttagcccatttacatttaaggttaatattgttatatttgaatttgatcctatcattatgatgttagctggttattttgcccattaattgatgcagtttcttcatagtgtccttggtctttaccatttggcatgttttcatagtggctggtaccggttgttccattccatgtttagtgcttccttcaagagctcttgtaaggcaggcctagagtgacaaaatctctcagcatttgcttgtctgtaaaggattttatttctccttcacttaggaagcttagtttggctgcatatgagattctgggttgaaaatgcttttctttaagaaggttgaatattggcccccactctcttttggcttgtagggtttctgccgagagatccgctgttagtctgatgggcttctctttgtgggtagcctgacctttctgtctggctgcccttaacattttttccttcatttcgaccttggtgaatctgacaattaatgtgtcttggggttgctcttgttgaggagtatctttatggtgtcctctgtatttcctgaatttgaatattggcctgccttgctaggttggggaagttctcctagataatatcctgaagagtgttttccaacttggttccattctccccgtcacttttggtacaccaatcagatgtagatttggtcttttcacatagtcccatatttcttggaggctttgttcatttctttttactcttttttctctaatcttgtcttctttctttatttcattaatttgatcttcaatcactgacatcctttcttccacttgattgaattggctattgaaccttgtgcatgcatcacgaagttcttgtgccatggttttcagctccatcaggtcatttaaggtcttctctacattgtttattctagttagccattcattcttctcaccttttttcaaggtttttagcttccttgggatgagttagaacatgctgctttagctcggggaagtttgttattaccgaccttctgaagcctacttctgtcaactggtcaaactcattctcgtccagttcgtttccttgctggcaaggagttatgttcctttggaggagaagaggcgctctattttttggaattttcagcttttctgctctcatttctccccatctttgtggttttatctacctttggtctttgatgttattgacctactgatgggattttggtgtagctgtcctttttgttgatgttgatgctattcctttctgtttgttagttttgcttctaacagtcagacccctcagctgcaggtctgttggagtttgctggaggtccactccagaccctgtttgcctgggtatcaccagtggaggctgcagaacagcaaatattgttgcttaatacttcctctggaagctttgtcccagaggggcacctgcctgtttgaggtgtctgttggcccctactggaaggtgtttcccagtaaggctacacgggggtcagggacccacttgaggaggcagtctgtccattctcagagcttgaacacaatgctgacagaaccactgctcgcttcagagctgtcagatagggacgtttaagtctgcagaagccgtctgctaccttttgttctactataccctgcccccagaggtggaatctatagaggcagtgagccttgccgtgctgcggtgggctccacccagttcgtgcttcttggcctctttgtttacactgtgagctactcaaggctcagcaatggcagatgctcctcccccagtcaagctgcagtgtcacaggtcagactgctgcactagcagtgagcaaggctccatgggtgtgggacctgctgagccaggcacaggagggaatctcctggtctactggttgctaagactgtgggaaaagcacagtatttggtcaggagtgtactttttctccaggtacagtctgtcatggtttcccttggctaggaaagggaaatcccctgaccccttgcgcttcccgggtgaggtgatgccctgccctgcttcagctcaccctctgtgggctgcacccactgtccaaccagtcccaatgagatgaaccaggtacctcagttggaaatgcagaaatcacctgtcttctgcattgatctcgctggagctgcggactggagctgttcctatttggccatcttggaagcaactgcccatcttagaaactcttacagccaagaggagactaaggagacatgctgactcaatgtaatgtggtgtcctggatggatctgaggaagggaaagaggatatttggttaggaaactctgaacaactaaagaaatctgagtaaagtatggatgttagttaatattcatgtattagaattggtttacagtggttacaaattatagaggacactgggtatgtggtatagttatacgagaacaatctgtactctcttagcaactcttctgtgattctaaaaccattctaaaataaaaagcttccttaaaaaaaattgatggcagagcaggagtaagtatttttgttttgtaaccttggaaaaaagagagttgaggcaaaatccacagaggactagaacctgtattcctatctggtgtgggaggagagagatgacatttggttgggagaaggctggagccaagttatggtgttcagtttgtttctgctctgctgtcatagggctcttccttggaggagctatagctctatggaaccgtatgaatgggagagtaaggttcaacagttcgttggtgtgacctgggtgtatgtgcacatgcggatgcattgtgtacatgcaaactcaaatccccatagcatccagctaggaagtctaaatgagcaaagcaagttgggtataagaaataagaaagtgctgggagctatgcttaataggagacacaagcctcaaatagcagaacagctgctgctctgttcagtgccgggtgatttttgctgtgcgggaaggtgaactgagatgcattttctggtatttcaaaagaagctgaaaatctagatttactttttgaatgtggaaaattctgctttttaaatgttggcaactatttcagaaagtttttattaatcatcatgtatgcccaatctgtgttgaaggaaatgtgtctgtggactgcacacagtccataccaccaggttgcaattatttctgtcaacctgagctatgctgagtccggtgggctaatacagatgaggcagggctgtgtctgtgtggtgtagagcatggagtcagtctgtgtcctgagctgtgatgagatcattctgtgagagtaaataactgagcttgtacttgaaagttgaggacaatgtggagaacaaagagctaagagcacaagcaaaggtccagaactagaacatcacagggtgtgttttggagactggatgatttgagtaaagaatcatgaagagcagaagtagttatcaggctagaaagttaggctggagccagataaggatgggcctgagtatttggaatatatactgttggcaacagatgactaaatactcgggttctcttgaaggagtacagggcagaaatcaggagatagaatgagaaatttgacatttacaccagaactttccagccacaaagagcaaggtagagtcaattaatgcactgagtctagttagaatgattgggttaaggtgagagtggccattcctaacacttagcaaaacagtgtgtatgcatatgcctgtgtgcagttatttgattatacatacactttccagctgggctaggctggcctatctgggcccagtcaactgctgtggacactgagctttaacaccaataagtgcgtgccgtattcatcctcattctcatttctttctcagtgcctcttgaccctccaaggattattgcactgatccagaactgctaaaatggagaaagccaggcctgacctgtgcgcacagcacacagcattgatatttgatgtgagattaggtcagagtcagccgggaagccttctaaagcgtggcatacagccaacaaaatgaaaaggctttattctggggggaaatgtttccctctctgcctggcttgctttccttatcctcccttagacatcctttcccctaaattctagttcattattttcatttgaaactctcaaattccactgggccactagctgaccacattcctccctaaacaatagcattctattttaaacacttattgtgccaatgttgacattttaatagcccaagaggggctgaaataactactcctacctcaccaccatcaccaaggagatcaagtatcatttctaggatttatggtaagcccctcacggtgaaagcacaaaaatcagaggccaggaaattggcagctacgtattttaaataggatttcggtaatctttggctggtctttcctaacaatgttgaagttgatattttgtaacttaacattggttctagttctgcctggtgagtagctctaatctcattttcattatgtgagaaaacacttattaattagtagaaactattggcaaacttgatatagttgtgaatgaataatgtaaatccctagtggggcccttcccaaacccttgctccccttcctaaataagcaaacagagggaaatttctgattttagtgggatgatgtaccactgattacccaacattgcttatgactttaccattaagatttataatgaaaactcttttatctatatgtaacaggaattaaactttatgcaacaagttaaataacaaactttctcgatatccaaatgagtgctttctttatccaagttcatcagtgtaggggaaagtcctaaccttatttcaaaaatgtgcaaaatattttgtaataactaggtaattctaaaaacatataaggaattatctgaagttaagtgtggtgagtgaagtggatgattgatagtcatttgggagcagtaaagtgggtaagagtaaaaattaatgagacagtcttcttcacgtggttcaaaaaacagcttctgaaggcagtttccctggaagagctccagaagtgttcttgtatgtggcagtaaagaaagacaatactcctgatgactggtaaccaagtaatgctggcttaaacagttacttatgtgataatcaaacttcccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataaggcataaaatcaattcactaatgtcatgctagagtgaggtagtaaaatgaggcaactcagaccagatggtgtaattcataaacagggctgtcatttgggaaaacgggtggagtggatggagaaattaacttgcagtctttccccttccatttcttcccaatccaactaaccttattcctctgggtcatttagctgtggctaaaacacacacacacacacacacacacacacacacacgtgtgtatatatataatatatatataatatactttttacttatagccataggtaaatggtgaatgaagtagatgattgacctgtgtgcatagcacacagcattgctatttgatgtttgatgaaatatcaatgctctcagaataaataattaaatgagtgtatatatatagacacacacacacacacacacacacacacacacatatatttcttttttaaaagagtgtaattgatgccaaagccactttctcttcagagctgcttaactacatgaagagtgtgcaccaacctggggttgcaaagagttctctaccttgtccggcttctggaaaggatgtgcgctttgctcaatggggaatggataagatgaggatgtcccactgctggttggttagtacatttttgtagatgaagcaaagcacatctgttcttatacagaatctcatctttaaaagggacctcagatagcatctaattcaaaaactcatctaatgcagtgcagtattcctctaagatacatacataaatgctggctaaatgcccccagggatggaagtttactgcctcacaaggcagccaattatctttctgacaggtgccattcttcctaatactgaggtaaagtccattgttctttagcttccacaaaaagcagtgataatactcttgacggcttgccctgtgccagggtctgtgccaaggagcttcatatgcattgtttgtaacacttgcaacattagtggcaggcagggatcatcctgcacattttacaggtgagggaactggcacaaggtcacacagctaagagagaaggatctagtctggctaaatccaatgcctaggccaatttcttgacaccatgcataattcctgtttcaaatttctatatgtgaaggcaccttttagactcttctgttttctcattgatttctcatatggcatgccttccaatgctttcagaatatgctatgacagtatctctataaaaatataaatcaatacaaaagttattgacccctagaaaatgacaatcacatacttcaattaaaatgagtagtacaaagagacttccttgaatcttttaataatggcatttatttttacataataacagcagcatattggttaagacatggatttaggtagatttgacacctggtttcaacattcattagctgtcagattcggggcattttatctaacttctcaaattatcagtttctcacttacaatgtggggatgatgatgatgcctatgttttagaattgtgagacttgacatagtacatataaagcacttagtatgatgctggcactatcttcaataaatggtattattatttctttatttgcagcaaaccaaaacccgtatgattgttgtcaagtaagacttcccctacatcatgtttgtaaattagaatgttagctataattataagaaattgaaaaattcatgttgtctaatcaatattacattttagccagtagtttcagccaggatcttggttctctcattaaatatactggtaatctttttcaattttgtgtcacctgcaattgttaaacatattttcagtatctttatccaagttgttgctaaaagtgattgaacagggaaatcaatgtttgttcccatctgtgggtgctgttaacagcttcgtatgtgtgttttacagtcacatatgtaattttccctgtgcttttctgtctatatcatacacttgttgtatcccctagtgatctctgaagttttaagctgtctttgacctatgattctgtacatctcctgatattgacatagctgaatctattaactaacttctaaaatggaaaccaggacacctggggctcagcactagcctttccccagtgtacttaagccctctgtggctccatttttcatacttttaaaactgagcaaatatttgccctctccttcctttcaatgatatggtgaaaatgaatttaaagcaattataaaaaggacatgtgttcttataattggtagcatatcatttacagagaaattcctcatctggtcactatctaagtagctaaacaactaaacattagcaagagaagtctttgagcagtcaatgtaaatgacaccaagtctatgcatttatcatgtgctttactcatagactcatacttattcacagtcccattacatacacacatctaacaagcttgtttatttcatttcccagtccacagccaaatagaggaagaaagtggatggagactgcccaaagtgggtaaattgaaagtagcaagaaaaggccaggtgcggtggctcatgcctgtaatcccagcactttgggaggccgaggcgggcagatcacgaggtcaggagtttgagaccagcctgaccaacatagtgaaaccctgtctctattaaaaatacaaaaaattagacaggcgtagtggcgtgcacctgtaatcccagctacttgggaggctgaggcaggagaattgcttgaacctgggaggtggaggttgaactgagccgagatcgcaccattgtactccagtctgggcgacagtgcgagactccatctcaaaaaaaaaaaaaaaaaaaaaaagtagcaagaaaataatcattttgaaaggtgaaaaaaaaaaagacaagagaattataaaaattagaaactcaaaaagtaaagaagcctgagaccactaattaaaggggaaagatagccttaaacatcagttttcaagaacattactgaattacaagttaatactataattgatgttcaaaatgattattcattattgtgttggacttccgtgttttcacatgctcagcattcattctgctctcctctggaggcagcactatgatttttcttcagaaaattacccttcccaatttgtattctgttccaaaggaaccatcatgtaaggagctttcccatctcctgaacaaggctgagcttatggtccaagacaagtcagtcacctttttgcaggaatttggatgttgagcagagccaacacaaagctactgggctggctcatccttatggtggtatcctgaattcttcccttccacgtagaaccctggagctgcatggtccctgaccttttcaagactggttgtccaattttcttttaatttggaagactactttaaaacattctaataaaatatgttagtcaaaggtggtctttggctgctcacagcttgtgtttcataactgacacagattcattaaagggatcaattttgttctatatgcagtgttcaaaaagccacagatatttgtaataaaaattaaaaataggccaggcatggtggctaacacctgtaatcccagcactttgggaggcagaggcaggaggatcacttgagcccaccattacgaaaccagcttagacaacatagtgaaaccccatctgtacaaaaatacaaacatttagctgggcatggtggtgtgtgcctgtaatccctgctgctcgggaggcttgaggtgggaggattgcctgagcccaggaggttgagtctgcagtgagccatgatcacgccactgcactccagcctgggtgacagaacgagaccctgtgttaaaacaaacaaaacaaaaaaccccccaaattaaaaatatttccatccaacttggttaaaatagaattgaaaacctttagcattaaagggatgtttccattataaataagttactaatttcctaaccatactagatgaatgagttgttattgcatacaaatccaaaaattattacattttattgtagcttgaatatatcttggtgaactcattttcttagagtggctctggttagctctttattaaaatgacaactgatgtcacagaagctgcctgaggacacatctaaaatgaacatgcttttagtggtggttaaaatactttgaacagtcaacaaatatttacagctctttttgtgtaacgtgctgtactaagtgctgggataaagcagtgaacggggtggacatagcctcagaactcccggagcttgtggtccaatagctcagtaaaggtctactgaatgaaagggagacttccctttgctcacaatgaggtcattcctcatgtttttgccaatgtatttttcctgcctggataatccaccctctgacctttatccacatcctttacccatttctttttcaaggtccagatcaaacagcaagttctccactaagcctctaacaataataacactgatggcagctaaacatttattgagcctgatgctaacctctttacatggattacataactcatttctcacaatgcactatgagatatttacatataattcttcagtaacccaattgaggggaattgcagggcaattaaaaaatacgtataacttaaaatgttgaactcagcatgcccagaactactagaatctttttgagcatagaacttaaaatgtaaggtgcgaagaaaacaattttatattttactgtgcctcagaattgcttggtggggtcttttaagaaataaagatgccagagtacattgtcaaaatttccaactaattaaaaacacacaagcacacatatgcagaacacagtacagaaaattgccgcaaatatcttctaaagataaccacaaattgcactttatgtgtttccattcagtttttcttctttttttgtagctataatcttttagacataattttaggataggtatcaccttatcagtgagatctttccttacccacctccattccctgtcctcattactgcttaagttttctccaaagaatttcttaccttctatttattaattactttttaatttactttgcttcctcagagtaacttatctccccacctccccgtggccccacttccacatacatactagaatgtcagctccataagggcagagatttttgtctactttgctcacttcagtatctacagtcgttaacagagtgcctggcatggagaggtagcttagtatctctttgtccaatgatggatacctgaatgaatacaactgtcaaagtgcccttcagaaatgctgtactatttccacttctacacgaagggtaaggcagtgccatgtggaaggtatatttttaatgggtgggaccttgagtcatcccttgaatgccacctgggatctctgtggcaggcacttgcaacaccaaaggagtgtacactgtgcctggggccaagggcaggtgccatacacaagtgcaaggccatactgaagaggccacctgccctcaaatgggttcaacaggaatgctttttaaagcaatgccccaaaattggttttagcacttgattgtataacctgaccacattatgagttctggaatttgttcagggctgtgtcctgtttcctttagatcacatctttctctcacccagattgcctaatttttgaacttttaaagagcagagtactgctttcagtgctatttagtcatttcccacagctcttcatccctttagagtagcttttatagttacttgggccattttgggtagtggacattggattactatttttgttcaaccaaataaatggaaggcttcttagtattattaatgctcaaaacatgcaacccacactcctattatgcaattgaatattgttttgaagtcatcctgtaattacaagatttccttccaaatcagacaataggtctgaaagtagtaattttgacctaaatatgtgcaagagcttgaagggcttcttataaaaactaagaggaagaccaagtttagtggaaaaacacccaggctaggatttgggagacctgggtcccactgacatctctgccaattattggctctccaagtccccctttggttgggtaatggggccgtccatcctaactcactctattatgtggaatataaatatgggaatcacaatgaaaactgtaaaattatattacatctaaaaggctgccatgttttcttaaacactggttaattatggtaggtagaaagaggtcttttgaaggcttttagagctcattttcccaaattgttttgtgtggacctctgcttcagggagatgtatttagtcagcttttgctgcatgccaacttcaatatcaaagtggctcatattccatacacattcctatgcttgctcgtctgcagttcagttagagttcagtcctgaagtttaagttgaaaggaagaaacttgatcttagtgggtacttaatctgttcagctcactaaaaacaaaaacaaaaacagctcagttgtatggaaggagcatgttaaccacaaaaagtaggggtagaccagaaagaagtaagctagaaggtgggttttggaatgagatcagcgccagtgaatctacccttcagttctagatttgagaaaagtagtcaaccaccataccaatgggcaacaagtaggaccaatggaaactgtactcaccccacctgttgaaaacctggagtttgagtaggtcttgccttgtgtaagaaggagtggagaagaaaaaaatcacaccctacatttggtcagggccaaacaagattgaggacaaatagaactttgtgttaaaatacttgtcccaggtccagtttcgttttgcaggattcagaaagagttgtgtttgtttaatacagtcttataaagaatttccaatcccagaggattcatgaagcaaagtgatgctacagcttccacggtgtgtatgtcagagcaggcaggattttggagattgtatatcccaacactgtaattttacaaatggaaaaaggcacagggaggaaaataaagctcaggattattcagttggaggagatagaaatgcacctaagtcccatagctcttagtacaggacatatttttttttacaatagcagcagcagcagcattattaaataatgatcatggaacatttatgaatctaggcatagttctaagtattctatatggattatgacttttatgccttataatagcccatagaggtacacttcccctttgtacaggtgaggaaaccgagagaggcagagaggttaataaacttgtccccagagtaacatgtaagaaaatgatagagataggacatatcatgaagcaatttccaaagcgtatctggcatataccagcttcgcttccagagacatctacctgaccagaggtagagcagtagtttacacttcttcacttgttcagacaataaagaaaatgggttttgaggaagccctgtatgcctttctaaaagtgctttctaagacagagtacatatttcctgatcttctgtatatccgtcatcaaactcaactgtcatcttcttaatgccaggtagatactaaaccacaaatcctccaaaacaactgggcagaaagtagaagacaatcagcagcattcactgctttctaagaaggcaattcccaggaatacagtcctgaaggtttaagttgaaaaagaaacttgatcttagtaggtatgtaatcagtttagctcactaaaaacaaaacaaaacaagacaaaaaacaaacaaacaaacaaacaaaaaaacaactctgtcaggtggaaggaacgtgaaacgtgttaacccatgaaaaacagaagcaggccagaaggaagccagctagaatctagggtttagaatgcgagcagtgcctgtcaatctacccttcagttctagatttgagaaaagtagtcaaccaccacaccaatggacaatgagcaggaccaacagaaactccatccacctacctattgaaaacctggagctttaataggtcttgccttgttcaagaagtagagaagaaaaataaaacaattcctatggtagaaaaaaaaaagatactgtgcaacaaagaaaaaccgtatcgagatggtttttgaggaagaatacacatgtgaaaaccagctagtctgggatccagaaaaatatttaagaaatagtctggcatcctcagaaaagtacaagaagatatggtgtctatgaaccaggagctgcatggagacagatgtatccagtaaggactagagtgaagctaagatataatggaagggagacaaaacactccctatctctggaaacaaaataaaatggaatacagggtgccagttaacccttgcagtaaatgataatttaaaaggaaaatacaaaatacccacaggtgaatgataacgaaagtatctcatatcaaaatttactggaagtcgctaaggcagaggaaatttataggtttgagtagattttctgtttttcctatttatttatatattaaagatatatacatgaggatatttatccccattttacaaaagaggaaaaagaagctaagagaagttgagtagcttgtcaaagttcacactaccagtaatagcagagccaggatctgaaccaggaggtctggttcactcttaataagacagaaaaatctctagcaaggttaagaaaaaaagaaaagatatgaataagcaaaatacatgataaagagagaaagaaaaaaatgttttgaacaactagcttacactccaataaatacgtatatattagtttcctagagctcttataacaaaataccatagactgagtggcttaagcaacagaaatgcattttctcacagctttggaggctagaagtctaagatcaaggtgttggtaggtttggtttcccctgaggcctctctccttggcttgcagatgactgactgccttcctactgtatcctcacgtggtctttcttctgtgtgcaggcatgcctgctgtcacatgtatctccttataacaacagcaggcaggttagatttgggcccaccctaacagcctcattttaacataatcacctctctgaaggccctatctctaaatacagtcacaattcgaggaattgaggattaagactttatatgaattttctaggaatatgattcagcccataacagtctagaaaagtgggtttcggggaaaaaaaacccacaacttcccagcataaatgtgaaatagaaaattaaatacaccaataatataacatgattattaatcctttccttttactaccacattcctagtagatagagactgtggttgttttacaggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttactaaaaaaaaaaaaacaccccagaagaaaagttaaaaccctaaacaaaaacaagaaaaagaagagtataagaattagaagaaaaaagaggaaattagcattttagaaattttatatgatgatttaatatggaacacctacaacaagctacagatacattactaaaattgattaaaaagtttagataagttgttggataaaaatcaatatacaaatacattgtatttctatacaacagcaacaaagctctaaaagagctgaaattaaaagttacaatttaatttacaatggcaattttacacatacacacacacacacacacacaccagggaatgagctgaaaaaataaagaccttaatggagacaattattaaatttattaaaagatattaaaaataccagaattaatagaagatatatcatatgtatgaatttgtagacaaaatattttgagatgctgtatctactcaaatggaacaatatattcaatgggattaaaatatgtatctgaaggcaatctgtgttgtactaaaaagcttgaaatgacaaagcttgaaagctggttctaaaatttatatagatgacttgagggtctgagaatgacccaaattgtcctgaaaaagatgaagcaaattttattattaagcttattaaataagaagtgagtgagtgactggtatgaggactaagggaccaagggagcaatggaacataacaaacttggtatgtgacagaggtggcattgctgaaaaccagtgaaatgagggaattggtcaacatatggggttgaaataattggttacttacatggaagaagtggaattggatgttcactttaccatgaacatagatatcaattccatgtctattaaaaatgtaaatgtgaggctgggtgcgatggctcaagcctgtaatcccagcactttgggaggccaaggcaggcgtatcacaaggtcaggagttcgagaccagcttggccaatatggtgaaaccctgtctctactaaagatacaaaaaaattagccaggcgtggtggcacacacctgtaatcccaactacttgggaggctgaggcaggagaattacttgaacctgggaggtggaggttgcagtgagccgagattgtgccactacactccagcctgggtgacagagtgagactctgtctcaaaaaaaaaaaaaaaaagtaaatgtggaaggtaaaagtctacaaagggagtatctgtgacttggggcagggaaatattgcttagacaaaacacaaagcgcacaaaccataaagagaaagattggtaaatttgagcacattaagaacctctgttcatcaggagacactgtaaggacagcagaaagcagacttggagaatgttgtgtgtgtgtgcgtgtgtgtatctagcaaataattagtattcagatatacaaatcaatattgatttttctacaaatcaataagaaaaagacaataccatggacatgttctcaaactccttagtaatcttggaaatgaaaattaaaacgacaatgtatcaccatttcctacctatcagattggaaaaatacaacctgatattacaaaaaactgttgatgtaggacaatgagaaccttagacaatgatagattcagcatggaattaacctaaaggaataaggcctgtctcctaagtttttgagggagttacgatatcacaacaaccttaggcttgtgtggcatcagcctgtgaatattaacttatatcaaggccaccgctataaaatcaaagtccttaaaatgccctaccaggacttggtatgtatgatctggttctcccttgcttctctaatctcacttgttactactttcccatcactcttgccatcctcagtccttggaagtatttctcgattattcttttatatttgccattccctcttaccggaatatccatcctccagatatccacatggctctgtctcttcattcattctagtgcctgctgaaaggtcatctttttaagatgatttctctgataattttatctgaaaagtgaccacccatcctacttgtcactatcttcttccttgtttttttttctttataaccttcatcatgactttacattttaaatttttaattttttcccttctctccttttttttttgagataaagtcttgctctgttgtctaggctggagtgcagtggcacagtcatagatcactgcagggtaattttaaattttttgtagaggtagggtcttgttacattgcccaggctggtctcgaacccctagcttcaagagatcctcttgcctcggccttccaaagtgctgggattaaaagcaccagtcactgtgcctggcctttacacttttttattgtgtgtttgtatccgtccactaggctactattgcgatacccctagttcccagattacttggcccatagtaggagcttaatatttgtgtaatcaggggacatgaaattccttataagctcttatttaatagaattaacaaaatattttacttctagattttaaaatctaatttactaacatcatttgggaattttgttacatatacatgcctcccacacttttttttttaaaaaagagttcgtttatcacacacttgttttttaaactaatgatttgctttcaagtcagtgttgtcacacgtccaaggttttcctacattctggtcaatatttattctattgtggactgtacaaagagagcgtcatcagttgttcttttaacactgagacttgtcaatatgaactaggaaagaatgatgataaagaacaccgaaggtacaggaggactctgggtgaggcatagtgccatcagatcagaatcctgagtatttcatgcaactgaaaagcctctggcttcaataataactcatggggaaggaaagttgttccacacccaaagagatcatattttgtaacaagccaatgagatcaagatttgtttaggtcaatttcagagcaaacataggttatcagatgcatccttcaatatggtttactagaatctgaaaattgcatgcttcttttgaagaaaaggatggttaaaggatactgctatgatttttattctgaaattcatcacaatactgtatatgtttataaggaaatctgctatctggtcagtgaaaggaactatctttcagacaactaaattcatgtttgtttcatatgaccaaaaatgcagacagaagccggatagtaaagatgccaggcagagagaatacacttgaagtagttggaaactacttgggtttaaattattggttgaaatctactggggttcaaattccatccatgccactcactgtttgacattgatcaatttagctaactcctctaagtctcaatcttttcatccataaagcatttcttcatctataaaacagggaagagtaatgagaaaattcagataaagcagtcaacacacgttcataattatgttaatttacaactaacgtatcttgaatgcttaccatgggccaggcactgactgggctaagtgccttatgtatatttttttcttttttaatcattatgtgcagtaggtgttgtgattatatcctttttacaaatgaaataaaaggcaaagatgagggagccaggacccaaaccctctgccctgtggtgggccccaaagtctgcatttgaaattcttggctttcttgcatctttctgttgccatagagagcatcaccatcaccttttagataggaggtggggttcagatgatcttcaaggttgcttacataaatcttttcttgttgtcacatgcagacacacaaactctctctctctctctttctgagaggtcagcccattttcctgtctgctacaagttgtgccattttcagtattgttctaaaatcagattagtcacaatagatcctatagtgcttccattaccaatttgtacagtcagtctacaatattgcttataaaaatgttcttttggagccattgtgggtctctttgaacatttctgcaatgttgtctgtacagacagtacatccaagaagaatgaggatggggaatgacgtaattaagcctgttgggaagctctctctctaaggtgaactggagtgtcagatggagttacggtgcttctgaacaccattccccaaagctccattttggaatcttagatttaaaaggcactttagcaaatactgtaaaccttttctctcatgctgaattactttggtaatattcttcatagttatctccacttgctgtagttggagagggaagcacaatcttctgggaattttaactttatttctggaatctactaacagatagttcattcagccgtttttctttatgcaactttcattctctgatgtgagttctgcctttgaaagcagaacagaatagatatatattttattcatgaaaaactttaaaatttgaaggtaacagtcaaatttcactcatgaggcagggattgggtctcattttgtgctccattataaccatagcacctagcgctgtgtaggaaatatagttggtactcattaaatttcttgatgaatgactaaatgagttctctcttttctccactagagtgactgaaagaaagtattatatttctttgacatgtgaagcataaaatgtgaccattaactcttctcaaatgtgagctccatgtggtgaaggaccacatatcatatgtaagcaggtaaattcatgattgagtgaataaatcctgaatgctgctctagtagtggttgtaacgttttaccctgccacacttggccatgacttgttggagaaaaggtaaatatctgatttaatctgggccaatcaaattcctctcctgggtatttggaattaagacctatctctggggagatgagctgaaagttccaacactaaggctgaaagtgaggactagttaaagcctcatggaggctaacatttctaggagaaccaagagtaacaaagatgagagacacgtgacctcagggagaacatgaggtgggccatatggctgtccagatacctgatggctttccagcccgtggctccagtttccatgatggtcagctgttcttcatttctttgagatctctgaatccttacaataatcaccgtcccaccctgacagaaaaacagagaaacacacacatgtgctgttattgaaggttgcctatgttagttctgttcctaccactctataaaacagtttattcaatctaatataacactaattcttgactcatattctgcacacagataactaaaacacccagatcttttcacacaaactgcagtttaaccaattgtataatagaatttttggaaagtttgctcattcacccattcattcaacaacaatatattaagcaactactgtatgtgaatggactttttatagtttttactatttgtctgtcagttgtcactttttgctgctgcgaaggatgttgtcttttctttccatttacttattagcagtggaattgagtaatgatgagtaaaataaaagctcgtaagctctgaatgtgggcactacatgatgtttgtcatatctattttgagtgtggaaagaacattttgcctactgtctgtttccctcttagattctgggttgttgtaggtatagtaagtaaatattggatacttgaattgttatgtgtggttttatatatacatttatatgcatatatcttatataaatttaaatctaaatatatatacatagctaggaaaaaacaaagtaaggttgtaccagagtaaagaaaagttgaccatatttaaataaataaatgtgattacatttacagaccagcagatgtacttgggactgtcacctctgtgtatcttgaataaaactgaaggttaaacttgtcccttcattgggctttaaattaaaaaatttttttttaaaattatcttaggtacataataggtatatatatatttatgggcacatgtgatattttgatacaggctacaatgtgtaacacctcagggtaattggggtatgcatcacttcaagcatgtattatttctttgtgttaggaacattccaattccactctttttctttctttctttctttccttttctttctttcttttttcgtctttcttttctgtttttcttttgctctccttccttcctttctttctctctttctttccttctctctttctttcatctttctttcttctccttccttccttcctttctctttctttctttgtttctttctttcctctttctttccctccctctctccctccctctctcttcctttctttccttctttctttctctttctttctttctttctttccctccctccctctccttccttccttccttcctttctttctttctttctttctttctttctttctttctttctttctttctttctctctctctctctctctttctttctttctttctttctttctttcttttctttctctttcctctttctttccctccctctctctctctctctttctctttctctttttttctttcttcttcttcttcttttttttaacaggatctcattccatcaccctggctggagtacagtggcatgattatggctcactacagcattgaatcaacctcctgggctggagcaatcctcccatctcagcctcccaagtagctgggactacaggtgcacaccactgtacctggctaatttttgtattttttgagacagggttttcttatgttgcccaggttggtgtcaaactcctgagctcaagcggtctgcttgcctcagcctcccaaagtgctaggattacaggtgtgagccaccatgcccagcctagttattaaaaaatatacaattaattattgttgactatagtcaccctgttgtgctaccaaatactagatcttattcattctatctaagtttatttttgcacctattactcatttccccaccccctaccactcccaccctgctatccttcccagcctctgctaatcatccttctactctctatctcaatgggttcaattgctttaacttttagctcccacatgtgagtgagaacatgagaagtttgtctttctgtgcctggcttatttcaccgaatataatgtcttccagtttcatctatgttgttgcaaatgacaggattttgttcttttttattgctgaataatacttcattatgtatatgtaccacattttctttatttgttcatctgttgatggacacttaggttgataccaaatcttggctactatgaatagtgctgcaataagcatgtgagtgcagatatctcttcaacatactgatttcctttcttttggatatttacctagcagtaggattgctagatcatgtagtagttctatagttttccaaggaactttcatattgtttgccatagtggctgtactaattgacattcccatcaacagtgtatagggactccccttttgccacatcctcaccagcatttgttactgtctgtcttttggataaaaacctttttaactacagtggaatggtatctcattgcacttttgatttgcattactctgatgatcaatgttgttgagtatttttttatatacctgttggccatctgtatgtcttcatttgggaaatttttattacagatgttttgcccatttgtaaattggattatttgattttcctcctatagagttgtttgagttacttatatatttgggtattaatcccttgtcagatggatagtttgcaaatattttctcccattctgtgggttgtcacttcactttgttgtttctcttgccacatagaagctttttagcttgatgtgatctcatttttccattttcactttggttgcctgatcttttgaggtattactcaagaaatagttgccaagaccaatgtcctggagaatttcccca

SEQ ID NO: 23 - DNA, 75164 bp, Homo sapiens
ctcatatccaaactactctcgacatcagtgcttttcgattgcggcacaaaggagggtgagcctgtcacccaccacacccatcacctcctcccctgtgggacctgacacggccccaccaggtaatgcgaatgcaccagtgttctcaggtactccttaggctgaattccgccaaggggcccactgggagacataaaggcgaggcagttggcagctacctggtgtttccatcttcagaggggagtccgaggatactgtggaagctgaggtagcactgctgacagcaagaggggtggcgtgacctgtggatactgaggaaaggctggtgacaggaagaggggtggcgtgacctgtggatgctgaggaagtgtcggtgacaggaagaggggtggcgtgacctgtggatgctgaggaagtgtcggtgacaggaagaggggtggtgtcacctgtggatgctgaggaagtgctggtgacaggaagaggggtgccgtgacctgtggacactgaggaagcgtcggtgacaggaagagaggtggtgtgacctgaggatgctgaggaagggatggtgacaggaagaggcgtggtgtcacctgtggatactgaggaaaggctggtgacaggaagaggggtggcctgacctgtggatgcagaggaagtgtcggtgacaggaagaggcgtggtgtcacctgtggatactgaggaaaggctggtgagaggaagaggggtggcgtgaccggtggatgctgaggaagcatcggtgacaggaagagtgctggtgtcacctctggatgctgaggaagggctggtgacatgaagaggggtggcgtgacctgtggataatgaggaagcattggtgacaggaagaggggtggtgtcacctgtggatgctgaggaagtgctggtgacaggaacaggggtggcgtgacctgtggatgctgaggaagggctggtgacaggaagaggggtggcgtgacctgtagatactgaggaagtgctggtgacaggaagaggggtggcgtgacctgtggatactgaggaagtgtcggtgacaggaaggggggtggcgtgacctgtggatgctgaggaacggctggtgacaggaagagaggtggcgtgacctgtggatactgaggaagtgtcggtgacaggaagaggggtggtgtcacctgtggatgctgaggaagtgctggtgacaggaagaggggtggcatgtcctgtggatgccgaggaaacgtcggtgacaggaagacgggtggtgtcatctgtggaagctgaggaagtgtcggtgacaggaagaggggtggcgtgacgtgtggatgctgaggaagtgtcggtgacaggaagaggggtggtgtcacctgtggaagctgaggaaaggccggtaacaggaagaggggtggcgtgacctgtggatgctgaggaagggctagtgacaggaagaggcatggtgtcacctgtggatactgaggaagggatggtgacaggaagaggggtggcgtgacctgtggatgctgaggaagcgtcggtgacaggaagaggggtggtgtcacctgtggatactgaggaaaggctggtgacaggaagaggggtggcctgacctgtggatgctgaggaagtgtcggtgacaggaagaggggtggtgtcacctgtggatgctgaggaagcgtcggtgacaggaagaggcgtggcgtgacctgtggacactgaggaagcgtcggtgacaagaagaggggtggcgtgacctgtggatgctgaggaagtgctggtgacaggaagaggggtgacgtgacctgtggatgctgaggaagggctggtgacatgaagaggggtgacgtgacctgtagatactgaggaagtgctggtgacaggaagaggggtggtgtgacctgaggatgatgaggaagggatggtgacaggaagaggggtggcctgacctgtggatgctgaggaagtgtccgtgacaggaagacgggtggtgtcacctgtggatgctgaggaagtgtcggtgacaggaagaggggtggcgtgacctgtggatactgaggaagcgtcggtgacaagaagaggggtggtgtcacctgtggatactgaggaaaggctggtgacaggaagaggggtggcctgacctgtggatgctgaggaagtgtccgtgacaggaagacgggtggtgtcacctgtggatgctgaggaagtgtcggtgacaggaagaggggtggcgtgacctgtggatactgaggaagcgtcggtgacaagaagaggggtggtgtcacctgtggatactgaggaaaggctggtgacaggaagaggggtggcctgacctgtggatgccgaggaagcgtcggtgacaggaagaggggtggtgtcacctgtggatactgaggaaaggctggtgacaggaagaggcgtggcgtgaccggtggatactgaggaagtgtcggtgacaggaagaggggtggcgtgaccggtggatgctgaggaagcgccggtgacaggaagagtgctggtgtcacctgtggatgctgaggaagggatggtgacatgaagaggggtggtgtgacctgtagatgctgaggaagggctggtgacaggaagaggggtggtgtcacctgtggatgctgaggaagtgtcggtgacaggaagaggggtggtgtgacctgtagatgctgaggaagtgctggtgacaggaacaggggtggcgtgaccggtggatgctgaggaagtgctggtgacaggaagaggggtggcgtgacctgtggatgctgaggaagggctagtgacaggaagaggcatggtgtcacctgtggatactgaggaagtgttggtgacaggaagaggggtggcctgacctgtggatgccgaggaaatgtcggtgacaggaagacgggtggtgtcacctgtggaagctgaggaaaggccggtgacaggaagaggggtggcgtgacctgtggatactgaggaagtgtcggtgacaggcacaggggtggtgtcacctgtggatgctgaggaagggctggtgacatgaagaggggtggcgtgacctgtggatgctgaggaagcgtcggtgacaagaagaggagtggcgtgacctgtggatactgaggaagtctcggtgacaagaagaggggtggtgtcacctgtggatgatgaggaagtgtcggtgacaggaagagaggtggtgtcacctgtgtatgctgaggaagtgtcggtgacaggaagagaggtggtgtcacctgtggatgctgaggaagtgtcggtgacaggaagagaggtggcatgaccggtggatgctgaggaagggctagtgacaggaagaggcgtggtgtcacctgtggatactgaggaaaggctggtgacaggaagaggggtggcctgacctgtggatgctgaggaagcgtcggtgacaagaagaggagtggcgtgacctgtggatgctgaggaagggctagtgacaggaagaggcgtggtgtcacctgtggatactgaggaaaggctggtgacaggaagaggggtggcctgacctgtggatgctgaggaagtgtcggtgacaggaagaggggtggtgtcacctgtggatgctgaggaagtgctggtgacaggaagagcggtggcctgacctgtggatgctgaggaagtgtcggtgacaggaagaggggtggtgtgacctgtggatgctgaggaagggctagtgacaggaagaggcgtggtgtcacctgtggatactgaggaaaggctggtgacaggaagaggggtggcgtgacctgtggatgctgaggaagtgtcggtgacaggaagcggggtggcgtgaccggtggatgctgaggaagggctggtgacatgaagagggttggcgtgacctgtggatgctgaggaagtgtcggtgacaggaagcggggtggcgtgaccggtggatgctgaggaagggctggtgacatgaagaggggtggcgtgacctgtggatattgaggaagtgtcggtgacaggaagagaggtggcgtgacctatggatgctgaggaagtgtcggtgacaggaagaagggtggcgtgacctgtggatgctgaggaagtgtcggtgtcaggaagaggggtggcgtgacctgtggatgctgaggaagtgtcggtgacaggaagagaggtggcgtgacctgtggatgctgaggaagtgtcggtgacaggaagaggggtggtgtcacctgtggatactgaggaaaggctggtgacaggaagaggggtggcctgacctgtggatgctgaggaagtgtcggtgacaggaagaggcgtggtgtcacctgtggatactgaggaaaggctggtgagaggaagaggggtagcgtgacctgtggacactgaggaagcgtcggtgacaggaagaggggtggcatgacctgtggacactgaggaagcgtcggtgacaggaagagaggtggcgtgacctgtggacactgaggaagcgtcggtgacaggaagaggggtggtgtgacctgaggatgctgaggaagggatggtgacaggaagagaggtggcatgacctgtgaacactgaggaagcgtcggtgacaggaagagaggtggcgtgacctgtggacactgacgaagcgtcggtgacaggaagaggggtggtgtgacctgtggatgctgaggaagggctggtgacatgaagaggggtggcgtgacctgtggatactgaggaagtgttggtgacaggaagaggggtggcgtgacctgtggatgctgaggaagtgtcggtgacaggaagaggggtggtgtcacctgtggatgctgaggaagtgtcggtgacaggaagaggggtggcctgacctgtggatgctgagtaagtgtcggtgacaggaagaggggtggtgtcacctgtggatgctgaggaagtgctggtgacaggaagaggggtggcgtgacctgtggatgctgcggaagtgtcggtgacaggaagagaggtggcgtgacctgtggatgctgaggaagggctggtgacatgaagagaggtggcgtgacgtgtggataatgaggaagcattggtgacaggaagaggggtggtgtcacctgtggatgctgagggagtgtcggtgacaggtagaggggtggtgtgacctgtagatgctgaggaagggctggtgacaggaagacgggtggtgtcacctgtggatactgacgaagcgtcggtgacaagaagaggggtggtgtgacctgtggatactgaggaagtgtcggtgccaggaagaggggtggtgtcacctgtggatgctgaggaagtgctggtgacaggaagaggggtggcatgacctgtggatgccgaggaaacgttggtgacaggaagacgggtggtgtcacctgtggaagctgaggaaaggccggtgacaggaagatgggtggcgtgacctgtggatgctgaggaagtgtcggtgacaggaagaggggtggtgtcacctgtggatgctgaggaagcgtcggtgacaggaagaggggtggtgtgacctgaggatgctgaggaagagctggtgacaggaagaggggtggtgtcacctgtggatactgaggaagcgtcggtgacatgaagaggggtggcgtgacctgtggatgctgaggaagggctagtgacaggaagaggcgtggtgtcacctgtggatgctgaggaaaggctggtgacaggaagaggggtggcgtgacctgtggatgctgaggaagcgtcggtgacatgaagaggggtggcgtgacctgtggatgctgaggaagggctagtgacaggaagaggagtggtgtcacctgtggatactgaggaaaggctggtgacaggaagagaggtggcgtgacctgtggacactgaggaagcgtcggtgacaggaagaggggtggtgtcacctgtggatgctgaggaaaggctggtgacaggaagaggggtggcctgtcctgtggatgctgaggaagtgtcggtgacaagaagagggatggcgtgacctgtggatgctgaggaagggctggtgacaggaagaggggtggcctgacctgtggatgctgaggaagtgtcggtgacaggaagaggggtggcgtgacctgtggatgctgaggaagtgtcggtgacaggaagagaggtggcgtgacctgtggatgctgaggaagtgtcggtgacaggaagagaggtggcgtgacctgtggatactgaggaagtgtcggtgacaggaagaggggtggtgtcacctgtggatgctgaggaagggctggtgacaggaagaggggtggtgtcccctgtggataatgaggaagcatcggtgacatgaagagcggtggcgtgacctgtggatactgaggaagcgtcggtgacaagaagagaggtggcgtgacctgtggatactgaggaagcgtcggtgacaagaagaggggtggcgtgacctgtggatgctgaggaagggctagtgacaggaagaggcgtggtgtcacctgtggatactgaggaaaggctggtgacaggaagaggggtgtcctgacctgtggatgctgaggaagtatcggtgacaggaagcggcgtggtgtcaccagtggatgctgaggaaaggctggtgacaggaagaggggtggcctgtcctgtagatactgaggaagtgtcggtgaccggaagaggggtggcatgacctgtggacactgaggaagcgtcggtgacaggaagaggggtggcgtgacctgtggacactgaggaagcgtcggtgacaggaagagaggtggcgtgacctgtgggtactgaggaagcgtcggtgacaggaagaggggtggtgtgacctgaggatgctgaggaagggctagtgacaggaagaggcgtggtgtcacctgtggatgctgaggaaaggctggtgacaggaagagaggtggcgtgacctgtggatactgaggaagcgtcggtgacatgaagaggggtggtgtcacctgtggatgctgagttagtgtcggtgacaggaagaggggtggtgtcacctgtggatactgaggaagcgtcggtgacaagaagagaggtggcgtgacctgtggacactgaggaagcgtcggtgacaggaagagaggtggtgtgacctgaagatgctgaggaagggatggtgacaggaagagaggtggtgtcacctgtggatgctgaggaagcgtcggtgacaggaagaggggtggtgtcacctgtggatgctgaggaagggctggtgacaggaagagggatggcctgacctgtggatgccgaggaaacgtcggtgacaggaagacgggtggtgtcatctgtggaagctgaagaaaggccggtgacaggaagtggggtggcgtgagctgtggatactgaggaagtgtcggtgacaggaagaggggtggcctgacctgtggatgctgaggaagcgtcagtgacaagaagagggctggcgtgacctgtggatgctgaggaagggctagtgacaggaagaggcgtggtgtcacctgtggatactgaggaaaggctggtgacaggaagaggggtggcctgacctgtggatgccgaggaaacgtcggtgacaggaagacgggtggtgtcatctgtggtagctgaggaaaggccggtgacaggaagaggggtggcgtgaccggtggatgctgaggaagtgctggtgacaggaagaggggtggcgtgacctgtggatgctgaggaagggctggtgacatgaagaggggtggcgtgacctgtggataatgaggaagcattggtgacaggaagaggggtggtgtcacctgtggatgctgaggaagtgtcggtgacaggaagaggggtggtgtgacctgtagatgctgaggaagggctggtgacaggaagaggggtggtgtcacctttggatgctgaggaagtgtcggtgacaggaagaggggtggtgtgacctgtagatgctgaggaagggctggtgacaggaagaggggtggtgtgacctgtggatactgaggaagcgtcggtgacaggaagaggggtggtgtcacctgtggatgctgaggaagggctagtgacaggaagaggcatggtgtcacctgtggatgctgaggaaaggctggtgacaggaagaggggtggcgtgacctgtggatgctgaggaagggctggtgacatgaagaggagtgacgtgacctgtggatgctgaggaagtgctagtgacaggaagaggcgtggtgtcacctgtggatactgaggaagtgtcggtgacaagaagagaggtggcctgacctgtggatgctgaggaagtgtcggtgacaggaagaggggtggtgtgacctgtggatgctgcggaagggatggttacaggaagagaggtggcgtgatctgtggacactgaggaagcgtcggtgacaggaagaggggtggcgtgtcctgtggatgctgaggaagtgtcggtgacaagaagaggggtggcgtgacctgtggatgctgaggaagggctagtgacaggaagaggcgtggtgtcacctgtggatactgaggaaaggctggtgacaggaagaggggtggcctgacctgtggatgctgaggaagcatcagtgacatgaagaggggtggtgtgacctgtggatactgaggaagcgtcggtgacaggaagaggggtggtgtcacctgtggatgctgaggaagggctagtgacaggaagaggcatggtgtcacctgtggatgctgaggaaaggctggtgacaggaagaggggtggcgtgacctgtggatgctgaggaagggctggtgacatgaagaggagtgacgtgacctgtggatgctgaggaagtgctagtgacaggaagaggcgtggtgtcacctgtggatactgaggaagtgtcggtgacaagaagagaggtggcctgacctgtggatgctgaggaagtgtcggtgacaggaagaggggtggtgtgacctgtggatgctgcggaagggatggttacaggaagagaggtggcgtgatctgtggacactgaggaagcgtcggtgacaggaagaggggtggcgtgtcctgtggatgctgaggaagtgtcggtgacaagaagaggggtggcgtgacctgtggatgctgaggaagggctagtgacaggaagaggcgtggtgtcacctgtggatactgaggaaaggctggtgacaggaagaggggtggcctgacctgtggatgctgaggaagcatcagtgacatgaagaggggtggtgtgacctgtggatactgaggaagtgtcggtgacaggaagagaggtggcgtgacctgtggatgctgaggaagtgtcggtgacaggaagaggggtggtgtgacctgtggatactgaggaagtgtcggtgacaggaagagaggtggcgtgacctgtggatgctgaggaagtgtcagtgacaggaagaggggtggtgtcacctgtggatgctgaggaaaggctggtgacaggaagaggggtgacgtgacctgtggatgctgaggaagtgtcagtgacaggaagaggggtgctgtcacctgtggatgctgaggaaaagctggtgacaggaagaggggtgacgtgacctgtggattctgaggaagtgtcggtgacaggaagaggggtggtgtgacctgtggatactgaggaagggctggtgacaggaagaggggtggcgtgacctgtggatactgaggaagcatcggtgacatgaagaggggtggtgtgacctgtggatgccgaggaagcgtaggtgacaggaagaggggtggcgttgctgatgagggccgtggtgaaggttttaccagaccctgaaggtgacagagtgtgggtctcggtttgtggagatgtaagcccagtggatgtgatcgatggaggtgtgggtgggactgttgagaaggtgtcggttgcctgggacgccaggctgatagtgtcagaccctctgctggttcttgtcctctgagtctgggccatccgggaaatggcggctgtctcctgaggagaggcactgggagaagttgggcttgactgtcctgtcggtctccctgcagtggaggcctcagagagggtgggatgaaaggtgccggggacgatcgaagacgccattcctgtgcttactgggatggcaccatgactggctgaggcggacagcaattcggttgttgactgggttgtgtgactgtccctggaggggtttgatgaaaaccttgtcgtctctcctgaggtggatattccttcgcttcctgaaggtgttgtgccactcgccccggatgaggaaggggtagctgtgcccgctgaggtggttcgtgaccctgaggaggccggttcgctggtctgtgtttgtccagaggcctctgtgctctcagcctggtgggtatgggtcatggctgctgctgtgtcaggtgaggtgctggcagaggctgatgtccattgtccttctgggccccctggtgttgacactacagagttggccagagtaagggcacctgttttggaaagtgacgtgcctcctgagggccccagggtggcatcatggctgctgggtgctgcctgcagtgctgtggtcggggcctgggttgtgtgaccatccccggtgggagctggggcaaaggttgttgctgcacttatggtgggtgcgtcctgaggaacaatttctgagggcgagtgcccactggctgtgaaggaagaacctggggtggtgactgtcttggtgtcagtcatgggggagacggacctcgtggtttgtgattcttgtgtggtctgcggggcttgagtgtgacccctttgggaaacagctggtgattcctgaggagaggtgcttgtggaatgtattgttgaatgatttgttgatggtgccgttgtaatttgttgggatgtgtgtctatccagcataggtgaagaagatggggatgtggccgtttttatcatctgagtcacactgtagcttgggctgctgagaagagcctctccagtggtccccgtttcttgtgtccattgtgtctgggcgcctgcccctgttgtttttgggagagttgtgctgtgggaggagtatgtggtgggctctcctggttcccctattgctgagaccttagaggggacccttggaatagtgccagctgtccctgtagatggatttcctgtgacaagcctagtggcagcacctgttgatgttgagggcagttctgtttgtgaccaagttgtgtggcctttgctggagaatgaggaaggccatgttgttgtttcatgtagagtaaatatttcttgagacacacctggagagaatgagctcctctcatgaggccgtcctgtggtctctgcaccttcactctgctgggtgtggaaagctgtggatatttttggaggtagagaactgggggagagtgctgttgacagagtgtctgaccaccatatggttgaaactttggaagtgattgcagaaatggttccacttacagatagtgatgtctcctctgtgtttccaagagtagagtctctggaggttggcattctgaacacctttgatgttaccaggaatgtattgctgacactggaaggggatgaggtggttgtttcaccagaagggaatgtctcctgagaaactgttccacttgggttgaatccacttggtgaggataaaacagttgatgttgtaaccggtgtgagggtgttgagggtgttgatttgagatactctggtggtctccacgctctgagtctggtggttcttagaaaaagctgttgtgtcctgagtagaagtccttgagaaagttgctggtgattgtccttctggatcaaatgttactaaggctgctgaggtgactggcataagacttccagtaacaggtactgatgatgtctcccctgggtttccaagagtggagcctgtggaggttgtcactgttatcttctctgatgtcatcatggatgtgtttgtgacactacagagggatgaggtagctgtttcacctgaaggagatgtcttctgagaaacagtccctgtcacattgtgtacacttggagagaaagaaggagttgaagtggttctgtgtgttagggtgctggtttgagattccctggtggtctgcgtgctccgagtccagtggttctgagaagaagctgatgtgtcttggatagaggtcctccaggaagttgttcgtgattgtccttcctgtccagctgttattgagactgctgaggtcactggggtagaactttcagttcctgctgttgatgtctcttctgtgtttccaagagtggagtctgtggaggttgtcattgttatagtctttgatgtcatcatgagtgtgttggtgacactggagggaaatgatgtggtcatttcatctggaggagctgtctccatcacattgtgtacacttggggaagaaaaaagagttgatgtcatcatctgcgtgagggtgtcggtttgagctttgctggtggtctccgtgctcttagtctggtggttctgagatgaagctgatatgtcctgattagaggtccttgaagaagctgcagttgattgtccctctagtgtcgctgttgttgagcctgttgaggtgactggggcagcagttttacttccagttattaatgtgtcctctgtggttcctggagtgaaccaaaataggcaagcagagagctaaatcatgaatgaactcctattcacaattgctacaaatagaataaaatacctaggaatacagctaacaaaggatgtgaaaactaccattcttcacagaatgagaacaaactactttaaaattcatatggaatcaaaaaagaacccaaatagccaagacaatcctaagcaaaaagaacaaagtgggaggctacctgacttcaaactatactacaaggctacagtaaccaaaacagcatggtactggtaccaaaactgacatataaaccaatggaacagaatagataccttggaaataagaccacacatctacaaccatctgatctttgacaaacctgacaaaagcaggcaatggggaaaggattctctattcaataaatggtgctgggaaaactggttagccatatgcagaaaactgaaactggaccccttccttacaccttatacaaaaattaactcaaggcaggttaaagacttacatgtaaaaccccaaaccatgaaaaccctagaagaaaacctaggcaataccattcaggacatagacataggcaaagattttatgatgaaatctccaaaagcacttgcaacaaaagctaaaattgacaaatgggatctaattaaactaaagagctctgcacagcaaaagaaactatcatcagagcaaacaggcaacctacaaaatgagaaaatttttgcaatctaaccatctgacagaggtctaatatccagaatttacaaggaacttaaatttacaagaaaaaaataaacaaccccatcaaaaagcaggcaaaggatatgaacagacacttatcaaaagaagacatttatgccaccaacaaacatatgaaaaaaggctcatcatcatggatcattagagaaatgcaaatcaaaactacaaagggatatcatctcacaccagtcagaatggcaattattaaaaagtcaagaaacagcagatgctggcaaggctgtggtgaaataggaacgcttttacactgttggtgggagtgtaaatcagttcaaccattgtggaagacagtgtggcgattcctcaaggatctagaaccagaaataccatttgacccagcaatcccattactgggtatatgcccaaaggaatagaaatcattctgttataaagatacatgcacacgtatgtttactgcagcactatttacaatagtaaagacatgaaaccaacccaaatgtccatcagtgatagactggataaagaaaatgtggtacatatgcagcacggaatactatgcagccatgaaaaaggaatgggatcacgtcctttgcaggtacatggatgaagctgaaagccatcatcctcaacaaactaacaggggaacagaaaaccaaacactgcatgttttcactcataagttggagttgaacaatgagaacacatggacacagagaggggaacaacacacactggcgcctgtcagggacgggacaaggggaggaagagcgtcaggataaatagctaatacatgcaggtgatgggttgataggtgcagtaaaccaccatggcacatatatacctgtgtaacaaacctgcacgttctgcacatgtatcctgaaacttaaagtaaaaaatgaaaagaaataaaaagaaaaaatgaaaaattaatatatcacaactgtacatatttgggggataaaaaaataataagagatggggccgggcatggtagccccacctgcaatcccagcactttgggaggctgagatgggtggatcacttgaggtcaggagtgcgagaccagcctgggcaatatggcaaaaccccgtctctactagaaaaaaaaatacagaaatagctgggcgtggtggtgggtgcctgtaatcccagttactcaaaaggctgaggcaggagaattgcttgaacccaggaggtggaggttgcagtgagcagacatcatgccacttcactgcagcctgggcgacagagcaagattctgtctcaaaaaaaaaaataaataaataaaataaaaaaggagagagagatgggggtgcaggattcccacagaggaaggcccctgataagcactgcttcaaatcgcctagaaaaagcacagttgcaggaatatagccaatggtcttctccagctcccgcctgtcttccttgtgaggaggaaggtgaggttagactagaatggtgaattaactgtgttaaactccatgggaagaagcaaacagtacccctgctataagccgggttaactctctcaacttgaattatagcattatctttcttaaaaataaattaaatttctacttttctttttcgttgttaacatctgtgccaatctggtaaaaaacccaaggggtaaatgcatatactcttgccctggtcacagactaccaagaagctaatattattgaccataaccactttttaaaaaaaaattatttcccaggcagaggccaggcatggtggctcatgtctgtaatcccagcattttgggaggccaaggtgggaggatcactcgaggccaggagtttgagaccagcctgggcaagatagcgagaccctgtgtcttaaaaaataaaaataataataataataataaaaatagatattaaataaataaagaaaaatatttcccaggcagaatgtttaaatattggctttttttgtttaaaatatttcacagcacctgcactagccacataccatcttcgtgaatattaccttagcctctgagtctctgaaccaagaagaaaccaagaaaacttgcctttttttttctcttagaaactgactcttttgggttttcattagttccctagctgttctcaaacttctttcttttttctttttaaacatatatatatagagagagagagagagagaagaaagagagagagagagaaagaaagagagagagagaaagagagacagggtcttctgtcacccaggctgaagttcagcggtgtaattggccttctgagtagctgggactacaggcacacacaaccatgcctgggtaatttttttatttctgtagaggtggaatcttgctatgttgcctaggctggtgtcgaactcccggcctcaagcgatcctcctgcttcagactctcaaagtactgggattaaaggtgtgagccaccgctcccaccctttttttcaacctcagtgctcctagatagttggcaagatgatactcagagagacaaagtctcagggaagaattcagcttcaagtccactttctggaattgactgtaattcgccaccttctcttcttcagacagtaacttagactctcaagtgagtgataatggttatgaaccagctctaattgttaaaaaagtgactcacgtgcaagcttctgcacttcattaatagtaactgcttactggtgacacacttgtaaaccgacgtggacaaaggcacgggctgaaccgcagagccctctgggaggtccctgggcccctggcttaatccaaaatgactccacttcaactttaaacggaaacttcctttagttggaattaggttgagatttgttgataggactctaaactcgatgcctgctttctcctagagaaaatttgcaaaacttggtttctccaaataaggtttaaatttaaaaacattctctatgcagttatttttaaccttatttcatttccctgataacataattaagagcatttgtctatcatcaggctttgagtagacaggagctatctaggggccaaactttctgaatgtgtaaattcttggcaattaacatcttttcagagcctgcatcacctctgctaaaatcagtgtcagcagcagaagtttcatgacagcaccgtccttttttttaaagtaaagatttttgtagttctttataaaagtggcacagctccatttcagcaatatggaagaagagataagcctctaatagcaaaaccagccaatgccagataaatacaggttataaatgtaataaatgttttctaatgcagaggtgagatgagaagaaagaaagggaaacactcaggagtgaagaagttaacaactaagatggtgagtcaatgcccttggaaatgtgctgactgaaaggctgaaaaaggaaaggaagcaagaccctcggtcacgacactgaactgagtttccctgcaaaaagctggaaccgccagcaaaaaaggtagactagaaagaccaggaagaaaaaagaaaaaggaagcagaatgaaggatatagtaacagaccagaactcactatagaaacaattaaaaatggaataaatgaagccaaagattagttctttgaaaataaaacaaatacctggcaagagaaagaaagtgggggaggggggtgggaggagggagagagagagacagaaaagacacagatatcaagattattagaaacaaaaaagggtacataacttcagaaaaaaaatttaagagacagtgctctgatgaatttataccaaaaagtatgaaaacttagataaattggatatactgtccttaaaaatataatttatcaaaaatgaattaagaaaaaaacctggctaaaaactattttattttatttatttaattttatttatttatttttttgaaacagagtcttgctttgttgcccaggctggagtgcaatggcatgatctcagctcactgcaacctctgcctcccaggttcaagattctcctgcttcagcctcccaagtagctgggattacaggcgcatgccaccacgcccggctaatttttgtatttttagtagagactgggtttcaccatgtcgtcctggctggtctcaaactcctgacctcaggtgatctacccacctcggcatcccaaagtgctgggattacaggcatgagccacctcgcccggccactataaactattttaaattgaatcagcagtttaaaaaatataatctaggccgggtgcggtggctcacgcctgtaatcctaacacgttgggagggtgaggcaggcggatcatgaggtcaggagattgagaccatcctggctaacacggtgaaaaaaaaattagctgggcatggtggcaggcgcctgtagtcccagctactctggaggctgaggcaggagaacggcgtgaacctgggaggcagaggttgcagtgagcggagatcatgccattgcactccagcctgggtgacaaggtgagactccgtctcaaaaaaaaatatgtatatataatctatccaccccacaaaaaaatgcaggctaagatgagtttacaggcaaatcagacattcaaggaacaggtaatttcaattctatacaaacatattcagagtttggaacaggaggaaatgatctactaataattttataaggttggaaaccaaagataggataagaaagacaaactatagattaataagtcccagtaataatacatggaagcatcgtaaataaaatattagcaagccaaagtgcatcatggccgggcgcggcggctcacgcctgtaaccccaacactttggcaggccgaggcaggcggatcacttgaggccgggagttccagaccagcctggccaacctagagaaaccccgtctctggtaaaaatacaaaaaatttgtatttttttggattacaggtgtgtgctgggcttggtggcacacacctgtaatcccagctactcaggaggctgaggcacgagaattgcttgaacccaggaggcagagattgcagtgagccgagattgtgccactgcactccagcctggtgacagagcaggactctatcttaaataaataaataaataaataaatattttaaaagtacatcatgatcaagctgagtttaaatcagaaatgcaagataaagacaatgctttcttaatgtaaatcaccatataaacagaacggaggggagacacaatcaccacagcagatacaggaaagttatttgataaaagtcaacacttactcctgttaaaactcctagcaaactaaaaagagacgttaactcttttaacctgataaacaatgtcaattataaccccgtgtaaacattatacttaaaacaatagaaacgtttctgtaaaatcaggaataaaaacaagatgccaacaatcactgcttctaatcaacattaggttgaaggttttagctggtgaaataagacgagaaaattaaacaaaaagtatgagagtacagaaatgtgattttgggtatggaagggatgaaacaagcctatggttatttgcagataacataattgtttacatagaaacttcccaaacatatacattattagcaaagttctatatccataatcaaaattttaaaaataattgcattccagctgggtgtggtgattcatgcctgaatcccagtgctttgagaggctgaggcaggaggaacacttgaggccaggagttcaagaccagcctgggtaacatagcaagatcctgtctctacagaaataaaaaataaaaaaataaaaaattagctgggcatagtagcacacacatatagttccagctactcagaagttgaggggggaggatcacttgagcccaagagttcgaggctgcagtgagctatgatcaccccactgtactccagcctgcatgacagagggagactctgtctcaaaaagagatttaaaaacaaaataaaactgcattcctatatatcagtgaaagagaaaatatttttaagactatagtgtttatgatggtgaccaaaaaaagtacataaaaataaatctaacaaaagatgtgcttaatctttatggacaaaattgtacaactgcattgaaatatgccaaagaaaacacacatactggttacgtgcatttgggaacatttatagttgaaagatcaaaacccataatcttgctaccagacaatgcttccttccaggatgtttttatgctttaaaaaatatatagtttaggccaggcgtggtggctcacacctgtaatcccagcgctttgtgaggctgaggtgggcggatcatgaggtcaggagatcgagaccatcctggctaacagggtgaacccccgtctctactaaaaatacaaaaaaattagccgggcgtggtggcgggcgcctgtagtcccagctactcgggaggctgaggcaggagaatggcgtgaacccgggaggcggagcttgcagtgagccgagattgcaccactgcactcctgcctgggtgacagagtgagactccgtctcaaaaaaaaaattaaaaattaaaaaatatatatgtatagtttaacttattcagtatacataattttgtatcctgcctttttagccatacctgatatgagcatttcttcaagatactagcttcgtaaacatagcctgagaagacgcacatcttttatgtcttggatggcagttccttgcttcccccttttggagtcctacaagagctggctcagggggactgggagagctcagctccatagtaaaatctagggtgctgtataaaaactccccctgctgagctctggtggcctccttcctaacaaagccactcccccaactggaagcgttgttacccttcccattttctgttaaacaggagcaggtctctctcctgtaccacatcctgctgtgtgtccaccatacccacctctctgtgcaatgagagctcgggggtcatgtggactccactgctccctgctcgcaatttctccttaatacatcttactttatgcccgttctgtgtgttgctagtatgtatgtgtgacactgtgtgtgtgtgtgtgtgtgtgtgtgtgtgtgacactgtgtgtgtgtgtccctgcccttatggaacattggacatagcctttaaacatttttttttccagatggagtttcactcttgttgcccaggctggagtgcaacggcacgatttcggcccactgcaacctccacctccgtgattctcctgcttcagcctcccaagtagctgggattacaggcatgtgccaccatgccaggctaattttttgtatttttagtggagactgggtttcaccatgttggccaggctggtctcaaactcttgacctcaggtgatccactcacctcagcctcccaaagtgctgggattacaggcgtgagccaccgcgcccggcctaaacactaaataataagccatcatagagaaagctcatattgttaacttactgttggacaattaggatatttccaatgtattgcttattttaaataaagccctgatgactatcttcgtgtctaatgttttgtttacattatttcagctcatctccttaacataaatttctatcagtggaattgctggtttatgccgttataaaatttttcatgttattaatacagactgccaaatttctttgcagaaagcttatgccaatttacagacctgttggcagtgtgcaagagtgtgcctgtttccccatatccctagcctgtgaacaaaggggcatgatccaggacaggccccatccctcacctgctgctctttgcttcacagcatcgactgaaaatcggccaggtgcggtgcctcacacctgtaatcccagcactttgggaggtcgaagcgggtggatcatttgaggtcaggagttcaagaccagcctggccaacatgatgaaaccccatctctactaaaaatacaaaaattacccaggcatggtggcgtgcacctgtaatcccagctactcaggaggctgaggcaggagaatctctcaaacctgggaggtggaggttgcagtgagccgagatcgcgccactgcactccagcctgggcgacagagcgggactccatctcaaaaaaaaaaaaaattcttgctaaacagggctgtgtcctggtagtcctccttttaaatctttatttagagaacttgctcatcttgagccaagttgattagagtttcctgctgccgcaaataggagggcaagtgagtcactgcatgtggaggacatagttttattgtctaggggagaaggcgctgtcaaaatctctcaatctgttgggcttgtgaggaggaagagattagcattcgttacgacaaaactacagttattgcatttgtctttcaccatcatttaaacaatacctctgaagccactcctgcaatagattgattattcagctgtttaggaaaacaatttgcagataactcaatctactaagcttgagtaggttatttgtaggtaagaaatcctgtgttcaagtatgacctatctttacaaagaagaaaaagaaagaaatcctagtggatggagagactatggagaatgatttttggtaagaaaatggttctcagctgggcatggtagctcatgcctaaaatcccagcacggacaggcagaggcgggaggattccttgaggccaggagtttgagaccagcctgggcaatagctcaagaccccttctctgaaaaaaaaaaaaaaaaaaaaagtggttctcaaaaggcagagggtgcatcagcattttaacacatgtccagagtgattctgatgcaggtggtccgtggaccccacgttcagaaacacttcccttaaaataaaatgatagtatccactcttaacaatgtttgtaagccaaaaccatctcgctgaagttgtcaggcagagaaatttgaagccttgatcaagttttattctaaaaaatactcatagccttgttcttgctgctcaagtgttggccagaatgaactgaccttggctctcaccaggatgcaagtcaggcccttcaggttccgtcagattgtcagacaactgaaacttgttctcactctggccaaacgcataaacttggggagcagagagctgggagatttgcgcctaaagagttgatattggagagaaacaggtctctcctctctcttctctccccgtgaccctccattttctacttcactgaaagaaccaaagccgtgcccttcatctccttcaatgcccagagccttctccgcaccctccccggggccccggggctccctcctgcccggatggctcactgctctgcctctgtgtctccgacgttctttctgcctttctccttctctcctgcctgtgagcatgttcaggtgtctgttggcctaaaacaagtctgtcatccgtctgtgtcctcctcgtccctccagcagcatgaaagccgggcttcccctgccgcctcttctttaccacgcactgctcgctctgcccccacctcactcacttcgctcaagccgttttcctcagagctaccagaatctccttcccaacagcaaaaacgattttctccagtcctcacgcgtctcatcagttcggccccatccattcattcattcatgaatctgacagatgtgtattgcgcccccccctccacgtgctctccctggccggcggccccgtgccaccacccagcctcaccctcattgaagctgacgggtcctgctccaccgtccacgctcccgggccctccactccactccccttgccacctctctcccccgctccacgcccagatgacatgtctccagccctttccctctcctgctgcccctccctctctggccaccctgcgtctactctcacgccttacaaatctgtacttctccctgacttcccacccatatgctggcctcaccctcccagggatttcctgcctagctcatgcaatgcaacaggtccaggtcaatctttccttgcaagctttcttccttccttctgttcatgctaacaacagtcccccagacatccagcccagaaagctgtgggtcctctggatttctttctcttccttgtcccctgtgtcctagtcagtactcgttgatcttcctcccaagtgttcaccccatcgcgtcctcttgtttgctttgccacatcctccccgtcgctttgactactgcggcagcctcctcactgcccctgctgactcgggttccgcacccctgctctcagcctccaccgcacccctgtgggttgatcctcagctctgagggccaggagggagggttgctgctgctgtctccttagctcgaattgctttggaaaatggcctgccctgcctgccctggaaggtgtctggtaggtcctggggtcacagactggtgactggcattggtcctgggtgtctgcgtaggtcccgggggcgtgggtctagtggtcagagactggtgactggcattgccattgtgacacggatgtcagaaaccagaatcctcagagggaggccactgggcaagaatgaccttcgtctggttgtgactgaggaaagatacttccagcgcgtctgtgtgcgtggcagggtggcttctgtaataagaaatggccacgccaagggatttctcgtttctgcgggagacattgttcagttttgtagccggcagcttaaattcaaaatgcattttaaacatgttttcccctttctcttgggtttccaaatacaaccttgaggcagctgcaaaggccgttttcctcagcctaaaaatagacttcacgcccctcccttttctcacgatctgtacacactccctccctcttctcaccgtctgtacacactccctcccttttcttgtcatctgtatacactccctcccttttcttactgtctgtatatactcccttccatttctctgcgtgcgaggatcgaattatatgtcttcctaaaagttgcaggggctaaaaccttgagagagacaaaccacatctgaaaatccagctgcaaaatcccagaaattacttcaagacagctcttgttaaaataatgtcagccagaggtccggacggactgggacccagaagagccaccagaacaagacatgcggacacaggactcagcccgattcttgcgtgccttccttatcaaggctttcccctctgaaaattaaagcagctactttaagtagaaatctggctgcttcccctttactagttttggttaataaattcacgttcttcctaccagaccttatgaattaaactatccgtttaatataatataaactctctgcaagcagcgagagcctccgcatctgcgctgggtcgagtgactgagggtcagctgacttgtgatgaacacaccagggaggtggggcttctttttacttctctcgtaggcacgttatgactctatgaataatacaaatgttcacagctcatgttcatgtggtgctttatagcttatcttgttaatagcggccccatttcacaggcggggaaatcgagattcagcggccccatttcacaggcagggaaattgagatttgaagagaccgagtgatattatatgccttggaagtagcagggccgggggctcggggtaagagccattgctcggaagctgcgagctgctcagctctgggactgccaccgagtggatggagagctgaggcaaagatggagaaatggtcactgacctgccccaagttcttggactgccacatgcagagggctctgagcctgaggccgagccaggcacattctcggggtggacgctgtgacactggggtgtttttgcaatgttcctggtgtctcttttctgggatgatgttagagtgagtgtgaaggctgttgacaccttaaggtgacaagatcactgtgagaagacacacgtgtgtcattgagtaaaacggatagtttttaagacattctctcagaggaagagtctccatccagggacgaggagggcactggcgttggcactgaggtagagacgttccccacatctgagtccttgaaggctctgtcaagcctctgccatcacgtcagccagagatctcccatcaaggtagttcttttctctccttgaaccacgtcaggtgggagacggcccacagctgcctcacgtctgttagggctccaggatgtgaaggccgagtggcagtaggcatcgttttccccagatggcccctctggtgactccacaggtgtgccgaggtgacaggtgtgctgttggctcgggagaaggagtggcagcagtatgagtgacgctggcagaagacagattccaagaagggtgaagccactccctgaagacacacaaagcctgcggctttctaagtgctgtgggttgaggcttattcctagcatctggtctgtttgtcttgggtttttcctggaactggaggtgaggaacccgtaagccgtatcgccacagtgtttcactttcctggaggggaattacttcctgacgggtggggccccttgccaggctgcctcgggcagggcagtgtaagcccaagggaagtgcccaacggtaaggatggccttgaggagaacattcagccccacacaggcagcaggcggcccggaaggcgcgcagacgctgaaccgctggccccaccgcctttggcagggagctaatgctatttgtgtatcagcccagaatcaactgtgaccagggttgtgtccactgggtacttccctagaattcaagatgaggaaagacactaactcaagatacccttggaataacagacctcttgtgatctccagcgcctgaaacgagacttggcatacagcagtgacttcgtacacatctgtggaatacatcccaggccctgtggcctttgttgccttcagccgaggctggagagagggtgacgttgcctgtttctttatctttatcttttttttttttgagatggagtctcgctctgtcgcccaggcaggagtgcagtggtgcgatctcagctcactgtaacctccacctcccaggttcaagtcccttcacagtggactccaaggcgagaactttacccgttctttccaacgatccccgccgaagtcacaccccaacccatggatcccaccaccggtcatttgacctcatttctgtcagcatctggtgtggcagcacccagccactctggtgatcgccacagaagctccagcaccaaaccaagaagcaccaaaatccggctgtgagcacagcacgccggccagctcaactctcttttccccaacgcctccttctcggaggtgccatctccagtctccaccatcttggtgttgccacccatctctcctggctcccactggggcaggcacatcctcctagcctagcgctgtcctcaggagcctggctgcctctccacagtggttagcctcgggctgtcctggtgtggtggtgtgtgcctgtgatcccagttggaatcaagtgcttctcctgcctcagcctcctgagtagctgggattacaggtgcccaccaccatctcctgctaatttttgtatttttagtagagacggggttttgccatgttggccagtctggtctcaaactcctgacctcaagtgatctgcccgcttcagcttcccagagtgctgggatgacagccatgagtcactgtgcctggccttgtctgtcatttcaattactcaaaatccataatctgggccgggcgcagtggctcacactggtaatcccagcactttgggaggccaaggtaagcagatcacttgaggtcaggagttcgagactagcctgaccaacatggcaaaaccccatttctactaaaaatacaaaaatcagcagagcatggtggcatgtgcctgtgatcccagctactcggggggctgaggcacgagaatcccttgaaccctggaggcagaggttgcagtgagccgagataacgccacagcacttcagcctgggtgacacagtgagactctgtctcaaaaatataaataaataaaataacataaaattcataatctattccacagcttgcaaagccctgcgcgatctaacacctgccttctctttcaagtcctccaaggggccaagctctttcctgcctctccatgagctccgcctctgcctgctcaggcctggcaccttctccacctggctgtcctcagcctcaggcctcagctccccgcagaacggttcctcacagggcccttcctgacttgtcagtcagatgcacctcccctactctctggccattcgaaatgcagctctcagcacaccctgtacttttccacactgcatttaccacatgtgcagttgagaacatttccgtaattatttgatgtctgtctgcaccaagattttagtgccaagagactgggccacgtctgtttcactcttcactgtgtgcatccagtgctgtgtcctagaacaatgtcaggaacttaaggcaggcgtttcctaaatggtggtttaattaacaaatgaatgaatgaatggctgtctcagcagggtgtgtgaatgcttctgttcttccctccgtcggtgggctgggctggtttggagattgccgaaaggctgtgtgctgcagtgagtcaggagacctgggttctagtcccagctgcctcacttatgggttctatgatcttaaacaagtcacttaacttagagagctttgaaaagcaggaactgtgacgcattcatcttcctgtccagagcagctggcatgagtagaaattctgcaagtgaatgaacaactccaaagtctaggctgtttcttattccaaattcccccaaaatccactggccactggacttttggaacctaaactgcaacctgggcggggcggcatctctacagagagtcgatgtctgtcctctgtggtccctaaacacatacacggggagtggagctgcgggcaacccaggccagtgcccttcctccaagcagggccgccattgcaaggcctcacgtgcaacacaaatgcccagttcctgagacttcttcagagtctccaggaaaagggtgaaaaggcatttaaacctctatgaagtagggccaggcacagtagctcacgcctataatcccagcactttgggagccgaggcgagcggatcacctgaggtcaggagttcgagaccagcctggccaacatggtgaaaccccatctctactaaaaatacaaacattagccgctgtggtgttgggcgtctataatcccagctactcgggaggctgaggcaggagaatctcttgaacccgggaggcagaggctgcactgagctgagaccacgccactgcactgcagcctgggggacagagagaaactctgtctcaaaaaacaaacaaacaaacccaaaaaaccaacaacaacagcaacaataaaaaaaccgtctatgaagaaatcgtcgatgaggtgccaacagactcagttattttgactcaatttctcagaacatgctggggcgggaactcagcctagcagtaagaaagacgtatatttaaggtaaaaggctgaaactagggggagagagagcctataaggtctctgtcctggccttcagagaagtggctctgtgagctacacgatgtgcatattttaagcacttaacagcaccgtgaaatcagagaaaagacacagagtagcaaaaccacccgttgagcgtacaaaaggccaaccacttcttgtcctctcattgcctcttgtccttagcaatgaagacacaaatcacttgcgtgtcaagcactgccaggccagcctctgccaggccagcctctgcctccacggctgagcccagaaaccaagggcgtggcgggactcacaggcagggagcggtgaggcagagctgtccgctggagcgagcccctgctctagggccatggccctcggggtccgttcatgcagcaagccacattctgaatacaccaagccagcccttgcaaacccacaggaagcacggggtggctttttagaggcacgaggatccttagatgaagggatatgaccctgggccgacacaagtgccattccgggttcaatcaccctccttcccccgtcttcccaggcctctttctcaaacacgtctttatggcttttcttttttttttagacagagtcttgctctgtcacccaagctagagtgctgccatttcggctccctgcaacctctgcctcccaggttcaagccattctcctacctcagcctcccgagtagctggaattacaggcgctcgccaccacgcccggcaaaattttttatttttagtggagacagggttggccaagctggtcttgaactcctgacctcaggtgatccacccgcctgggcctccaaaagtgctgggattacagcgtgagccaccgcgcccggccctttatgccttttctactttacaccagatgctgtctcgtttcatcctcatgacaaccctacgtagtagccccttccccctgggctcagtttgccgatgaagagcctaagactccagagccaaaaggcgttgcctgtgttccctgggctgccaagggcgtcgctgatgctggacctctgagtttcagcccctgctcttccctgtgcaccttgctggtcgttggccaaaatttggctgatgttcctggcaggacctcttgtccagggatcctttccttttgagtgtcctggagcacagtggggtttcccagaggggcagaggggtctgtggagagttttggtgtcctcggtggcaagttgaggtggcctgtcccagactgacagatagaccgggggttctccgaggaggggcccataaagacccttccccgtggagtgcgctgtggccggcgtcccctcccctgcctgccctgcacttgctccagcctgtcacctccctggggtcactgatagtgctggagaccaaggcctatttcgacccagttgcctttccctgtggcatggaaccaggacggccaggcttccttctgagtcattcctgcctggggcgaccagtagacaccaaatttccatctgtccttgtctagcccacctctgtctgctgtgccttatcctttaacccttgagagccagggctgttccttaaggaaaccctcattgcggcagctcctttgtggaaaccctgtgtttttcctctggcctgggcttcagtgtgacccagcctgggtgagggtcctgccggcaagtgtgcaaacagaccctagactcaagtataggcaggtcatctgtaaaccccttcagggagccaaaaggaacggggctggctggctgccagtcctccagcagctgccctgtgggggtgggggctgcccacccgcccttggtgactgcttttcctgccaaggccctggtcatgcccggtcagatgtgtgggtgccatctcccagccacgaccatctcctctcctggcccagctccacttggtccccttagcgacgcaaaggactcagcgctccacgacatgcctagcttcttcgggtcgtcatggagacgcccttgcacaccaacagtccttcactccttctccgggtcacgcccccgtgcttttccacgcccaccccaggtcttgcccctctgcgctcctctccacagaccccacttcctggctccacatggagctgagtgtccagctggtacccagcacatttgggctcagctttaaatcacagatttggaaactcaagaacttgggcgtcaggaggtccaaccgttcaccactgctttttacacaggggaccggggccctggggagacacggggcagggcctggtcacaggggccagaacagttcacggcaaagacttggccctggggctcctaaatccaagctgcctccccggcgccccaagccccagcctcgctctgggagtcatgattcccgtggagactccttcaaccacatctgcagggcagggccgtgtggcggctccttccggcctccacgtcctcacggtgggatgagcactggagcggggttgtgtggccagggtggggtgggggtgctggagggtggggaggtgtagggaggtggtggcagtttcctttgccctcagcctagtcctgaaacatcccgaggtggaagggtccgcttcaccagcatggcttctcttgcagcctttaaacggcactcgccttctgactcactcccaggaagctcctcaaatatgcgcccaagaaatattttccctcggcgactgttcttagcctgctgagaggcagggcaggagctgagactctaaccccagcttgaactctggaccccagactctcccccaaagactcagacacccagaaacacagaataaaacttggtcctgaagccagagggacagcctggaaagtgtggggaagaggacgggggcccccgagggaacatctcccacaggcctggcatccctcccctcccagctctgtacacggaggagcccaaggccaatgccggggctacgagccccaggcaaggccgtgacccaaatggaggcttttaaacccgagctcagaggtaagaagcccacggccagcacctcccggccctctgcgccctggccgcctcctccgcaccaccctcccggccggcctgcccctctcctccttgtcgcttcccttgcttgctgctgtctcccgatcttctcctctctccattcccagggtcctcagtttgtctgcgtctcacctgtctcgtcctctcaccctgcagctttacatgagttttcttccgtctccatcacccagctttcctggcatcccctctacccccagctctgtacacaagggtgtacatctttctccttgactctgttcctcttgctctggctctgcctgtctttctctctgcgagtaagcctgggctctcaccatggatccttccagacatcgccgggctgctctctggccctctgttctcttttctctctctttcgagcattctccctctgtctttcccctcagatcttgtcccgtatctgccagttcatgcctcctcttccccacttttctcctcttcttattttttattttattttatatttatttatttatttatttatttatttatttatttatttattttgagacagagtctcgctctctctcccaggctggagtgcagtggcgcgatcttggctcactgcaacctccacctcccaggttcaagtgattctcctgcctcagactcctgagtagctggaattacaggtggggcccaccacgaccggctaatttttgtatatttagtagagacggggtttcaccatgtcggccaggctggtctcgaactcctgacctcaggtgatctcctgccttggcctccgaaagtgctgggattacaggcatgagccaccgcgcacggcctccactcttctttctctctccctcttctcttcctcttctttccctctctgggtctctctccaccttccccccatgttgtcccattcatctctttctcctttccctctccctctttttctctcccttctcttcctcttcgctgtctccctttcccctattctctctctctctctctctgtctccccggacctctttctctgacagctcccacctcccccaagtgctccccgcagccagcctcatctgctgtctccatcacttacctgggaccacatgcggaaggaggcagagacacaggcagctcagggacacccaggggaccctcctccagcgtgcccccttcatggctgcggcaaaagtccccctggctccctggggaagctccacggcccagcagctgcagtgtgaggagcagacgtgagcccgtcccctcaggcggctggcccgaaccaagtgcgtttctccgaaggggccagggaacctgggaagaggacaaaagagggcggggccccacgctaatcacccttttctctcctcagccccaccccactaccccaccaggaaagaaaacaccgatacacccgttgctctgcttctcatcagcctgagctgagtggcgggagggatgggaggagacatgggggaatgggaacaggtcacactggaaatgggtgggccaccctcctagccgggttcctgggtcctctcctccctccccaggggctgcccctgtcccaccagagctttgggctgctgggaagaatggggaagaaagggccccagagggagcgaccttggggctgtatgaatgggggaaagagagtgagacttaagcagaccccaaggaattgggaagcggggaaccatgtgggtgaggggcaggaacagaaatgcactgtatgccgtcttttggaaaggggtggtgtgcttggaatatctgctcagtgcaggcgcgtggcagaccccagacgcgtggcagaccccagacgcgtggcagaccccagacgcgtggcagaacctcagtgcagatgcgtggcagaccccagacgcacggcagatcccagacacatggcagaccccagacccatggcagactccagacgcgtggcagaccccagacgcgtggcagactccagacgcatggcagaacctcagtgcagactcgtggcagaacctcagtgcagacgcatggcagaccccagatgcgtggcagaccctcaccagatggtggacttcttctttccagggcagggagctggagccagggtgcagggagccagggacagtctgggagactggcctgagggagctggcatgggcagtgggttgaaggcagaacctcggtaggaggaagcgactgtaacctgtgaggaggtggagctgctcctggagacctgggggctctgctcaccccagttccacctcttggaactcacaggcacaagcgaggagggaaagggaccccaagtagggttgtaaagacgaagagggcagttggtgtagctctctgcaaaggaaaacggggatacctccgctcccctctttgccacagtgtgaatctctgcttctgattcctcaagacttgattcccgaatgtggggtgtctgtggggtgactcgtcccagagcagggaccttcgatgctcagacactgtggggcccaggacaaggactcagggtttctgcattcccaagcagagccagccttgtccagcaaggagtaggcaaccgacgctgtggcgctgtctccgagggtcacggaggccctgtgaccacttgcttctagaagctgaaagtctgttcatggccccaggccaaagcctgggccacgccataataatgcggataccgtggggaagtggcgtggtcccccaacagtccctccagctctgggtggacgagctgaccctgttctttcctggaggtaagaaaatcataaaggtaaagagtcatgtggagcatcctgtgggcgcctggacggggcagcaggagggacctactgcagggaattcgcagacaccaaggcccagcttggccttcgtgatcattttgcacttttttttttttttgagatggagtcttgctctgtcgcccaggctggagtgcagtggcaccatctcagctcactgcaagctccgcctcccgggttcacgccattcccctgcctcagcctccctagtagctgggactacaggcacctgccaccacgcccggctaattttttttgtatttttagtagggacgaggtttcaccatgttggccaggttggtctcgaacccctgaactcagatgatccgcccgccttggcctcccaaagtgctgggattacaggcgtgagccactgcacccggcccgtggtcatttttctgtcagctcttgctcgtgggtccccccattacctttccacaggttttgtttggtgacgctttcaggacaacagttttccatctctagaggagaaaggagcatccaggtgagaccaaactaagcgctggacatcttgttgaccgaacacaggtagctgacctctttcccatgccaggaaggccagaggcacacagcgctctccggaagctgctgtgacggccgagactccaggagggcgttacaaacctgggcttgatcccagctctgccaccgcgtcaccacaaagtcacagcctcttcgagctgttttcctcgttcacctgtaaaatggggataacacctatctgaaaggttgtagggtgggagtgagcctgtagatgctgaggggctgcgggagtattaggacacctgttgtgaggacacctgttgttacgacacctgttgtgaggacacctgttgtggaggacacctgtggaggaacgtggctcctccttccatccgggcatcatccctggagggagacacaaacgagggccagccaggatacaggaggagtccggaagtgaatttccaggcccaggtctttcctgcgtcccctttgagtcttataggatcctgattaggagcgtgagatcctggagaactgggcgtgcgcactcctgttcacctcttccctgcccacgcccgtttcccttctgctttccagctcccctcaatatgcccattttccagagttaggatgtgtctgggtctctgtgataaatggctctgtcttcatctgggttgggtcacgggacacccatttgtccttccttctctcctcccaaggcatccgatggggacagaatggggtgaatgagaggggacaaaatgagtggcttctctagttccttgtggccgaaaaacctcctaggcccgcatactgctgggtctgcataggggcaggagtctgaagtcaggtgtaagttaatattccacgggaggcaggaagagcttagtgtggatgtggggtgtaagtaaattggagcaaggataagatcatgagattctcccagacttggcttgaagagacagctgggtttgaggcagcaaagccaggatctccaagagagattccccttctaagctacccaagtaggagtccctagttttttgggtcccctaaaattgcttacctttatatcatttatgcctcgtgctgtgaataaagttcaatcttgtcagacttaggacaactaggctgatctcgagcaggaagctggatgtttattaagtctgatttacctactcagtctggactaaaaaggtgtgtggattccctagtcagtgacccagcatgaagccggtcactagagtgccaggccctgagcctgtccccatggccctgtgaagtacaaagcgctgccctacctctcaagtgagcacgctgaggctccaggagcttcatcatccccgagtcaccggccaggtcgggccatctagggaaactggagagtgttaactccgcagttacagccttctgggccacacactgtcccaaagctggaatttgagctctgttctgcctggctccaaagcaaaagaagggcaatcacctgggctgaccgcccacgacatccttcgctccgggtcctttcccggtggcaggtggagacggccttttggaggggcctcgctgtccagctgcaaggatagtggttagtggacagctcccagctgctggcccctgcagggtgggccttgcttttatgctgagctcatgctcttctccaggtgaccctgtggccgatgactaagcaaagtggcatcacagtgacctcaccatttccaccccacaagactccgccaacaggcagtctgcccctcagagcgccccatgggcaggagctttgtggctgtgtcagctgtgccacatcctcctgcccagcccggcctccttcttcttacacaggtgccacatcctcctgcccagcccggcctccttctccttacgcaggtgccacatcctcctgcccagcccggcctccttctccttacgcaggtgccacatcctcctgcccagcccggcctccttctccttacgcaggtgccacatcctcctgcccagcccggcctccttctccttacgcaggtgccacatcctcctgcccagcccggcctccttctccctacgcaggtgccacatcctcctgcccagcccggcctccttctccttacgcaggtgccacatcctcctgcccagcccggcctccttctccttacgcaggtgccacatcctcctgcccagcccggcctccttctccttacgcaggtgccacatcctcctgcccagcccggcctccttctccttacgcaggtgccacatcctcctgcccagcccggcctccttctccttacgcaggtgccacatcctcctgcccagcccggcctccttctccttacacaggtgccacatcctcctgcccagcccggcctccttttccttacacaggtgccacatcctcctgctcagcccggcctccgcccttctccttacgcagatgccacatcctcctgcccggcccggcctccttctccttaccaggtgccacatcctccgcccagcctggcctccgcccttctccttaccaggtgccacatcctcctgctcagcctggcctccgcccttctccttacaaggtgccacatcctcctgctcagcctggcctccgccgttctccttaccaggtgccacatcctcctgcccagcctggcctccgcccttctccttacgaggtgccacatcctcctgcccagcctggcctccgcccttctccttacgaggtgccacatcctcctgcccagcctggcctccgcccttctccttaccaggtgccacatcctcctgctcagcctggcctccgcccttctccttaccaggtgccacatcctcctgcccggcccggcctccttctccttacgcaggtgccacatcctcctgcccggcctccttctccttaccaggtgccacatcctcctgcccagcccggcctccttctccttaccaggtgccacatcctcctgcccagcccggcctccttctccttacgcaggtgccacatcctcctgcccggcccggcctccttctccttacacagatgccacatcctcctgcccggcccggcctccttctccttaccaggtgccacatccttctgcccggcccggcctccttctccttaccgggtgccacatcctcctgcccggcctccttctccttaccaggtgccacatcctcctgcccggcccggcctccttctccttatgcaggtgccacatcctcctgcccggcctccttctccttaccaggtaccacatcctcctgcccagcccggcctccttctccttaccaggtgccacatcctcctgcccagcccggcctccttctccttacgcaggtgccacatcctcctgcccggcctggcctccttctccttacacagatgccacttcctcctgcccggcccggcctccttctccttacaaggtgccacatcctcctgcccagcccggcctccttctccttaccaggtgccacatcctcctgcccggcccagcctccttcttcttaccaggtgccacatcctcctgcccggcccggcctcgttctccttacacaggtgccacatcctcctgcccggcccggcctccttctccttaccaggtgccacatcctcctgcccagcccggcctccttctccttaagcaggtgccactcccctatagccttcacattccttccaccaactcagcatttgcttctgggaggacccgacccgagacactcacgtaaaagaggatgcccacgtacagatgtggcagcaggccctccgagctgggattcagacccaggtcagcacgactccaaaatctttcctcctctgcagctccttattccatggttcagcagggaggcgggcgggctggaggccccggcacctgctgtatgtggtctctatccgaggccatggtgaaagcagggaggtgggtgggctgggggcccagcacctgctgtatgtggcctctatctgaggccatggcgaaagcaggggccctggtactagggtcacacaaaggccactgtcattctcttgggattcggtttctcctttccctaaaagtgccaagcattctcacgccaattagctcatttcctgtctcatctcacctctgtggtggagcagggcatgatttttacgcatgcaacgtcttcttacgggcatccctgtgaagcagggccaccccggggcacaggagggcctggaggtccagggatctaaactcattccattcacccagccttaaggagaagaaaaccgaggccaggaagtcagcaagaacatgaagtcggtgacccagcatccaggtccccggatttgccacctgtgtccttttgtggggcttccctttgtaaagcttgaaagaataagaggatcttaacataattttaaaactggaagagaccctggtgaccatgtcatccgaagccctcattctaccgtggaggaggtgtgggcccagagagaagggaggtccttgttggcgcagccggtgagcggcagggtgtgtcccggagcccgggtttccagcgccctctctgtcttgctgccgagcgtccacgtctgttcggttgtctttgcacactcctggctcccagttagaccgctgctcccaggcggaacgtctgccacaggggacacgtacatgcggccaccatggggactgaatgagggtgggcccacaaagctctccaacgcggggttctgacagaaagcccaacccgggccgaaagccatcttttaaaatgaagtttactgggtttcttttttcattataaagtaatgcacactgtccacagagatatgaaaatatttaaaagtagagagaagaaaaacatcatcaatgtttcaccacccaggaacaaccctattaacgcgttgagagatttctggcttgtttctcatacatagctcatatccatagtttaaatctatcatatcctagatatagtttgatctcctctttaccacctaactttatttatttatttatttattcatttttattatttatttatttattttgagacagagtctcgctctgtcacccaggctggagtgcagtggtgcgatcttggctcactgcaacctccgcctcctgggttcacgccattctcctgcctcagcctcccgagtagctgggattataggctcgtgcccccatgcctggctaatttttgtattttcagtagagacggggtttcaccatgttggtcaggctggtcccaaactcctgaccttgtgatccgcccgcctcagcctcccaaagtgctgggattacaggcgtgagccactgcgccgggccatgacctagctttaaacctaaaagtctccccaattattataaaactccattcacacatttctgaaggccacgtgatactgcattggctgccaccataactgaactaacttggacactgggttattcacggcgtccctgttacaggtaatgcccggatcagaggctttgtacccaaagtgccttctgtgttcaggatcatttcctgaacctggaagcagagctggtgtgttctgatcggcggctctgaccctccttctacagtcagaagtccataaacatgagcttgctctgtccaggatgtcggcacttttttggacacttgtgatcaattaacccttttaatgttgatggtctaatggcggaagcagagctgacaatggggccgggcgctgtggctcacgcctgtaatcccagcactttgggaggccgaggcgggcagatcacctgaggtcgggagttcaagaccagcctgacaaacatggagaaaccccatctctactaaaaatacaaacttagtagaaatgttggtggtgtgcacctgtagtcccagctacctgggaggctgagggaggagaatcacttgaacctgggaggcggaggttgcagtgagctgagatcacaccactgcactccagcctgggcaacaagagcgaaactccgtcttgaaataataaaataaaataaatagaataattactccggaagcctaaaaatgatgggtggattaaagactctgcaggtgggtggggaaaaggtggagaaccccttcccatcccagctctttcctgggtgagctcccagctatgatccaggaccaactgccaggcttctcattttgatactggacactatgcttagcccagcgactgtcctgaagaaagtgatccagacaaaatttgaacagagaaagaaggcagtgagattagcccatcaggctggaaagtgagacttgttccttgttccccttgctccctggggagaggaggcaccagctgaagctggccaggggacagaagaggggtctggtgagctctgctccccggtgtgcaggggaggcagaatgcaggcagaggagcagcctgacaatgcgacggacacattaccacgtggccctatgtgccctcacggggtcacgagctagtggaatctaaacatggagagaggatcatttagcaacagggtctgtggccctgggcatgactgtgtgccaggcaacagacaagcctcagtgagggccatccaggaaggcctctgccttagtgctcacaaactcggtggcttcaaacaaacaggaatttattctttcacagtttggaacccagaagtccaaaatcaaggcgtgggcagaaccacactccctccggaggttctggggtggagccctcctggcctctctcctggtttccaggggtggctggccattctccgcattcccgggctggcagccgtgtccctccagcctctgcctccatcgtgttgtgtggccatcttctcccctgtgcgtgtgtctctgtttcctcttctcataaggacaccagtcactggattaggctctgcctcaattcggcatgacctcagtttaacttaactaataacctctgcaaagaccctatttccaaataaggtcacattctgagtgacatgaattttgggggacacgtactcaccccagtacaacctccttgaagaaaatttggggcagggtaggtgtatgggtcatgacaatagatgattcttgccgaatgatgacctatttgggaagaccagcaggtgtgcccacatcaccctgggctggctctggaaatcccccaaatctcggctcttgtcaccactgagtcaggagccaggcggcatgaccaagggaccagcttgactattcctcgatctaacttcttggatcatgaggccaggcagatggcagccccaggagccctcagctgtagctcatcaggcccgtgctgagaccaccccctcccctgcccaggagggcagaaaagcagggcccaggcagcagtggccacacctgcctcagtggtttcagccctgctctctcaaaggttgacctgctattgactggaaggtatcacattcccttgtttccttctgtaaccagagaagaaggtaaggggtaagggtgggagaggggagagagacaggacagtatatctaaaaataaacgtaccccacctcaacctcaagcattgcacagaaaggtgtgtccgcctgctcttcacccgcctgtgacccccgcattccctccaggtgagcaggagcccgacctagacactctctttagcctacacatgccagactctccctttagaggaaaaagggacttctcaccaagccacaccccttgaaactgcttcctcgggtgcacctggagtgttctcactcctcggccccagttcccactcacacttcctggagctggaggagggggcaagagggtgatgcgtcataagcctgcatggacattgtcactgaaatgaaagctcagcttccagggtccggagacggctttggccccaaggtgccagggacagcataagctgccgggacctggcgaggcccagggggcgagccttcgggcaacatctagcctggcactcctggtttcgtgctggaggagcagggtgagagaggggctactgttgagctgtaggaggcagagtgggtgctgggggaaagagcaggagctttggagtcactgtgggcaagccacttcctagctgagcctcagtctccatgtctgcacagtggggagagtagacgtaattcctattagcttagtacgtcgtagattctcagcaaatgttagcgtccccacgccaccgccccccagatgtgggcatggaaagagaaacaaactatttggaaggagagtctggggttgttctgggtggagggccaggtcatagacatgatgtggtggcaatgcctgattctggctgagggaatcattctggaatggtgagggggtggatctggccacagggctcaggagactattgtcgtctcaggggtcctcacaaagtggctgggccaggtgagctggtgtttcttatatgcgggtaaaggtgttgctcgtatgcaggtaaaggtgtttctcgtatgcgggtaaaggtgtttctcgtatgcgggtaaaggtgtttctcgtatgcgggtaaaggtgtttctcgtatgcgggtaaagtgtttctcatgcaggtaaaggtgtttctcatatgtgggtaaaggtgtttctgatatgcaggtgaaggtgtttctcatatgcgggtaaaggtgattctcacatgcgggtaaaaggtgtttcatgcagcagttggcaagttggtaacttcttcaagccctgtgatttcgagatggggagagaagtctgtgagaatgcagttttgagaagcagaagcaatgaggtcgcatcagcctactgccgagcataacacacaagggcaaagaagacgggggtctgggattggagggcttcttaaaattctgacactagaccaactttccaagttgttaaagcctgcagaccccagatgtaatctgtcagtgtgagaggagttaaatgtcagctccaatatctacattataataattgatacatattacctaataatcaatatattgtgatgttatatcatagcatttattacatacaacacagttactattatattagcttcatctacatgtgagatctgctttttaaaaaacttactttattttttatagagatagggtcttactttgttgcccaggctggtcttttttttttttttttttttttttgagacagagtctcactctgttgcccaggctggagtgcatgatctctctgcctcccggattcaagcgattctcctgcctcaccctcctgagtagctgggattacaggcgtgcgccaccacgcccaggtaatttttgtatttttagtagaaacggggtttcaccatgctggccaggctggtctcaagcccctgacctcaagtgatccacccgcctcggcctcccaaaatgctgggattacaggcatgagccaccacgcctggccaagattcacttaaaaaaaaaaaactgctttaaaaacattcataagccgttattgcctggagagtctttgaatgtgtcacaccctttaacacgcaggagcagccaatccccaaagccctggtcacgtgatgacaattaggccacctaccctccgttattctggcccctctgccaagaggcaggccctcacccaactgaccctaccagcgcaggggcctgagtgcggctctccaaagaaacttgatgttggcattcagccacaagcccggctctcagaggaacctggtgtgggaaagacgccccacctccagcccctgtgccgtcagagtcaagatcactgtactttgcataaagtattaggaaaaaacccaaattcttgctctttgattagagcctctccttctttccccaccagccctctgcagaagcaagaggcaaaactaaaactcaggtgtttttatccgtgagtctgtgtttctgtgtaagtgatctatgcatttaaaaaccaataacttactttatccttctcaggacctgaagtatggtctttcatcagatgcctacagagggtaggaaggccaggaagaggtggggagggcaggaggggagcgctgaacaaatgtagaggttggatccaggcgtgcggatcagaccttgaactaaggagccatggagagcacagagcccccagggacacgggaagacggttgtcctgggtagatggcagctccagaagcccccagctgtgcctcatcaggcccatgctgagactacggtctcctctgcccaggagggccacagacaagtggagaaagcagaaaagcagggcctgggtggcgctggcctcacctgcctccatgaggcggacaggagcctcgcagccgtggacgcagcccaggccaagccatgcagggagtagtaacaagaataaatgaagccgtgaagccagggcccctttggcgcttgtgcaaccgccaacctgcgtagttctgtgagcactgggacacgtgttggtgctgactcatcaaaatcccgggactgtgtggttttggacactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttgggcactgctggagtccaggtgccctgtgtggttttggacactgctggagtccaggtgccctgtgtggttttgggcactgctggagtccaggtgccctgtgtggttttgggcactgctggagtccaagtgccgctggggctgcctcggggaggaggaaagtttccagaagagcttacggaagagcctgcggcttgggagcagcatcccccagctcgcgtgctgggtgggaagtgccgaggggctgtgcagagggctctcgtgtttggggattttctcgggacggctgttttctacttgaaatgggggtcctggagttcatggggaatgagagaggtgagcgggagccagaacgggaaagtccttgtccgggggcttccgcaggagcccccttggcccctggccagacacttccagcttccctctggccccagagattcccctcggggtcaggccctgcctacctgcctcggcctcgcggtcgccttcctgcccctcaggaagccctgccaaggtcccctgaaggcccgcatgcttgcccggaggaggccgctcctcatgttgccccagggactgcccccaaggcttccttcttcagggaagaggcggctcttggccagggagttgttggggctgtttccaacccaggcaaaccttcgcttcctctcctgccctcctgccccgggtttttccccagacagacctacgggtgccagtgccagtacgggtgccagtgccccagcctcgcctcccctgcagctccctcctgggccaggccgaacaccatcgtttcacagtccacttactgagctgagaagacctcctcgtatgaagatctgggaaggcctgagctttcaccggcctgcaagctcacgggcgagcctgccatggttgaaggacgctggcagaagaccagagaccctggcccagggcagaggactctgtcactcacggcacggcacgttgctcagtgtgaacgagcttcctcttcactcccgtttcctttgctccccaaaccccacgggggctacgcagaggcccaggtggattctgtggcacagctgggtttgcctcaccgccggggatccccgtgcttaggaaacgccggactgtcatgaggggctgcgaagcaaacctgcccaacctttcccgggggtggacgtcgtctttgttacactggacagcgagcaaatctcgcttctgccccagagggagacgctgtccctgcgcgccgagactttcactatatacacgtccttgacgagagtccagagcaaaaggccgtcggcgcatctgctcctgagacttgcagaaacgtggggaaccagtgaaaaattgtctccgacatccgagacccagaggaagcccaggccaacgggcgcagggtgctggcttttccgctgccttaggtttcaccgcgggtgccgtctagccccgtcccccacgtctccgtggccagcacagggcccgaaatgagaccgctcataaataactgaaaaaatcacacttacctcagattgtaccctactatgtcaatcatgttggaacaaattagcgtttctgaaacaagagttatggcagaagtgactgcgatgttccgatgtttctaggtgttggcacggatactgttcggtcccaaccccaggaggtagttactgggagccattctgaggagggagtgctgaggactcccctcaacaaggggctgtggccaaggaaaggggccctgagagacctcacacagagccccccagtcgcatacggcacggctgaactctcctggcttcccagagaatccagaaggaaagggcggcctcccgcagcccccgccagccagctcaggggcagacggcctagtggggcccttgcccagccacccgcctatctattggctaaaaaaatgtaaaaacaaaaatcactcttcccatactactctttttctccttccctctttttaaaatcctgtttttgcttttgttcattgacagcagcctaaaaagtgttcttcctcatatatgggagttaattctttttgtttttttgagacggagtctcactcttgtcactgaggctggagtgcagtggtgtgatctcagctcactgcaacctccacctcccaggttcaagcgattctcctgcctcagcctcctgagtagctgggattacaggcgtgtgccaccacccccagctaattttttgtattttttgtagagacggggtttcaccacgttggccaggatggtcttgaactcctgatctcaaggctcactgcaacttctgcctcccgggttcaagggattctcctgcctcagccttctgagtagctgggagtacaggcctgtgccaccacgccaggccaatttttgtattttcagtagagacggggtttcaccatgttggccaggatggtctcaatctcttgacctcatgatcctcccacctcggcctcccaaaatgctgggattacagcgtgagtcactgtgcccagcctaatttttgtatttctggtagagatggggtttcaccgtctggtctggtctgaaactcctgacctcaagtgatccaccggcattggcctcccacaatgctgggattacaggcgtgagccaccgtgcccggcctgacgcggtgaaagtctgaagattctacatctactccttcaaatttacttctaggaattcactcaaagggaatagccagccaagtatacaaaaatgtttgcgcatggcagcacttggaaactacctgctggcttacgactggagtttggtgattataatgcattagtgcaatggaatacaaaatattctttaaaatgatcttgtggaaggccaggagtggcagctcatgcctgtaatcccagtattttgggagccaaggcaggtggatgaattgagcccaggagtttgagaccagcctggccaacacggtaaaaccctgtccctactaaaaatacaaaaattagccgggcttggtggatgtgcctgtagtcccagctgcttgagaggctgaggtgggaggatctctggagccccaggggcagaggttgcagtgagtggggatagcactgctgcactccagcctggacgacagagcgcaatcctgtctcaaataataataataataataaacagtaaataaataaacaaaatttaaagctgatcttgtggaagaatacaattgaccattgaacaattcgtgggttaaagggcagcaacccccgtgcagctgaaaatccatagataacctttgactccccaaaaacttaactactaatagtctactgttgaccagaaaccttgctgatgacataaacagttaattaacacatacttggtctatgtattatatcctgtattattacagtaaagtaagctagagaggaggaactgttgttaggaaaattataagaaagagagaatatatttattattcattatgtggaagtggatcatcacgaaggtcttcattctcgccgacttcacactgagccaactgaggaggaggaggagggtcaggggttggtcctgctgtctcaggaatggcagaggtggaagaaaatctgtgtgtaagtgacctgccccgttcaaacccacgttgttcaaagatctactgtatatagcaatcgggtgacaggtaataaaacagtgtgaagtgacacgtttatcaaatggcttatgcagtatgatcccaacttttttaaaaagctacataacatgaaaaaaagcccagaatgaaatgtactaaagtgtaacattggcattctctgagtgctaggattaggggtaactttcattttgttcattttgcttgtcgatcttttcaacacgaagtattattttataatacaaaaatcttgtgggtttttaaaatgaagctgtatcttccaaattgagtttttctccggttagtgttaacagaagcctgacttgcttgagaagacggccgctgctggtaaagggacaagaggaatccagggaggaaggaggcaggaaggagcggggcctgcagagaacgccaggccgaaaggacccccagggccagccggcttgaagccttccctggacttgtgccaggcaccgggcactgcaaaaagctgtgtgtctgcatgtgtagagaactgcgttacgaatctttttcctttgttgagacagtgtcttgctctgttggccaggctggaatgcagtggtgcgatcacaggtcactcaaccaccgggctcaagtgatcctcccacctcagcctcctgagtagctgggaccacaggtatgtgccatcatgcccaactaattaaaaaaatttttttgtgtagagacagagtcttactaggttacccaggctggtcttgggctcctgaccgcaagcaatccacccgcctcggcctcccaaagtgctgggattacaggcatgagccaccgtgtcccaggcagaaatgtatttttatgtgagttgtagttaaaaaaaaagttgtgcaatatgactctatagtagcccctgccaagccctacagtagcccacaccaagccttactgtagcccctgccaagccctgcccagccctggctgcgcccttctcgtaatagggaacttgagaactcccgatctttatgatgtttcttgacaatacaaactgttaggcatttttattattattatatttaacaagcgttggttcctcatcgtgcccagccagctccccgcaccccctctctggggcagcagcttagatgttggaaggcagccaccgtgtcacccccaagtccaggcttgcctccccatcccatccccagctccttaaccaccctccagcacgaagttttgagccacttccttttctaaggacaccctccccacatccaggccgcctggtccattcaaatatgatccccatcctaggaccaaggcactaagccaggccatgttgctcatttattaacccataggttcatttgaagatcattaagcaagcactggccgtgttcttggcactgcgctgggtgtaggggagtcacccaaaggacaaaaaaggcccagccccctgccttgaggagccccccattgggtggggtgaggcaagttggcccaggtcatctttgtcacaacgaagctgtgctccccatgagggctggctggggtccgacgggactgatactcattctggccgtgagccgagagaagccagccagcctcaactgcacggccacgacctgccgcccgccctccagctcctctgggccggctcccagtcagggcatgtttctccagcaggcagcctgggaaggtgtagacctctgacccccggctgggccccgtccaggcttcaaggactcctgagggccagcggccggaatgaccacttgagagaatggacttgctactaactgttgaactctgtcagcgcctttcacaccggtggctgataagagattaatttcttatcttctgataagagattacttcttataagtaatcttatacttctgataagagattaatttccaaaatacataaggaatgcaaacaactctatagcaagaagacaagtaattcaattttaaaatgtgtaaaggacttgaacggacatttttcagaagaagacatacaaaggccaacaggtgtatgaaaaaatgctccatatcactaaccctcagggaaatgcaaattaaaaccacaatgagacatcacctcactcctgttagaatggttttcacaaaaagacgaaagatagtaagtgttggggaggatgtggggaaaagggaacccttgtatacagccgggaacgtgaattagtaccagccattatggcaaagtttgaaggttcctcaaaaaattaaaaatagaactaccataggatccagcaattccactgcatggtggatatccaaagtatataaaagcagtggccggctgggtgcagtggtcggctgggtgcagtggccggctgggtgcagtggccggctgggtgcagtggtcggctgggtgcagtggccggctgggtgcagtggtcggctgggtgcagtggccggctgggtgcagtggctcacacctggaatcccagccctttgggaggacaacacaggaagattgcttgagcccaggagtttgagaccagcctaggcaacatagcgagaccctgtctctacaaaaaattttaaaaattagccaggtgtggtagttcatgcctgtggtcccagctactcgggaggctgaggtgggaggatcacttgagcccaggagttcgaggcggcagtgagctatgatcacaccattgcatttctgcgtaggtgacagacaagattctgtctaaaaataaaataaaacaggccaggcacggtggctcacacctgtaatcccagcagtttgggaggccgaggcgggcggatcatgaggtcggcagatcaagaccgtcctggctaacacagtgaaaccccgtctctactaaaactacaaaaaattagccaggcgtggttgcgggtgcctgtggtcccagctacttgggaggctgaggcaggagaatggtgtgaacccgggaggcggagcttgcagtgagccgagatcgcgcctctgcactccaacctgggcaacagagcaagactctgtctcaaaacaaacaaacaaacaacaacaacaaaaaccacattgatttgttcagcagcgatagaaaaataataaactaaaatcagtatgtcaaagagatgtctgcactccagtgttcactgcagtaatattcacaatagccaagatatggaatcaacctgtctatcaacgaataaatggataaagaaaacatggtatagatatatgatggaatactacgtaccttttaaaaaaggaaattctgttctgtgacaacatggataactctggccaacattatgtgaaaaggaataagccacccatagaagataaataatgcatgttctcagttatatgcggaatgttaaaaagtcacactcagcaggaacagagtcaaaaggtggtcactggaagctgaagatggagggattggggagacgttggtcagaggacacaaaacttcagttaaactggaaggatacgttcgaaacttatccttcgaaactactgcacaccatggtgacgatggtgaacgtatcatgcactcgaagatggctgacagggtagattcaaagtgttctcgttcgaggccgggcgcggtggctcacaactataatcccagcactttgggaggccgaggcgggcggatcacgaggtcaggagatcgagaccatccctggctaacacggtgaaaccccgtctctactaaaaatacaaaaaattagccgggcgtggtggcgggcgcctgtagtcccagctactcgggaggttgaggcaggagaatggcgtgaacccgggaggcggagcttgcagtgagccgagatggcaccactgcactccagcctgggcgacagagcgagactccgtctcaaaaaaaaaaaaaaaagtgttctcgtttgaaacatccttcgaaactactgcacgccatggtgactgtggtgaatgtatcatgcacttgaaaatggctgacggggcagattcaaagtgttctcgccacacacaatcacacatttgtaaggtaacgctgcgttcactagcttgatgtagtcattttacaatgtatacatctatcaaaacaccatgctggccggcgtggtggctcacgcctgtaatcccaacactttgggaggtggaggtgggaggactgcttgaagccaagagttcaagaccagcctgggtaacatagtgaggccccgtgtctaccacacacacacacacacacaaagttaaaaaaatttgagaaaacccaccatgctgtacacagaaatacagatcatctctgtcaattaaaaataatttttaaaaaattacagcaggtaaatatatatacaagtaatctctactcattgaatatttatttatttatttatatttgtgacagagtctcgctccgtcacccaggctggagtgcaatggcacaatctcggctcactgcaaccttcgcctcccaggttcaagcgattctcctgcctcagcctcccgagtagctgggattacaggcatgcgccaccacaagtggctaattttgtatttttggtagagacagggtttctccatgttggtcaggctggtcttgaactcctgacctcaggtgatctacctgcttcggcctcccaaagtgctgggattgcagatgtcagccactgtgcctggcctgaatctttaaaaagtagatgttaacaccctgttttacaaatgagaaaattaaactgaaaggttcattttttgttgaaacaatgtctattaagtgcctatctgtgccaggggtgaagctagaagcagagataaaggcagtggggaggaaggctggtgtctctgctctcatcagcctggtctggaagcagataataaacacaaaggccagcaaataattataactgccataagcattatgaagggaaagcagagacactctagggacatacagcagggtaccgactttagctggcagtgagaggctggcagagggatgcctgaccaggggccagtggaggagggtgaggttagccaggcagaggctggcaccactgctgtgggccgaggatggcctgtgctaaggccctgaggtagagagacactttgcccatcctaggatctgaaagaagtccagggggattggagcagagggagcgggatgagtgaggtgggcttacacagcgggggattagggcagagggagcgggatgactgagctgggcttacacagcgggggattggggcagagggagtgggatgagtgagctgggcttacacagagggggattggagcagagggagcaggatgagtgaggtgggcttacacagggggagattggagcagagggagcgggatgagtgtggtgggcttacacgggggggattggggcagagggagtgggatgactgagctgggcttacacagcgggggattgggcagagggagtgggatgagtgagctgggcttacacggggggattggggcagcaggagtgggatgagtgagctgggcttacacggggggattggggcagagggagcgggatgagtgaggtgggcttacacagcggggcaggaggcaggttctttgggtttccgagctctgtgagcatcagaatgtcctgaggaagctgatttcagtgcaggctctggggccggccatgccctccctggagcctcagtctgtgagtcttccctgggacctgtttccccaagtggtgccgaggcaaatggccggatgacgacatttcaagggtgttattggccatctgaaggatctgggactttccctttttttttttttttttttgagacggagtcttgctctgtggcctaggctggaatgcagtggtgcgatctcagctcactgcagcctccacctcctgggttcaagcaattctctgtctcagccttccgaatagctgggattacaggcacatgccaccacacccagctaattttttgtgtttttagtagagacagggtttcgccatgttggccaggctggtcttgaactcctgacctcatgatccacctgcctcgacctcccaaagtgctgggattacaggtgtgagccacctcacccggctgaatctgggactttttctaagaaagcagaagccattgcgaccaaaaccattcagcagacaggatttgaacccagctcggtctgattccaaaaccagaaggacaccatgtcttccttaaaggaagaaggcacatcagaccatctgtcaagtgggtccactgagggtcagaggaagagcctccagatgagggaacggtgtcagcaaagccagagcccacatgggacgaggcggccccagagccgatggcctgagcagagccagtcgtgtgtgttatgggttttcgccttagcagaggcctcacaggctccctccccacgtgtgtctgcatccgaatctcattttcgctttgcaataccactgtgagaagagcctgctgggaggttcttcccctttcccagatggatacactgaggctcatgcaggtgacaccatttacccgatgacctatgtaaagtcagaaaatgtgccgggggtgctggggccccgggaggaggttgagctggactcgccactgggcagccaaggaggctgggtggtcctggcacacacagaggtcatggggcagcatggcccctgctgtcgtcgaccacttggagactggaggacttggcctttggatttggatagaggagccctctgtcatgggtgctgttcagttcggggaggtcacggaggtccccaaatggggatggtctcactgccgtgccgcctttgctggctcctccccaccctgcgactcagtttcctcgtctgtgaaatgaggttgagctagttggtcactacccagttcagctctgacactgtcggactctgagtctgcctgggtgggtctctgattccgcatgggtgggtctctgattccgcatgggtgggtctctgattccagaggatgctggcacaatgagagttttggggctgggaccgaggtgatcgggtgccaagaggaacaaggaagtaaggggatgtttcaaatacagtttcattccgggttgctctgagaactgagtggggaacaggccctgacggcatccagggacagggccaggacgtgtgggggttaggggggtgcagggagtggcaggcctgtcccagctccgtctactagcagaagaatgggcagccgtgagctcaggtgcgccaggcaggggaaatggaatcggccgtcatggatgtcctggcagaagtggaggccgaggaggtcctctagaaaggggtctcacccttctccacaggcccacaaggagcctctttctcctttcacacccaggacgggccagcaggaccagagcagtggccattgaaagtaacgtccaaacaggaagataaggcccaggaggctctgagtcccgggttcccagagctttcctgccgccacccagaagcccagcagggccctcactggcagctggcccttcctccccaagagccagagctcagacggaggctctcccagggatggcctccaccagggctgcagcagagcctcggccatctctcagccctcccggacagggaaccccctcctcccggttggttctcctggggtgagcttgcatggcagcctgcttcctcccacctcctgttccctacaccgtccccaccaccgccctcccgcatcaggcccctgtcctgcctgcccgtgcctgatcgcctgtaccccgatccatcgctcttcttctcctcacttctctcctccctcgtgcacctctggcccctgcccattgctgagatggttgacccctttggccctcagcaaatttaacattcaggaaaggtccacatttcataaatccctgtaattctagggttgggagatgctccatcgaaggtcactttggcccatcccggcagcccaggattgaggtctccaccttgccccagacacagccagcccctcagaaaccaatgcctaccagccagacccacgggaggacaaccgatgtacaaaccagaaggccggtgtattaatttaaaatggaaagcagaactcccaagctggctgaatgcttcatttgcaggttgatttattctcccctgtgtgggtctgtcagtcttccatggaggctgatggaggctgtccctttgcaaggattgtgtctggtgacggggctgccccttcacagcttctggatagctgaagactcaaattggaaagcttgacgagcctagaaacaggattaggggagaggagggtgtgagactgcatttcccaaaacagagcattcttgcatgaacagctttccaaaaaaagaaaaaaaaaaaagacaccgtggataatgaagcttgcagaaggctgcgctcacccgcttctggaaattcgcactgtgcatcggcctcatcaaagctctgaaacaaacaccaccttacaggaagttttccaaactgacctgaccacgaagtgttttccctcaccctccctaatactgtccgacgggcaaggccaggctactgccaggaatgatttcccaggcctctctgaggtggggaggtggggagctgggtccccgtgtccaaggcccctgccctcccaccaggctttttcctgggagcagcctcccaggatgcccccttcttgttctcctttgaccggcttttcaggtacatcctttctcgatccatgtcactgatgctgcctaggcactgagggcctgctccaccctgatgtcagccggggaggcctttctgtgcaacagaaataccacaccagcaacacagggacaaaaggaacaggttacagggattaaacacaaaaacataaactgtgggtgccctgaactaataaaggagcagatgtcctcaagggatttagacacagaggcatggacctgggctgagttttggggtgaggtgtggggaaaccagaattgctccagtttatagagtggccaagatctgcagggtcagggatgatctgggagggaggggtgaggagagccttggaaaggaagacaaagccagatctagcaaataaaaatagagaatatccagttaaatgttactttcatataaacagtagatgatttttttaagtattataatcacatacaagatttgggaacccttatactaaagaagatttgtcatttatgtgaaattcaatgtggctgaagatcctgtattttatccggtaatccatgcagtagcaggagggggaggctccgttggggggcagcagggttgcgggttgggggagagactgcctgcctcttggcgacaggcagcagctggccatgcagcatggccagtggcctggagatcacagtcagagctctccagcaggcgggtgcctcacggagatggggcatgggggcagaaatcaaagagaaacgccacatctcacactgggattgacgcagggacagaggacgaagcagaaatgccttgtgggatgtgcagcccaagaagccacaggcaggacatgggagccggaggcggcacgagagcgtcacccgcaccaaaggattctcggggtctcgggacttgggagccggaggcggcacgagagcgtcacccgcatcaaaagattctcggggtctcgggacttgggagccggaggcggcacgagagcgtcacccgcatcaaaagattctcggggtctcgggacttgggagccggaggtggcacaagagcgtcacccccaccgaaggattcttggggtcttgggagaaccttgtacttgacgagggaggcggaacgggcttgatccattcttatgtctaggccccatggaaagaatgactccagttggcatttgtgttgtatgtttgtatacacacacacacacacacacacacgtacatatggatctgtgtgtgatctggtccattggtctatgttggttttacgagtctaactctcggaatcctagtgataccttattgttatccttgttaccatcataaaagggacctcagggtccagtgatgtagtgtgtagttatgtatactgctttagaaacatgaagaaactcaggtctgggccaggcacagtggctcacacctgtaatcccagcactttgggaggctgaagcgggcagaccgcctgaggtcaggagtttgagaccagcctggccaacatggtgaaacctcgtctctactaaaaatacaaaaattagctgggtgtggtggcacatgcctgtaatcccagctactcgggaggctgaggcaagagaatcacttgaatccaggagacggaggttgcagtgagacgagatcaccactgccctccagcctgggtgacagagtaagactctgtctcaaaaaataataagtaaaaataaaaataataaataaataaaaataaactgaggtctggaggcgtgaaatggcttgtccagagccacacagcagagccgaaacaagaacccctgcagtgaccacagctgtttctgccgttctaacttctctctccacattcaaatgagttaacatctgtgtgtgtttccccgtctgtaaaatgggaaccacaggagtctctcacagggtggctgcaggattaactcaaactgtacgtgattagaaggtgtgtcccacaggtgggtgttcagtaagagctggttgttttgactattatgtttacacctgtgttttttcagtctgaaaagctgaaggcatgacaggattagaagtgaatgaaaagatgtattgagagaacacccatgaaaggaggagggtctgtcagtcatctgctgctgcctaacaaatgactccaaaactgagtggcttcaaacaacaaacgagtatttcacgcagcagcacactgctcccctccccatgctccctaagtgggccgaggaagctgttctttatttctgtttcttgatttcaacagatgcagaaaaagaggagctgttctttgaaagacagcatgggtggtgcagaggatttggggctcagggagaagtgagaccaaggaagtcacaaacaagtaattttcttttccatcagctcatgtttgctaagctgcagcctgtctctgtcgtgccggtgtccccagcgggagccggccctggagggaggcaggtattgaggaaggcgtcacgcagcaggtggcccctccgcggagtttttcaagatggtagaaattaggcaggccaagaaaggaaaggggtctctggcagacggagatgaagcaaacatccagctgtctccctcctcccctcgcccttcagcgggagagatctggtcctccaagcggccccggccagccctgggtggactgttagttcatcactgcagttggttggctggacgctgaagttccaggaaggtttctgggcctgaccctggctccctgccttgtcgggttcccatctggagggcatgagcaggagtgacgctggccaatcaatcagatcttcagatgcgagtggatattgaaggctggtaggaccggaataggtggaggaggagcccagtggtggacgaaagggccaggacacactgtcctctcccctgccctcatctgccctccctgtcaggagctgcttcccctgtctgctcccctcctcctggggaggagctggggcccagagcccacacactgtatgcaggattgcaggactgaggctgagtgcaggactgccggcatgaggcaggggtggaaatgtccaaaatacctgcagctgggagacacatgcacgcgctttctccattcttcccattcttactttaaaaaaaagcaatatacaaatgttttttaaaatctgacattagaaaatcacatatattaattatatttaatttataattaaatgtatatatttttatatatttaatttataattaaatgtatatatttttatatatttaatttataattaaatgtatatatttttatatatttaatttataattaaatgtatatatttaatttataattaaatgtatatatttttatatatttaatttataattaaatgtatatatttatatatacacttaatttataattaaatttatatttaatttataattaaattacatatattagggctaggtgcagtggctcacgcccataattccagcactttgggaggctgaggtgggtggatcacttgaggtcaggagttcaagaccagcctggccaacatggcgaaaccccgtctctgccaaaaaatacaaaaattagctggacatggtggcacgtgcctgtaatcctagctactccagaggctgaggcagaagaattgcttgaacctgggaggcggaggttgcagtgaaccaagatcacaccactgcacttcagcctgggtgacagagcaagactccatctcaaaaaaaaataggccgggcacggtggctcaagcctgtaatcccagcactttgggaggccaaggtgggcggatcccctgaggtcaggagttcgagaccagcctggccaacatggtgaaaccccatctgtactaaaaatacaaaaattagccaggcgtggtgtcaggcgcctgtaatcccagctactcaggaggccgaggcaggagaatcgcttgaacctgggaggcagaggttgcagtgagccgagattgagccatcgcactccagcctgggggacaagagcgagacttcatctcaaaaaaaaaaaaaaaaaaaagaaaaagaaaaagaaagaaagaaagaaataataaaataaaatcacatatattagaaaatcacatataaccctccttctccatagttaaacttaataattttttgctcctaattttctcatctacatatatattttaatatagctgaaaccacactgtagatacaactttttagtctgttgttttacttactatattaagcatgtttaatattactatgtatctataattttaagggaagagcttcatcaagtagttataccataatttaacaaacttttcccttattattattattttttagacagctcttgttgcccaggctggaatgcaatggcgcaatctcggctcactgcaacctccagctcctgggttcaagcgattctcctgcctcagcctccagagtagctgggattacaggcatgcgccatcacgcccagctaattttgtactttttttggtagagacgggggtttctccatgttggtcaggctggtctcgaactcccaacctcaggtgatccgcccgcctcagcctctcaaagtgctaggattacaggtgtgggccaccgcacccagccaacttttcccttattgttgaatatttagatagattgtttttgcttggtttgctggtttcactactctaaatatttgccatggaaactatgcctacagcttttccctctcttttagtatttccttaggatagattcccagaagtagtattactgcatcaatgtgtagaaatccttggtggctcttaacacacattaccaaattacttttcaaaaatttgcacctcaattgggcacagtgactcacacctgtaatcctagccctttgggaggcagaggtgggcagattgcttgagcccaggtgttcgagaccagcctggggcaacatggtgaaaccccgtctctacaaaaaaattagccggacatcgtggcaagtgcctgtagtcccagctactcaggaggctgaggtgggaggatggcttgagccctggaggtggaggttgtagtgagccatgatggcaccactgcactccagcctgggtgacagagtgagaccctgtctcaaaaaaaaaaaaaaaaaaattgcacctagaaatgtatgaaagtgccactttcaccaaatctttgcaagcactgggaagtatttttaaaaatcattttatagttcagtagtttaaaaatcattccatggggccaggcatggtggctcatgcctataatctcagcacttcgggaggccgaggtgggcggatcacttgaggtcaggagttcaagaccaacttggccaacatggtgaaaccccgtctctactaaaaatacaaaaatcagccgggcgtggtggcgggcgcctgtaatcccaactactcaggagactgaggcaggagaatcgcttgaacccaggaggcaaaggttgcagggagccgagatcaagccatcgcactccagcttgggtggcaagagcaagactctgtctaaaaaaaaaagaatcatgccatgtattttaatgtatttttttttaccacttttgagagttaaatagctatttttcctgtgcgtgtgtgtgtgtgttctcatagtgaattgtctaaacaagtccatccagttaggatcttagtatttttcttatcaatctaggtgagtgttttcattaaatactgatactgatagggacacttttgtcagatttgttgcaaatattttcctttccctataatttgttccttttcttttttttttttttttttaatgaagtctcgctctgtcccccaggctgcagtgcagtgacatgatctctgctcactgcaacctcacctccctggttcaagcgattttcctgcctcagccccccaagcagctgggactacagacgcctgccaccacgcccagctaattttttgtatttttagtagggacggggtttcatcatgttgggcaggctggtctcgaactcctgacctcaggtcatccgcctgcctcggcctctcaaagtgctgggattacaggcgtgagccaccgcactcggcctgttgtttttctttatcctctccttttaaaatgttaaaaaaacagactgggcatggtggctcacacctgcaatcccagcactttgggaggccgaggtgggcagatcacgaggtcaagagatcaagaccagcctggccaacatggcaaaaccccgtctctactaaaaatacaaaaaattatctgggcatggtggtgggcgcctgtagtcccagctactcgggaggctgaggcagggaggcagaggttacagtgagctgagatcgtgccactgcactccagcctggcgacagagtaagactccgtctcaaacaaacaaacaaactagtgggtttggaggctgacctgggaagactgcttgagcccaggagttgaaggttacagtgagccaagatcgcggcactgcactccagcctggggaacagagtcagaccctgtcccaaaaatacacagctggtgggaaacaggcgtctgcgcacggagtccctggcaagctcttccacgtgcccggcgtcaccgggctgcacccgagcagggtggtctgcctagcacgggagggggtcacgatgccaatcaatcaataaataaaaaatcattttatagttcagtagtttaaaaatcattccatggggccgggcgtggtggctcttgcctgtaatcccagcactctggaaggccgagaggggtggatcacaaggtcaggagctggagaccagcctgaccaacatggtgaaaccccgtctttactaaaaatacaaaattagccaggcgtggtggtgggcacctgtcatcccagctactcgggaggctgaggcaggtggatggcttagaacccaggaggtggaggttggagtgagctgatatcgcgccactgcactccagcctaggcaaccaagcaagactgtctccaaaaaaaagtattaaaaataaagctagatttaatgaagatctgaaggatgctttgcttcatcaatttcagaaagaaatagaagacctgaaaaagaagctcacagaaggggaagaaatatcaggctgtgatgtcagtgggtcggacggagatgacaatgaagagggtaagattggagaagatgaagagaaaaggaaaaaagggggaaataaagtcttcccagagaggacggttgaaacgccggcgacagcggatgcggagagaaaggcacttgaaacaaagcttgacgtggaagaagaaacaaggctgcagctaaattcgagaaacaggaaaaaagatcttaaaacccaacaagagcatcagtctttgccagaaaagttctctgccctggagaagaaggtaattgttggtggcgttgatttgttggccaaagccgaggaacgagagaaacttcttgaagaatctcatacagagctggaagaaaggaggaaaagagcagagcaactttgcagagaacttgagggaaaaaggtaagaaggcttggaaactgaaggaaaatagaccagtttgcaagaggaaccacagggaaagaccgagatcttaaagaaagtttgggccgggcgcagcggctcacacctgtaatcccagcactgtgggaggccgaggtaggaggatctcgaggtcaagagctcgagaccagcctggccaacatcgtgaaaccccgtctctactaaaaaaggaggcttggtagagttactggtttatagtgtgttctttaagaatccttatgttgcctataccaatagttagggtgttaaaatgtaatcgtattctctgtttgtgtttagattattataaagtagaaatgtaataaggcgaggaggttgcatcacacacttgccccatgaatggaatccattccatatgctatttcattcactttctggagaaaggggaatttttttgcagcaaaaatttcaggtgactttgtggtagggggcggtgctacttcatctgtaacatatttttaaaaccatgattatgctttgggttttttgttttttttttctttttgctttgcttctgtttctttttagtctgtttttaatatccttccccttcactttaatctcaaggaaagtcctctttcctgcagggctgtgaattaaagaatgggcagagtttacgtttaagtaagccagtgtctgctcaatttcctaatgtacacatttgttttctttttaattattccttgttcttaaaaatactaggagaggccgggcacagtggctcatgcctgtaatcccagcactttggggggccgaggtaggtggatcacctgaggtcaggagttcaagaccagcctgaacaacatggtgaaaccccgtctctactacaattacgaaattagccgggcgtggtggtgcatgcctgtaatcccagctacttgggaggctgaggcaggagaattgcttgaacccggaaggcagaggttgtggtgagccgagatcgtgccattacactccagcctgggcaacaagagtgaaactccgtctcaacaaaaacaaaaacaaaaatcctagaagaatagaagaaaacatagatctttttctttctttctcattctttcgttctttctttcttctctctccttcctccctccctcactctttttctttctttctttctctttctttctttctttcctttctttctccatccttcctcccttcctccctctttctcgcttgctctctctctttctctctttatctctttctttctttcttgttctcactttgtcacccaggctagagtgcagtggtgcaatccccactcactgcagcttcaacctcctgaggttcaagcgatccccctgcctcagtcccccaagtctgagactacaggcatgcaccacctcttcaggccaatttttgtattttttgtagagatgcatttttaccatgttgcccaggctgggaaaacatagattttctagtgcccttaaacttatgatgtaatctaactcatttaaataattaataacttcagcagtattactgcaatactgtatactggccaaaattacaaagtgaagagtaagtcagctgcatcaatttcaaaaggcatgctttcattgtactttatgtataaattgtatctgttcaagttgtatatattgatattgttgtatatatgcagcatggttaaataagaataacaattttttacctaaaaaaaaaaaataaatggaaatagcagtaatcctggaccagaggagagcactggatctcaacctagaatggaggccctcctacagacaccctggcctgtgagggagcagggcccagggtaggggacccaggaggtctggccgtgcagatcgattatggaagctgtgaacagtggagaagagttatgctttgttattttgttttgctttggcaaatgtaactaggacaaaaattgtccttctttccctaggcagctatgggaaattctggctttgcctatgttactaaccactcctcaggaaacgagaaaagtgatcagactcttccgaggaggtcagtctctggagttggctaacctttcagtttagctcttcaagacccacgggcttcctgcaaaccttggcggtggcctccagtggaatatgaagtgaccagcaaagtcccatgcggggggctggtgcatgttttcgaaggaggaatcgtatcagaagctgaaggcagctcacatcacaacttgtttgcagggattttgtcgcatctttcagtaaaattagcaaaagtgtgacagcagttatagagatgtctgctgaggctggaaaaatagccagtgggtgactctgcctccccagtgaggctgtgggacgagacctcccaggctaggctgcaactaaacggcagaaccgaatgacagagagtggcaaaaaaatcattaagcagttttagatcaaaacatcttcccactgggcaagtatataattttccccaccaagatcaccaagatcagacaagggggccgggtgcggtggctcatgagtacttaccgtgtacctgttacttgccaggctgtgggtacaggagataaacctggtctctgccctcatggagcttcctgtctagtgggaaatctttccccagctgtctggtgtccactccctctgcctgcccacttctgacccttgccctcttcctcccccgccctgggcctcgctcctctcttggcacctatgggcagagaaagaggttgcccaggttatcagccacacccctttgggctccgtttccatttcggagtgtggcctggtctctgctctccccagggaggttttgtgcattagtcactcggcttgcggaacatgggtcagcagagatgatggggtcaccaggaggacaaggctgcagagcaaggacttgccccagagtctcaccgcctctgggcccctctggaatgaccacggccaagcctgtcctggggagaaaagaaggcacaggccggtgatgggtctagctggggctggcgctaggtgcggggccccaccggtgacatgcctgatctgtccacacgcccggaggagggcagtcccggctgtcctgggctggcctgcgctgcccccttccctcctttccagcctgtcacaaaccctggcacttcctgcttggtgcctcggttcaggcctgggtcttgctccctgggaccaaggaggggcttcctccctgatcacccccgccccggacaccacaccttcggttcaccctgtgcccacctctgcagactcccaggagcagccctgcacagcgcctcccccacctccaagccggaccaggccacaccctccccagtgcttctcctgctcatccatggacaacgctacaggccaccgagttggcccccacacccttcctgggggtgggggtatctttatgaaaatggaggggaaatagagatgctctcagcataacagtgcaccagagtcgtgaggccaccaatgatggcaaaagaaaggtgcgctggttttgtggctgtgcctttccgagggccattttctttcaccctctcccctcctccatggctcctaaagtcttctcgtctgctccaggaagaggaagattggacggagccaaggtcctgggtggatagaagggcctccaggaccccctggatgtggaggagggagggaaaagctagggtagagcagaaagaatccccagtgtccccatcctgggcgaaggcggctctgaacatgtaaatatttgatggatttacaagaaagatttccttctggaatagactgtatctttacactctttcagataacatgggaatagttgaagagtcctaatgttacaaggaaggggtctcgatctagatcccaagagagggttcttggatcttgtgcaagaaataattcagggtgtgtctgtaaagtgaaagcaagtttatttttttgtttgtttgtttttatttcgagacagagtcgctctgtcacccaggctggagtgcagtggcatgatctcggttcactgcaacctccggctcccaggttcaagccattcacctgcctcagcctcccgagtagctgggattacaggcgcccgcaccacgcctggctaatttttgtatttttagtagagacagggtttcaccatgttggccaggctggtctcgaactcttgacctcatgatccaccacccgccccagcccctggcctctcaaagtgctgggatgacaggcgtgagccaccatgcccggcccgaaagcaagtttattaagaaagtagaggaataaaagaacagctgcaccacagatggaggcctgagggctgctttgcccatttttatggctctctcttgctgatatgctaaacaaggggtggattatccatgcctccccttgctagaccatgtaggggaacttcctgatgttgccatggcatttgtaaactgtcatggtgctggtgggcgtgtagccatgaggacgcccagaggtcactctcatggccatcttggttttggtgggattgagccggtttctttactgcaccctgttttatcagcaaggtctttatgacctgtatcttgtgccaacctcctatctcatcctgtgacttagaatgccttcaccatctgggaatgcagcccagtaggtttcggcctcatgttacccagctcccattcaagatgcagtcgctctggttcacacgcctctgacacgaataacaacagctaaggatgatcgagtctctaccgcatgccaagcacttagcattgtgaccactctttgtggcaaattcttttgatgtctatgatacggaagagaaaaccaaggctcgagaagggtgagaaagttgttcgcgatcctacacccaggcgggagtggggtatgcccaggcggtcttgacgaaagcccacgttcctagccatgacactggtgaggtggccacgaagaggaagggacctcccatcactccgaggcccagctgcagcccttggaaggctgcacacctgagcgtggtgtgcgctgaggccgggcctcccggggcagccccaggcagcggctggctgcggcaggggtgggagggcaggggtaggaaggcacacggcgggtctggggcgctccctccctcgttccttcacgcaggtgcagacttgcatggccgtctgaaggctctcccagctcctctggctgcctccttattttctctcacacagtcacctcccctaatagaaccctggggagtttaatccccatctcacgactgcttcccggaggagccggacgcacacttggctgtggatttgttctccagccacgctcagctccagccgggaccgacgcgctgaagccgcagggccgggtgccgccggcagggggcgcgcgcagacagggaggccccaccccggcccgcggaggacgcgctcccctcccagcgcagccccggcctcagcgcctcggtccgctccgcctgcacctgccaagcccggcgtgctgcaaagcctcgctcaagctcacgttaattccaagtgaagctcaggggctctcagtcctgggtgctcatgacaactccgtggagagctttttaaaacttatgggccaccgcctggctcggtggctcacgcctgtaatcctagcactttgggaggctgaggcaggtggatcacctgaggtcaggagttcgagacccgcctggccaacatggcaaaacccccgtctctactaaaaatacgaaaagtagccaggtgtggtggcaggcacctgtaatcccagctactggggaggctgaggcaggagaatcacttgaacttgggaggcgcaggttgcagtggagctgagatcgtgccatttcactcagcctgggcaacaaagcaagactccgtctcaaaaataaaaataaaaaataggccagccacggtggcacatacctgtaatcccagcactttgggaggccgaaatgggcggatcacgaggtcaggagttcgagaccagcctggccaacatagtgaaactactctattaaaaaatgcaaaaaattagccgggtgtggtggcaggcgcctgtaatcctagctactcaggaggctgaggcaggagaatcacttgaaccgcgggagacagaggttgcagtgagctgagattgcaccattgcactccagtccgagcaatagtgcgagattccatctagaaaatataaataaataaaaataaaaataaataaataaataaataaacctggccacggcctagggaccgtgcaactcttgatcacctacaaacacctggaaagcacacgttgtggcaaacatgggctttggtgacaggaagacctgggtccagatcttgcttgctacctgcttactagctgtgtgaccctggacaaactgctgaacttctctgaacttggttttcttagctaaagagagagaatataagacttcttatgcttgtcaggaggattcgtgtaataccatgtcaagttccaagcacagggttctctctggtggaccagtcgttctcagcgaggacagtgatgacccctagtggacagtgtgggaagttctgggagtgtttcaacgaggacagtgatgtcccctagtggacagtgtgggaagctctgggggtgttttcagttgtcaccgagccaagggctaccggcgcgaagggcccggcctcctgcaatgcgtggggcagtgatgcgccatgaggaaatgtcacggatcctacgtgacaaaatagtcttgcgaacaattttaagacaaactgaattttccgggaatgcaactactgtgtaagttgagaaagtttcataacgtgttttgttcggcactttaccaacagttgttcaccgacgtggaaatcttatcactggcggcacctgccgcgtgtggtatctgagtggccgtgactcgtgcgtccgccctcgtgtgtcacacagtcacttaggcacaagcatctgacccttgtaacatcttagagaaacgcttctcacgcgccagtgcacacaaatgcctgcggaacttgtcaaagtgcagtctcctgtccagttggtctgaggggggacctgagaaactcatgctatgaggtcctagtgtagtcacgcctaagtgtgtgtgcagagaacacatttattataaactacgcttctcttatctctcctttttttttcttttttttgagtcttgctctgccacccaggctggagtgcaatggagtgatctcggttcactgcaacctctgcctcccaggttcaagtgattctccagcctcccaagtagctgggattacaggcatgcgccatcatgctgggctaatttttgtatttttagtagagacgaggtttcaccatgtcagccagactggtctcaaacgcctgacctcaagtgatgtgcccgcctcagcctcccaaagtgctgggattacaggcgtgagccacgacacccagcctcttatctcttgtacaacacttagggcatcatcttgggtcgagttccccaggaaacactctgagagggagatttgtgtgcctgtgaggggcagataatacaggatcgggcagagggagaagtggagctgtgatatagtcatagcagaggatgcagctggtccctcagggcttaggcctggggtggccttcagagatgtcccaaattgatgccggagtggagactcgaccggtcactggatgtgtgcttcccctccccccagggacaaaaatgtggctctcttgggcctcagctgtgagctgtgagcagccgacactcctgcagctggaggaagggtcttggtcctggatgactggtgtgggtggcaaaccccaaatctgcgatcaacagtacgctgatgtttaaacatggtatgtggacagattacattacctttggaatttaatttcagtatagtaaggcaaaccccgaatctgtgactgacagtaggctgatgtttaaacacggtatgtggacagattatattacctttggaatttcatttcagtaaagtaaaggtgttgcaaaatatttgtcctagaaagggaacactgagtttcgtaggtttacagcctctgtacagggtaaatggcagaggctcctattaccagaaatgatagttcaccaagctcagcaaatacctactgagtgcctaccatgtgccaggcgctgttttaggcacttggagatacatcgatgaacaaagcaatgaaggcctgtcctcactggagcttacattccagcaggtgacaaggggttacaggctgtgatcacagttttcagtttcaggcccacatctgccctctggatgacccacaaggcatcccatagttggcatcagtcaatgggtacctagtttacagcaaacccaccacaacagctggacaggcacagagaactcttctctctgaccagaggatctgtgcttccaaaagtatggaggaaattcccattggcttttttttctcgttccatcttctctttgtttggccgcagaggcagctgcagtctcaggaagtgtgtggtgaagcagggaagctaaagcccaggccttcaagccaaagagccagaaagggtgggggaataagggtggggtggggtggccccaaagccagaaagtgtcacagagactgaagagaaggaggtgctcagggcaggaatcccataaagctggatccaagctcctgggcccatccctcgacggcacaggcatggaccgtaaatatccctcgacggcgcaggcgcgggccgtaagtatccctcgacggcgcaggcgcggaccgtaaattgcacaccgaaggccctgagaactgaaccgtgggtagattatcaccccggtcccagactggccactggtttgtgcacgtgtggggcagatcccaaccacaaaatacagagacttgaaaactgacattggagctgccctcgctggaacttggggtctcagcctaagtcaactacctgctaaaaccaacctgctgacaaacaaaaataacattctctgcaggctttaaacaagacccagaatctcataacttcatcttcacagagtctaagatacaatccaaaactactcaacgtacaaagaaccacagaactctcacatctcacaaggagaaagacaagcaactgaggccaatcccaagatgaggcaggtgttggaatatcacagacgttaagcagctgttataaccatgctccaaggagtaagaacaaacactactgaagtgaacaaaaagatacatcatcttggcagatacatgaaatattaaaaagaaatatgaaaattttagaactgaaaaatacaacaacccaaatagaaaattcgcctgagaggcacaagatgagaatgggccacaggccatggacctccacaggcagccccgaggcctcctcgggtttggaggacgtgggtggagggcactgagaccagcaccaaaacaagtggctttggtcccagaacccttgatgctgctgccactcaggccacccatgtccaaatctgcccagtcctgcctggctcacagtctggctgtgcctgcctcccctcacctccacccctgccccacaaccattacgcatttcctcaactgcctcctctatgagcccctcccacccagatgcaagctcccaccgggaggggactggtgg

SEQ ID NO: 24 - DNA, 78033 bp, Homo sapiens
gaagatttcccaaaatgttttacaaaatggcaaacacttgcacttgaaatggataagcaaaacaacatgtgtggtcagtatcatccatacacttagatgttgaagctaactaaaacttttattacaggaacaatatttgaaaattaccaaaaggaaacaaaaagaaatctccaagtcacccgatggaagagaaacctaaaggcagtatacaatgtgttcccttccattcactgtgccttctactactgagaacactgacttctctcatcaaacacagagggaagaatgggcctgatttcacacaggacagggaaactgctgggtgtggccctgaagcatgcattggcccatttccctgcccgctggccctggttgcatctcatgctcagactccctctccctcctctctcaaagcatcttcatacagggatgggtaagaagtgggatccctcccattggcattggctatgtactcaagaactttcatcttgctggtctcagcgtgggcccttggaccccacaggaactcatagcatgcaggatcagtgccgggcacctgccggtacaccaggtacttttcctgcacccaattttgggtgaggagcctcttgggctccccaaagaggaagtgctcccttccagcatacacccccataatgctcaggacttcccacataacctcttcagggatgcagttcccctccatgaagattacacccaggactattatcaggaggccagacttgggcatgctctgctcattacactgtatgccatcataagagaggttgagggaggtgacaaggacataggagtggctagtggggtccacttccttcacatcaatgccaaagagcagttgcatgcatacagaggcttccctaaatatctcaggaaagtagtcctcataatttttgatgacactccccagcatttctgcctttgtgatcagccccttgactcgatacttgcggagcaataaatgaaccaaatcaattatcttgtcatgtagtatatcttgggaaaaggactcagggtctatcaggtcaggcgaggtacttggcccctccttttcttggctgccagagccctcatcagataggctcccaaagatggcatccatggcagtgggagagaaggactcttcctgaggactctggggaggacttggtgactcagcagcaggcaactcctctagagtgcccacattcagagtagaggagaagaaggcagcctcctgctcctcagcttggagagcctgtgcacccaccaggcccaggtcttcttcttgggcctgaaggccttcctcaggcttgcagtgctgacttctttgctcaagaggcatgatgactctggttaggtcagcaggccgaactgtgggaaatatctgggtgatggggccccacagcctggggagagagggagcgtgagaacagactcagatgagatatgaaccatggagaatctaacaaaagcctacttacacttgttctcctccagtgatcctctgggttctcctgggactcctgtcctccaggttggcctgttctctaaaaacctgaaaaaggaagtgagaaggctgctcaagatgcagctggacatcagagcaggaggctccaggactgaggtagggcaggtgaggttgcaagctgggggtccctttctgtactggggcaggtggggccatttgtagattaagggtgaacatctcatcttgactactggcactgcctaggcttcctgtgttctgagatctgaagacattgcttgagaccaaggcctcactgctcagtttttggagcttctagaagaggaatcatggggccatcaggctgcagactgcaagcacccatcctggcaccccagcactgtcagaaaggtgggccaaactctgtgagtttctcacttttttggagtggatggtcccctctgtgctcagggccctcacctttctcctgccagggcctggaagacacagctctcctgacctgagaaactctcagatcaatagctctttcctgatatgaaagaggacatgtggggatacacatctggccacatgtacacagggctacccaggaaggacagcaagagatggtgacagtcagcagggtccatgtgtcctcgggtaaggagcctgtttggttcccatcttgatgcctatcttggcctgggaccctccctctgttgacctgacgccatctccttaaaccaaagctctacctccaggagacatcagaagaggaaatcagggaaatagaaacacccatggtcccagggacttcccatagctgacagaaggggcagggaagggctgagtcccatgtttttggtaagtgctgtcccgtcagcccccaccttgattctggtcatggcctgggaccctcccactgctgacctaagtgcagccctctcagaccaatgtctcccgctccctgagaccaatgatcccagtataagagaggggtctcagcacatagtcctgcacatgctctctggggagacagcaggggcagagcagatttctaagcagccctctgtgttctggccaggaggaaccctcaatcctccctcaggtttctcacctggactcttggcagatcctgggaccactgtagttgtggaccatatggggctctttctgttgactggaagtcgtcctctgagaacatagtgctcacctgcccaagattccaaaacagaagtaaggggccccacgtcccatcaccccatcatgtggttgtccagggctgacagcagaggctggacccttcggttctggggattccaaagtcctcctgtgggtttttcatctttacttctgccagggcctgtccttccttgactcccaacccctgagatgagcagacatatccctttacaccaagacctcatctccctgaaggtttcccaactttctgcctgtggtacaagtgaccttgccacttggggccacccgtgatgaggtccccatacagccaaggacaggggacagagagactctgtgggatcccttcattatgggatgtgggtatctccagtcctcaccaaggggacacatacaccttgagtcctaaagatcctgggactcctccctctgctgatcaggtgtggctccacctgctgacctgtcatcacccccttgaaacaaggtgctcacctccctgagcaaggtgccacccccaacctcgtggcagaaatgtgagcatggcacatgcctccccaacttgggcctccgagggatgaaaacagaggaagcaaggattggtgaggtccctttttctttggcatgtgggagggtacattcttaccttcagtcttcatcaattttcctctccttgactactggcagatcctggactccaccctgtgctgaccaggtgtgtatccctctgctgacctgaggacctgcctcagaccaagggccccacctctctgagatatgggaggcagaaagtgaaggggcactacatggacacccctcatgggatgccaaaggctgacagatgaagcagatttcaggggtgcctcctctctctgggtttcctccaggtattcagatttactcctgacaaggcctatccatgtctctcctgctgaactgtggatgagttttgcaggccacgaccaccatctcccagagaaccccaactaggaagtggggagctgcctctctttcctagagtcctgcttggggcctccaaggaccgatggcaggggcaggttttctacctcagggataattggttgcctgagtcctccctctgggactcctccctgggttgacctgaggctccactcctcagaccacaacccactccttgctgacaccccaaaggcagagtgaggatgcaccacatgtggccactgtgccttggaactccaagggccaaggtccctactgacctggagtccaaagtctcctgagtcctccctcttcttcttcctcttgatgctggcagggctgcaccccagaccccctctgcggaactgagtctccatccctcagattcccaaggctgaatgaaaaggcacctcagtttgagacggcgggactatgggggggggctgttctggggtgctgggtcccttcagttgtccctcaggccttgctcacctcccagcagggactgagccctgtctgtgctccccctaggtctttctcatgataccaagccccttccctctgtcagcccaggatgcggaaatcaggatccacttgcctggcagcaatgccaggaacttcccaggactgacagcagagagggagccttgctctgtggggcctcagccctccctcggggtcctgaccttgatgcctggcagaacctgggtcctgccccccccaaccagccctgccctggtcacaccaagctctgaccccacagtcccctgaggcttaagcggcggggggcagaagccgaggggggtgtcagaggggacggcccagcctgagaagtccatccccatggggtgatccagggctggcagcagaggcggtgctggattatctggggtcctctatctgggtagggagcatcctcagtcctccctcagcatctcatcttgcctcctcacagagcctgggcccgctgccctcagcaggtcacaagccgcccttcagaaccgggctatcacttctctctgaccccctaatgtgcaactccgcagtaccaagcccggaggtcctttgcgttgtctgcagggacaaggatggactttgtggcccctctatcaggatggggtggaacctctccataatttctcagagtcctgatgttgatgcctggaaaggccggggccccaccctttatggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctggacccgctgccctctgccactctcaagacacccctcagaaagacgctttcgcttctctcagatcccagaggcggaagccaatggaggtcacatccggcccccacgcctggagcttccctggatttacagcaggagcgaacccgattctgcccgtgtgggggcggggcgaggcgaggcggggcggggcgaggcgaggcggggcggggcggggtggggcagggggaaaagtagtggcgaggggtgcagatgtggtcgagggtcatgggggtgcctcagtcctccctcaggtttctgaccttgattccttgcagagcctggagctccgtcctctgccaatgatgtctgctcctctcggaccaagtctctgactctgagtcccctgaggtggcagtgagcgggaggtgtgaggtcgggggacaacattgccaaggtcttccggggctgacaggagggaccgagctggattctgtggcccctctatgtggggagggtggaccgtcagtcctcactcaggagggtcctcctcttggctactggttctttcatgaagtgatgggtgggagatgctctgtttctgtcacctctgagcattgcccaactgcaccccttgcagacaatagctgcggatcccaggctaggtgcttccatgtggcttcagtacccgtgattgtagtgacctctgggagaagatgcacaccttcctacgggggctcctccccagccagatctagactttgcaaacttttgccctgaaagctttatttttacactgaagaggctgagtggctgcaagaaatttgcggaagtcctgcgtttagaatttatctaacacttcatagttcattttagtgattttcattttttaattctcattcagtgtcaaaaatcatacttaacctaactgcctatttcactctaatggtcaatactctaatttaatccattctttatcttcaattaaaacgataatttttaaaaagccaatctttatctactgacgtggttttagtggttatcagcacaaattccagccgtattcctttaatcaaccagtgtttcctcatgtcctgaagttaccccatgactactggcacctgtggtctgagaccctacccgagttttccacagtgaagtaggggcagaattttaaacatttctttcttcctatccaccccaacttccctgccactcttcccccccaatcacaagtattccttcaaaatacaatgaaattctcagggctctctcatgttttttttgtttagatttcttttttgatattgtttgcttgttcctttatttatttatttttattctttagttttcccgggttgttttggggagtctaagatagaagcccaagactgaacgcggtggttcacacctgtaatccaaacactttggtaggccaaggcaggaggatcacttgagcccagtagctcaagattaatctgaactacataacaagaccccatctcaaaaaaaaaagaaagaaagaaaaagaaaaagaaaaaagaaatgaaaaattagctgggtgtggtggcgtgtgactgcagtcccagctggtagggaggctaaggtgggaggatcactggagcccaggatgtcagtgctgcagtgagctgtgttcacaccactgcactccagccttggaaatagagtgaggtcctgtctcaaaaaaacaaaaccaaaccaaacaatcaaaaaccaacagatgcctgagcttgacagtcatcttggctggttaaggaattacgtctgtcaatttttgaaaaaatagaattgccatctttgcaatattctgttccctatcaatgatatcatatactgccttgtttatttgggtgctctttgaactggatatatcagtacttgtatagttgcctcagtaaaaatcatacatgcttttgttagtcttcttgttaggtaatttttggatattgttgctattgtgaatggggtattttctatgacctgttcttaatagttattgtctgttttgcaaatcttttgattttgctttattgatcttctgttcgctatttttcacatgtctcttattcatttgactatttcaagtgtgcatttttttgaattttctagatagactgttgcattaccctaccaaatatcactctttctttccaatatacatacctcttatttattttggtatccatatctgtggctttgtattccaatacaactttgaaaaatagcaatgatagcatacatttatgacctgtgcctgacatgaatgcgtccaacattttacaattaagtatatttgctatcaatttgatgaaacaaaatttccttctactcttaattttctagttatttttatcatggatgattactaattttttcaaaatatttttctgtatccattaatatgatcatatgttttgcctctataatcttgttaatatagggaatcacactgaaggtatattttaatgtcaaattgtattttcattctttggatatatcccgtttttccatttagtacactgccctaatgaattggctattaatttatttaggatatttgttgctatgtgagtaactttggtttaagtgttcttttcatggtgaggtcctcttctggtatttgaaacaaagaacactagtctcagaaaatgagttccacagttgcccatctttttgtatggtttttaagagtttgcttaggatggcaatgagttctaattatttggtaaaactggcctctgaaactttcttttcctggatcatttgtgggtggcttgaactgagaatacagttttagtttgtaatgtttgattaaagttttctgtttctttatggaccaatttgatctttttttttttttttcgagacagagtctcgctcagtcgcccaggctggagtgcaatggcacaatctcagctcactgcaacctcctcctcccaggttcaagcaattctcctgcctcagcctcctgagtagctaggatttcaggtgtgcgctaccacacccggctaatttttgtatttttagtagagacggggtttcaccatattgtccagacgggtctcgaactcctgacctcgtgatccacctgtctcggccttccaaagtgctgggattgcaggcgtgagccactgcgccgggccattttttttttttataaaatatagttcatttcacttaggatttcaaatttaatggcatgatattatgatgaaataactttattaaagtgtcagacatgtaaaatagtatagtataatatacccaatatacttgatattcagcatcaaaaatcttcaatccattactaatctgtttccaactatacttctacctaccccacgtctcaaatgctggaataatgtaaaccaactcagtaaccttggatagaatactggatccaataagccagttcatggtacagtgcagctgacctggctctgagacagcctatggctcagagaaaagggtctggcttcaatagaccagcctccctagacccctacctcctactctctgttccagggtcctgaggtactgcacgcctttgttctcttctagacacatgctcctataatactgctagctaatactgctttccagacacccttgggtctctctccaaatatcttctctgtgaggccttctatgaataacctttctttttcttcatagaatttgtgtctttattatttatttttgtaatttcactttcattttagattcagggggtacgtgtgcaactttgttacatgggtatattgtgagatgctgagatttgtgatattattgatcccgtcactcaagtagtgagcatagtacccaatagttggatcctgacctttcatcatatacaaaaattaattcgacatggattaaagattgaaatgtaagacctcaaactataagaatcctagaagaaaacctaggaaacaccattctggatatcaccctcgggaaataatttatgactatgttctcaaaagctattgcaactaaaacaaaaattgacaagttaacctaattaaactcaaaagcttctgctcagcaaaagaaactatccacagagtaagcagacaacctgcagaatggaagaaaatattccccaactacccatctgacaaaggtctaatattcagaatctataaggtgcttaaacaattgaacaaacaaaaacaaataacctcattaaaaagtgaataccctttctaaaattgcaatcctccctcttaactcatcccaaacacttattcagttctctagattcaatttgtttccatagtatttatcaccatgtcaaccaaaattaagactggttaggcaaaaataagaggataaatgtttattggaagccaaatgtgaggactgacctgggaggagaaaccaacaaagttgggagtgttctggagagtcttacaagttggaagggttttatgagagtttagaacaagagagaactttttatatggcagttgtcgttttttattagaggatacaatacggaggttagaatcattgtaccaaattgcaacatacagactaaaatgtccatgtgcaaaacaaccagtaaaatttcatgatttaaaaataaatcagcaaacttttcaatgttggtacattacatattaatccatatgtaaacaatttgtggaatgcaggataagacactttactgagggacaggatggcaacagaaatcacaagacctcccccaggtgagttcatttggaagcctaccaaaggtgatttggaagttaaccattaaatctactgcacctttaagtttgtttcatgatttattgtgtgcctaccctttacctcactagaatgtaagttccacctagggaggaaatgtgttcaatattgtatcctcagagcccaggacagtgcctggcacacaatacatgctcagtattcatttatggaatgaataaagaactgccagttctatggtcctagtatttggagcttctctggtactaaagtctcatggaattttcaatctttccaaacacccaacagccaaagtttgaatgctcccactatcttctaattgttggctcctggaccaggtaagcatctgagttttaaagggactccaaaggcctgctttcccagcttctggtttgtgctcctcacatcctgggtaagtgagcatggcagggctctagccacccagggctatctgaacactctctcttgtcaggaggcagctgtgacctttccctgatgccctgtttctttttccatcttgtttggatatgcaagttaacacagtagtccttgcaaggtggaatctaacagcctaattgtacctgttgggatttggggtttccttctcctgaggcccatctctgagcccccatcaccttggctgcagtgcccacacttgcccacagtttcccgtatctgacttcagtcttcccaactggggcttggaattgcagctctccaatacaactactcaagactcagtgctgaggcttatgaacagttaaacttttatttaaaattctctacttagaaatccccttccaaagtattatggttcagatagaactggcagaagatgaggtagccatttggtgagtttcctaggggttggtaaataataaaagaatgctgtgtgaatgagtgacaaatcactataatgatgacttacttttcaaatgatcccctatgtaatgcccacacattaattaaactaatcacctcgttaaggcgcctatgagtttttgctttctaaacttgatccagagaggtgatgccgaactgttttgtcagctacccaaagagccatctaggatctcggtgtacccccaaaaagtttaagaagactaatgggtgaaacccactgtgaggtctgtggtcattagtatactcctccaggtcccagaatatcctcaggtcaaattaggatttggaaaggagccaggaagggtaaggctttcttgttaccaaagggcataggctgtgatgagtttggaaaagtgtgagaaggatcacctgctggatccatctatagtgccttaggctggccacgggaggaatgtagaagtaaaatgggactggaggtgagctggagccctgcaagatgtcatgaaccgagtgcttccagaaagaactccagagcagactgctttgtcgcactccaggatgacaactgtgacacttagtgccctttgttggagagaaacgacggatggggagaatgctaactctaggatgcctaagtgttgcagggctagagcagctagggggtctcacagcaccccaccaacagcctcttctggaggcatttccagggtctagcatatcccacagcagcctcctgtgtggttacacaccacagaggatggaggcaatcctgaccagggtagggcagagcagatgggggccttcctgtgcccatacatgggaaggtcctgactgtctctagatgtcctgagcctgcccactgagggactgatgtgaggcctgtcagccatggtcctgctctcctaagagacctctctgttccaccagctatgactgaaaccctgcacttaacttcagcttccttggcaaggggctgacctcctgcatgcttcttgaaagctgtattagtccattttcatgctgctgataaggacttacccaagacctggcaatttaaaaaagaaaggggtttaattggacttacagttccacatggctagggaggcctcacaatgatggcggaaggcaaaaaggagcaagtcacatcttacgtggatgacggcaggcaaagagagcttgtgcagggcaactctcattttttaaaaaccatgagatctcgtgagactcattcactatcacgagaacagcatagggtaactgcccccatgattcaattatctcaaaccgtgtccctctcacgacacatgggaattatgggaattatgggagtacaattcagaaggagatttgtgtggggacacagagccaaaccatatcaccagctcttccctgtgccaattaccctgtcagcttttcctgagcaaataaggagtcctgggtctccttttatccttgatcccagggctggagctgaacatagggatagcgggggctagtggcaggatgcttgttatgtcccaagggaaatccacaaaatagcatcagaggacaaagccaaggttgcccatcactcagactgagggtcagtgcaaacaagccctgcagacactgacacctacgtggatgcagtgagagtccacatgtctcatgagcactgcgctccgtcctacttgccccaccatgtatctggttgccagcctgctcagtggagttggctcgaaggaaattgttgagtcatctaatctgctgagaataaaagagaccaggccaggcaggtacacagcaaggcagggcacatgtctggacataatagcagcctctggaagactggacttctgatatccatgtcaaatggttgctgtagcttagcctgggcaactgcacttgggccatgagctgccagggtaccctaaaggtcaatggaagtcttcctggaggctggacttcctggcatatatttgaggttctaagcctgcttcaggctccaccatcttctcacttgatttatctctgggatccctttgttttatttgtgtgtaatgcattttatcttgctgtgttacgtacttctttgtagcctgctccaaatattttctgaatgaagcaggagtgaaaaaaagggggaggaaaatagtgagcgaagtcccttctcaatcccacttaactctttaatgtcttcacctcatctgcattcccctctggatccccagtgttctgttaatggagcacaagctcattgcaggggtcgcggttctgaactgcagcccatctggagctctcaatgcagaaacttgtccatcttcacaccctttatcctaggacccacctctcctccacagcatttgtctccatgtcatatggatagaacaggagagaggccattgggtaggattctgtttcaagctttcactggcaccaccacttggctcctttaagatcagtcctaggggcatattgatagggcaatagttagcagtggaagatggctggcactcccttgtttgtgggttgcagctcaacccagtacagagacagggctttgaacccataagaaagtaagtttgaatattagctctgtcgcttataagcccatacatcaagtatcctttatgtacttcagttttttcatctgtaaaatgggagtaataatagtacaacttcagagtgtttatgtgagcatcatataacatgccacttgtatgtaaaatgtttggccctaataatgtggtcattaataagtggctattattattgtgtgcccatgatgtaccttcccccatattttaatattcctgaacctgtatatgtcttatgatccacatgtgcattaattaacgcatttattttcttttccccttgaaaatctgttaccttggattgtttaatcccacatctttgagctgtatagacatgatataacttgttctagtcctgcttggggcaataaccagggctattgaaccaggacctagatcaacacataggtctgtgagagttgctttgaagaattcctccaggctcaccctccctgcatccaatctcacaccccagagctctgcaagggagagtcctccaggtgaacacactgaatgccaaagaaaaggtcccacactgtgcctgaccctggctgcccaggttcacatctctgaggagtactagagccacattccaaattctccacaccactgcttgcacttcattgggatggctcaatggttattttaaaaagtacattgttccttgcacaaatgtttttgtattttgaaaaagcctagagttacctactttccaagtataaatctctttttgtgcctaacatgttgtcaattttcttttctccctatcttaaatttaaaggagcagataaaggcaatcttatgtgcccagaaagaagagaaccaaatatttgtgaccagccctgatatgcacaactgaggtcattttagaggaggaagctgaggccccttttctccatctgcttgtcattgctctagtctaggcctgctcttatcctgtgggaatcctcaaccctggacattccagcctcttaacagttactgtatgacaatagcaacacaaagaagtagggagagaatggaactgtatgtgaacaaacccattgtatactattttaattaagttggtattaatttaaatagattggtacaagttaaactatcaattgtagtccccaggacaactgctaagaaaataataccttaaatggcaatgggattaaaatggtagactagaaaaacatatatttttcacaaaggaaggtagcattgaaaatataaagaaggaaaaatacatatgtaatataaagagtaaatcactgactacaacacagaaatattaccttaccagtaatcttaaatgtaaatggattaatcacctcgattaaagtcagagattggggaaatatattttggaatcctgttctaactatatactgattatttataagagatttatatagatgtatacatctaaatacataaataggatgaaagtaagtatatgggaaaagatatatcatacaagcagtaaccaaaagagagctggaatggctatgctaataccagacaaaatagactttaaaataaaagttgttactagagaaaaagaaagatattttataatgatgataaaagttttagtctatcaaaaatatgaaacattataaacatatatgtacctaataacacagaccccaaaatatagaaagaaagaattaaagagagaaataaataattcaacaataattattggagactttaaaccctaatttcaataaaggtataacaagatagaaggtcgccatgactatagaatatttcaacaacaatataaaccagccagacctaacccccaattatagaacacagcacccaaaacagcggaatatttttctcaagtatacatggatcacctttcaggataaacaatatgtaagcccacaaaacaagtctcaataaatataaggggattgagattgtacaaagtactttatctgtctgcaatggaataaaatatgaaattaacatcatgctacctgacttcaaactatactacaaggctacggtaaccaaaacagcatggtactggtaccaaaacagagatatagatcaatggaacagaacagagccctcagaaataacgccgcatatctacaactatctcatcttggacaaacctgagaaaaacaagcaatggggaaaggattccctatttaataaatggtgctgggaaaactggctagccatatgtagaaggctgaaactggatcccttccttacaccttatacaaaaattaattcaagatggattaaagacttaaacgttagacctaaaaccataaaaaccctagaagaaaacctaggcattaccattcaggacataggcatggacaaggacttcatgtctaaaacaccaaaagcaatggcaacaaaagacgaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaacttaaacaaatttacaagaaaaaaacaaacaaccccatcaaaaagtgggtgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaacccttgtggaagtcagtgtggcgattcctcagggatctggaactagaaataccatctgacccagccatcccattactgggtatatacccaaaagactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtcaggggaggggggagggatagctttaggagatatatctaatgctaaatgactagttaatgggtgaagcacaccagcatggcacatgtatacatatgtaactaacctgcacaatgtgcacatgtaccctaaaacttaaagtacaataaaaaaaaagttaacatatttaaatttccaaaaaaaaaaagaaattaataacgttggtaaatttcagatattcacaaatttgtgaaaattaaactacatactcctaaacaaccaacgggcaaaagaaaaaatcacaaaggaaattcgaaaatattttgagataaatgataatgaagatatatatacacacatggtcatgtacaaatgaacaccagctcatcgcatagttcaagtgcactagcttgcattgttgattgcacagttttagagagacatgttgatgaccctattttgccacttccagagaccagatgtactgtgcaattaaccagaaaacactgatttataaagcatgaaaataagaatctcttctgagcttataactaaacatatctaaactataataaacattaaattccaaggacttgatatggtttggatctgcatccccacccaaatctcatttcgaattgtaatccctacatgtcaggggaaggaccatgtgggatgtcatcagatcatgggggagggtccccccatgctgttctcaagatagtgagtgagttctcatgagagcagatggttttaaagtgtagcacttcctcatttgcgcaaaccctccatcctgcagccttatgaagaaggtgcctgcttccccttagtcttccaccatgattgaaagtttcctgaggccttctagccatgcttcctgttaggcctgcaaaactgtgagtcaattaaacttttttcctttataattactcagtttcaggtaatattctttatagtggtgtgagaatggactaatacaggactacagctgtgcctgaacaggttacatcaaaaataataataaaaaaactactccaaaagatgaacaatggctacctctgccaaatggaagagtttagatgggctgccttctcaagttgggaacacaatcctgtacatacgtgcttaccagtgccacaccatagatttacaagtcagcatgggtaacccaatcagagactataaaatacccctcaataaatactttgttgcacagcttcaataagtgtgcttatctgacagcctaatatctctttcagggactaactttacagctgaagtcacaatcttctaggggtggccaccaatcaatgattaggcaatgcagttttagtcaagaacatacacttctcagaaaggccaccagccaatgactgagcaagtcgagggtaaaatggcttagaaagtcccataaaagggacccctcctccaagcaatctttgcttcagagctccaaattggactagcaaagactttgtgagatctccccaaaagacaagagggagaaattgggtatgtgcaattgttaagtacttacatgacatgcgaaataatatattatttgaaggtagattgtgattaagtagagattacattgtaaactttagggcaaccacaaaaaattcactaaaagagatatacataattaggcaacaatgaagataaaatggaataatagaaaaatgagtgcctattcacaatagcaaagacatggaatcaacccaaatgcccatcaatgatagactatataaataaaatgtggtacatgtacaccatggaatactattcagccataaaaaggaatgagataatgtcctttgcagtgacatgaatagagctgcaagccattatcctcagcaaactaatgcaggaacaggaaaccaaacatcacatgttgtcactcatacgtgggagctaaacagtgaaaacacagggaggggaacaacatacaatggggcctgtcggtggtgcaagggaaagagagcaacaggaaaaatagctaatgcatgctgagtttaatacccagaaagctgggtggcagcctgagggccatcaactcatgcatttaatcagaacaaagaggtacgcatcaagcctggaacaaagaaatatattgtctcacaagacaataagcccagcacaggctgtgagggctctttatctcccaagaagaaaatgttccaggtacaaggcccatcttatgcagctgagcaggttggtcaacagacaggacatgactgcctttaccaacaatattaaaaggagaatgtatcattattgagatttgtctcagaaattcaatattcacaaatcaatctctgtaattaactgtatcaacagactaaaggaaaatgcatttgatcatattcaaatgattaaaaaatttttatgataaaaagtctagacaagtcgaattaaaaaagaaataattcaacttgatataggacatgaaaaaaaaaagaaaacctctacagttaacatcatacttaatgatggactggataaaaagctgggatgtcaattctgaccaatcctaccaacatctctgtgaaagtccagaccaatgtaataaagcaagaacaagatattaaagacatactgacaggaaaagaaaaaaatgaaaccatctctatctgcagatgacattgattgtatttgtcccttttcacactgttataaaaaaatacccaagactgagtaatttagacaggaaagaggtttaattgattaatagttccacgtggctgaggaggactcagaaaacttacaatcatggcagaaggggaagcaaacatgtccgtcttcacaaggtggcaggaaagaaaagtgcagtgcgaagggggaagagccccttataaaacaatcagatcttgtgaaaactcagtcagtatcatgagaacagcatgcacctgcaggcccaataccacctggaaaccaccaaggcttggggcttgcactttctgaagcaatggcctgagcagtacattggccccttttagccatggctgggatgcagggcaccaagttttgagattgcacaaagcagcaaggccctgggcctggcacacaaaaccatttttttttccttaggcctcaagccagccaggagtcctgaattcctagccttcccacccctaggaaccccctacccctggtaggggcgaaagcatctgatgtcaaaaagactcaagggcatcatggaccttccatatgggtacaggactgcaggacgtccatcagcctcgaaaagacctctccactgcctttcagttgctagcttctcagactcataggcccaggcgaattacaatggggctgccgctggcctgggaagagcaaaaactgtggggccttgcacgtagcaggaaaagactggaaggagactcaagaccatgacaactcctttctgtgaggagccctgagagggtgaatcggtaatgatggagggtgccaagtgagaagaatgtaatgaagggatggttgtgaaatttgaggagagaggcggtgaggtcagggaagagatgtggggtcctcaggagggtgttgaatagggagagggcacagggtcaaggggtgtggtgcttggggtctgcagaggatgtggggtcaggaaagggtcttaggatttcaggtgtggggacacacagtgaggtcccaggagtggggcccattgaagtggaggctctgttctatctgcagtcttggtccacactccttaagattaaccagagaaacacgtagaggacaacaagatagtgaatatggacagagcagtgaagatgccagtggccacggaaaatactatttcttccatgctgtctccagggagtgcttgctgcagtgtttgatggaaggtacagcagtaggagtggtgtcagcttcgacctgcccgagcagagggacagtacttgaaggaaatgctagggccagaagccatgtaaaagcttccaaatgcacgtgtgtcagggccagcagtggcaggaggagccagcaacccagaccctatgactccttctgcggggatcagtcagatggccttggcattggtcagacaggaagtgaggtgggttaggactgagaactaccaggagtcagcagggcaccaccagcttggatcctgagtctggaagaagacctatacctgaagcagtgcccctcctccctcggatttgccccaggtcatccctaggaggccatcccattcttctcctgccatctcaggaaagtacatcacagtggagggcataagccagaccagcacccccaaccaaccatcatcccatgcgtgactttacacacagatactttcctacacacaaagaccaattcaaagctgcttgtcaccatctcttaagtgaatctttaagaagcctaatgtggcagggcttcaggtcagggccacttgatcaaacccagcaccttctgaatgaccaccagggcacaccgagaatctgcctggaggaagcccaagccctgccctgactgctttttctctacttcacctttctctcctcttccaggaaataaatttgcttatgctgagggtcagttgtcaccagtctgacttatttcttccactctgtcctacaacagtgcttctggactccaggcaatgctcctccaaccgcatcacctgggggctagttaggaaccagcatctcaggccccactcagccctaagcagtgagaacctacatatcaacaagattcacaggagactcctgtgcatgtccccatgtgctaatccagacgtggtgtttcttctttgtgcctctgcctcagggagtctgtgactcactgaattcagggtcctctgttcattagtcaggtggaatcaggcaggatgtcctgactggatccttttcagaatcttccgccaacaaaatcataccacatagcaagagctgctttccactttctgaagtggatgcacttttttgcaatttaacattcccagcaacaatgtatgagggctctaatttctctaccaccttgtcaacacattattgtcatttttattgcagccattgtagttagtatgaaatagtatctcatttaggttttgactcgcatttccctagtgactaacgaagttgagcatcctttcatgttcttttggccatttgtagatattctttagggaaatttctgttcatattctttgctcatttttaatggtttgtcattatatggtggtattgtaaatgttccttatgtattctggatacaactttcttatctgatacatagcttgcaactgttttctctcaatctgtgggttgtctctctgtctagaggtgccttttagagcacaaaaaggttttttgttttttttttgtttttagtttgaggaaatctagtttatcaatttgtgtttttgtgggggaaaactatgctataaattggagggaaaaatgcaacctagccacagtatgagctcaaggaagacattttttgaaagttgaaattgtcacattatttttaggtgtcaacgatccagtaaagagcaaggattagctaataaaagagaaaaaatgagacaatttcaagagaaaaatgcttgagaaagagtccattctaggctcttagatagtgctggaatgctttgtcttttgtcagaaaagaaatgacagagaatgcaggcatattggtggcatcagaggcgagataaagagtgaactgccatcaaatagctttcgtttgccttatcagaaaggtggaaaattggccgggtgtggtggctcatgcctgtaatctcaacatttggaaatccaaggtgggcagatcacctgaggtcaggagttcgagaccagcctggttaacatggtgaaaccccatccctactaaaatacaaaaggtagccgggtgtgatgacaggtgcctgtaatcccacctactcgggaggctgaggcaggagaatcacttgaacctgggaggcagaggttccaatgagccaagatcatgccattgcactccagcctgggcaacaagggtgacactttgtcgaaataaaattaaaaaaaagaaaagaaaagaaagaaagagaaagaaaagaaataaagagaaaagaaagaaagaaaaaggaaaatcatcagatactgttgaaggctggagtgttttggagatttgagaagattcgaaatagattttttgcagagtgagaaagtgaattcactagaggaattgagcaagttgtctcaaatacttcaaaggacatcatcaaaaaattgaaaaggcaactcacagaatgggagaaaacatatgttaatcatagggataaggatctaatatccagaatattaagagaacagtcacattttaacaattaaaacacataaccccatttaaaatgagcaaaggatttgaatagacagttctccaaagaagatacataaatgcccaataagcacatgaaaaggtgctcaacatcgttagtcatcagggaaacacaaatcaaaatcacaatgagataccactttacatacactagaatggcaaaaataaaaatgacagacaataatagtatctctaaggatatacagaaattagaatcctcatacactactgctagaaatgtaaaatgatgcacctgctatgaaaaacattttggaagatcctcagaaagttaagaatggagtgttaccttatgacccagccattccattcctagtcctacacccaaaataattgaaagcaaataatcaaacacttgtacatgaatgcacatagacgcattattcataataccaaaaagtggaaataacctaaatgtccatcaagagatgaatgtataagcaaaatgtatatacatacaatgaaatgtcattcatccttaaaaaaatgaagtgctgatacacgctatcacatgaatgaagtttaaaaataatatggtaagtgaaagaagacaaacacacacaaaaagctacatgttgtatgattacattattatgaagttcccagaataggaaaatctatggacaaaaagtagattaattcctgccaagagctagaagaagagggaacggaaagtgattgttaatgaggaggtgttttctcttggggataatgaaaatgttctggaatttgctatggcacaacttattaatagttaaaaatagtgaaatgatggaatcatacttttgaagtggtaaatttatggtacatgtatttttttaaaaaagaaagcaaactgacaacacatagaattgtggtgaagaataggaaagagcatcagtagagagcctctctggggtgcagcctactgagctcataaaagctgaagagggggcaggaactctgatataacactctcacatgatagacctcactctgcacacaggtagagacagatcaccattgggagactttgaaggtgatagcaaaaacaaagcctaaacccggctaaactactgaagaaattgaccacacacttccctcacacacaaacttacaacctagctgaataagatacattccaatttacatgcattaatattatttacctcagcctctactgttcttctacacatgaggactggcattcaataaaaattataaaatacaaaaaaattaataactagtaactcattttcatgaagaaaagcaataaacagacctggactcagaaatgacctaactgctgactacattacaaagatacttgaaaagaattgtgattaatatgtgtatcagtccgtttgcacactgccaacaaagacatactcgagagtgggaagattacaaagaggtttaatggacttacagttccacatgactggggaagcctcacaatcatggtggaaggcaaggaggagcaagtcacatcttacatggatggcagcaagcaaaaagagagagagcttgtgcagggaaactccccttcatagaaccatcagatctcatgagacttattcactatcacgagaacagcaggggaaacacctgcccttatgatttgattacctcccaccgggtccctcccacaacacgtgggaattcaagatgagatttgggtggggacacagccaaaccatatcgacatgttaaagaatatagtggaaaaactgaacaatatgcatgaagagaagtatcaagaaaatcatgaatcactgcacacacttgttaaaataattaattgggaggccataagactgaagcagctctagcaccctgagttcctatgtaaacaaactgaaactttactcaatacaaatggaaaaatgaaacaaactttaccaaagttggccagctaacctctaacaggggctttgccaatcagaaaccaccaaacaaccactaactaggggctttaagactactgctccactttttttttttttgagacagggtctcactctggtgcccaagctgttgtgcagtgttgtgataacggctcactgcaacctatgcctctcaggttcatgtgattctcatgccttagccacctgaatagccaggattacaggtgtgtgtcaccacacccaggtgatttttgtatttttagtagagatgaggttttgccaggttggccaggctggtctcgaactcctgacctcaagtgatctgtccacttcaaccttgtaatgtgctaggattacaggcatgagccactgctcctggccctacagctccacctaaaccaaaaaaaaaatattttctttgccttgcttctgcatgcacatcataaaagttctgccctcatgcccttttggtgaagccctggaccacttgtggttttatgctgcccaattcatgaattgctgtttgctgaaataaactctttacaattttaatttttctaagtttatcttgtaacacaactattttcagtttactgtacatattgaaacaaataactgatctctgagcgatgagagatagaaaataaagtgagccctaaaatttccttagcttactgcctggagggcagagtacacagcaggaaagccttgatgttttttgagttgaggaggtagaatttagaggacagggagactaaaatttgcagaacaaaataatgaagaggagaaagcggtacagagagaaatctccagagcttacatgggtttgaggatagttcttgtttcctctattcagagtgaaaaactttataaagcatgggacatcagctaaaaaccttaagagcgttttgtccaggttatgaggcattataagctatagactaaaaactgctctgatctcacctaaaaagagcaagacttgaaaaaaatgccactattttcaagaaacttacccatgctgaagaataaatcccaataatattttatagaaatacaaaactatctagcactcaacaaagtaaaattcaaaatgtcttccatccaatcacaatgaccaattttgtaaaaaagcagaaattaggatcaataatgaggataaaacacacacatgacactgataatagagattgtaggcaaagacatttaaaaatttatgaatgtatatgagaaccacaaagcagaggggaaaatgagggataaaaaaatacttgaggaaataatgaaaagttttcaggtttgataaaaactataaaccccaaaatctaataaactaaaaaaaaaatcacaaaacaataaacatgtataaaggtataccaaggcatttgataatcatattgtttaaaatcactgagattttaagaagaaatcacaagaaacttttaaaagtaaacagagatacaaattatgtacattacctacaaaggaacaaagataacgatgacagcagatttcttttgaaagataatgaaagccagaggagagtactatatttaaatattgaaggaaacaaatactaaagacgtaaacttctatattgatgaaaatatattccaagaataaagatgaaacacttttgtttcgggaatgcaaaattagaatgaatttatcaccaacatatgtgcactagaagaaatgttaaagtaagtcctccaggcagatggaaagtgatgccagagaaaaatccggatctacacaaaggaatcaagagccctagaaggtgcaactgcatgcataagtataaaacatattttccttattatgtaatgtcttcatagcaaagtaactgtttaaaataacagtacttaaaggtattaagttaaaaatagcaatgtatgatgtggcttacaacatatgtaaatgcaaaatgtatgcttagaatagaccataggatgagaagggggaaatggaagtataccgttggtttttatgtatctgactattctaagtgccaatgggtagagctgaatagagatgactgttttcctcattgcacatgaggtatactaataaggtgagcctgcacataacaagacatttttaaaaaacactcatcgtttattatgtgaacagagagagtgctgtgaactccagacaattactctgtaatattccttaaatgagaaactcttatagaaagaactttaccttgttttcttaaaggaaattaagagacatatctctaataaattttggttgagatgaagccatctgaacatcagtcaaggggattgtgcaccatgtgcggaagcagaggcaacaggtaaaagtaaaatgagtcaagatccttgctcttgttgagcatgcttgtacatggtctaagaacactctcaaaagaaggaaacacagtgaacatgcccatagtgctgtttggtgatgataggcagtagcaggggcctctttcccggaggagaggctgaagcagggctaggaatgaggttagagacagagattggggccaacactaaggaagatccttgcaaaattctcagagggatagtggattggagggagggagggtaaacagtcccattttgagaatagagaatagataaatatgtagaagaacagtgtgtgcctacgtgtgtttaggtcaggggtaggacaatgaagaactgggtaaacaagaggtgacatggtgaggtatgctgatgataaaaagattgggggctatcagttgttggcagggctggagagccaggaagcaaaattgggattcagtgcattgggcagaatggcatccacatagatatgtgcctgtgcaggggcatgatgaagcccacctttgaggaaggtcttctagcacagggctttcccagcagtgcaggggcatccccagtgttctgtagcaggtaaggcatcagggcccactgcctaaaggagggagaaaggatgctgggcgaacaggactctgggactagagtgctcacttcagccagactgctctgccttctaatgttcataaattggagttctatggaaggcttcagttaaaataagggattctatgtctaaaatttggcaaccatggtctactagtgagatatgggatgcattgtggtgtcctggcatcctctacttgtgcctaatattgctttcagccctttgcttcactgactttagttactgcaaagttgccagctgcctagaacacactagattagaagaggtttaacaaggaagtgtgtaccatctccatgggttttccatctaccctccaaatatctgcactttaaaccaatcctctattccagacattatctgctgacatatagacccacttttatagtcacaggacacaggttctctgttgtgacaaggacgcagaaaccatgggaggcattctgagctgggaacatcatctggatcatttttcatagccctttatctatagttactgaattagttggtcctgggcattcccactccagcttacccctccttgcagatgcacattcccttaccttgctcattggtattcctagcctgtatcaatggtcagccatcagtcaccagctccacttgcatagcacccacctctatgaaaggggtccagtgtacacaggaaaaaaattgtcagcctccactgggggtcaagacagctccctgccctggtgagagtgcacaggattactacagtgatcaagagaatgactcaggcagccagctatacccttcctgacaggagatggggaaattttaatgtaggctaattgtatatgtatatgtatgtgtatgtgtatatgtatatgtatatgtatatgtatatgtatatgtatatgtatatgtatgtgtatatgtatatgtacatacatatatcactccatgattcctgacattcttatagatcttgttatttcctaagtgagtaaaacaatacgaatatctttcattaaaatatttgtcctgttgtctttggttcccgaagcagcttcagaacagcttcggaatagtaaaggtggaagacagtcttctgttgtaatgttggagtgctttaggcctcagaaggagacctcggaaaacacaatctcgctttctaactttcttttgcccccctttcaccttcttctttttctccctaagacaagccatagaaactaaaaacagtcatctctcctcacctgtcttagagctggtcataaagaaattctctgacctaccttgtctgattgtaggtcttaaactcccatttcagaagaggtcctgacccataccctggaggacacaatgctgctcagggagaacaggaagaatctgaacagacaggccttgctggtttcccaactcagtctcttagtattaggttatatctttctgtccaatcatatttctacacatctgtccatgcttcaatcatgcctatccaatgaagtcttagtaaaagggtcaggaggacaggatattgagagcttctgaacagctgaattcatggaggcttccagaaaggtgcataagaactcatccacgtgccaggagagtgctgcaccccaactgcatgggaacagaagcccttgcagggcagaccctccagaactcgccctatgtacctctttatatggctgtttcattgtgtcctttaaaatatcctttgttataaaccagtaaacataaatatctccctgagttttgtgagctgatccagcaaatcaagcctaaagaaggggtcatgacaacctgaagttgaagccaatcagttagaagttccagaggcctggacttttgactagcatctgaagagagggcactgttgtgggactgagtcctcaacctgtggatctgatgctatctccagatagatagcgtcagaatggaattgaattaaaaggcacctagctggtgtctgctgtagaattgatttcttgctttttggtgaggagaaatccccatacattcagtcacagaagtcttctgtgttgattgttgtggtgtgaaagcagatgaaaacagatgaaagcagatgaaatgccctggtgcattcagctaccgggcctgctcactcacatcacgtggccatgttcagctggagattatggttcccagatttcccaagcctattcctgctcattgtcctgtcctccctactgcctttccccttatatccctcaggtccctgatcccactgggctgaactctggattgagagctctgagtgccagcctgcctggggctctgtggacttggttgtgtgcgtggtctctctcatggactctggcagttgccctttcttggatcctcctaatgcccctcatgagctgatggtgtcctgtcttctctccttccctgccatctggtcagtctgactgcattagtccattctcatgctactataaagaactggcagagactgggtaatttataaaggaaagaggtttaattgacacaaagtttcacaaggctagagaggcctcaggaaacttacaatcatgcaggaggggaaacaaatatgtccttcttcacatggtggcagcaaggagaagtgctgagcaaaaggggaaaaagccccatataaaaccatcagacaactcactcactatcacaagaacagcatgagggtaaccatccccatggttaaattacctctcaccatgttcctcccatgacacatagggattatgggaactaccattcaagatgagattttggtgggacacagccaaaccacaacattctgcccctggcccctcccatatctcatgtcctcacatttcaaaacaaaatcatgccttcctgacagtctcccaaagttttaactcatttcagaattaactgaaaagtacaacttccaaatctcatttgagacaaggcaagtcccttctgccgatgagcccgtaaaatcaaaagcaagttagttacttcttagatacaatgggggtaaagacatccattccacctgggagaaattggccaaaacaaaggggctacaggccccatgcaagtccaaaatccaataggtcagtcattaaaccttaaatttccaaaatgatctcctctgatttcatgtctcacatctaggtcacgctgatgcaagaggtggtctcccatggccttgggcagctctgcccctgtggcattgcagggtacaaccccccacccaacttccctcaaggaagatcccattctgggatctggaggactgtagttctcttctcacagttccactagggaataccccagtgaggacactgtgtggaggctccaaccccacatatcctttcatcactgctttagcagaggttctccatgagggccccacccctgcaagaatcttcttcctgaacatccaagagtttccatacatcctctgaagtaggcagaggttgccaaacctcaattcttgacttccctggaccggcaggctcaacaccacagggaagctgccaagacttggtgattgcaccctctgaagccatgacccgagctgtaccttggctccttgtagacacggctggaggggctggaacacagggcacccagtccctgggctgtacacagtatggtggccctggcccaggaaactatttttccctcctcagcctctggacctatgatgggaagggctgccgtgaaggtctctggcatgctctggagacattttccccattgtcttggtgattacatttgtctccatgttacttatgcaaatatctgcagttggcttgaatttctccccagaaaacgggattttcttttccactgcattgtcaggctacaaatgttccaatttatatgctctttcaccttttgaatgctttactgcttagaaatttcttctgctagatacgctaaatcatcactctcaagttcaaagttccacagatctctggggcaggggcaaaatgccaccagtctgtttgctagcatagcaagagtcgtctttattccagttccctacaagtttgtcatctctatctgagaccacttcagcctggacttcattgtccatatcactataagcattttggttaaagccattcaacaagtctctggaaagttctaaactcctacatcttcctgtctcctgagctctccaagtctctaggaagcttcaaactttcccacattttcctgacttctgagccctccaaactgttccaacctctgcctgttactcagttccagattcgcttccacagttttggtatctttacaacagctcgccactacccgttaccaatttactgtattagtccattcttatgctattataaagaactgcccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaactgcccaagactggttaatttataaagaatagaggtttaattgactcagtttcacagggctggggaggcctcaggaaacttccaatcatggtggaaggggaagcaaatatgtccttcttcacatagcagcagcaagaagtgcccagccaaagggggagaagctccttatacaaccatcagatctcatgagaactcactcactatcacaagaacggcagcatctgggtaaccactcctatgattcaatcacctcccacggatacctcccatgacacgtggggattatgggaactacaattcaagatggcatttgggtggggacacagccaaaccatatcactgaccaaacccttctcgaagtaaagataaatgggaatttcgtgtcagaagatgtttactgcacagtgatttccatggtctttcttcatgtaccactgtgagagaggctatggttttgaccacctaggaaagtttgtttatatgctcagtactcagttttaaataaggctacatcaaaggcattcttcatttctgttacattacctttgaattctagcactcactttagattatttaatacagttttcacctctttgctgtcatttcccatctattcttgtgtgttgtctactttttttattagaccttaaacatatgaatcactgatattttatattcatattttataagtataaaatttgtgttatactcagtctgcttttgcaacttgctttgtcacctcaggctctttttccttgccttgcgtcatgctgtggaagtttttgtgaaaaactgaatgtgatgtatttggtaatagtaaaccaagatgaaaagcttttagtgtgatactttctgttaatttgactaggtcttggacagggcttaatgtttgctgcagctgtaggtgccaaagccttcaatgccctgcagtattcttttttgtctccctcctattgtctttggttttcttaataactaccaattaaattaagcctctgtcttctagctcttcatccattgtaatccactgtcgatgtggttgtatcatccattgtaatccaccatcaatgtggttgtaaggtgttagggaaagaattgaaaccatctttgtaaatgttatacaattaatcagggaagaagagaggaggagaaatgaaaacaaaccaagctttcagcacagtcagcattaatcactaggttagcttgctctctgacccactcctcatagtcatttgtctctgcctcaaaatcacacagaccttgttatcagattataggtccccataattgctctatagatagcaacttaaacattctgaaacgttaagttttccttttgagatattctttccaatccttcataccagtgaaacctactgattgtagctggtctgaaggaccccaggaggagctggctcacggaagaatgcagtttccacatcctgatgacttcatccctcttaccccaaacaatcaacgactccaactttcagccccttgccctccatgatcctcttaaaaactgtcacgcgtatccatgtgaaaagaccaccaaacaggctttgtgtgagcaataaagctttttaatcacctgggtgcaggcgggctgactccaaaaagagagtaagcgaagggagataggggtggggcagttttataggattttggtgggtagtggaaaattacagtcaaaggggggttttctcttgcaggcaggggcgggggtcacagggtgctcagtggggcagcttctgagccaggagaaggaatttcacaaggttaatcactcagttaaggtagggcaggaacaaatcacagtggtggaatgtcatcagttaaggcaggaaccagccattttcacttcttttgtgattcttcacttgctttaggccatctgaatgtatatgtgcaggcttcggctcagaggcctgacaaaaatctcatcccagaactccttggggagatggatttgggggtctcctcccatctccttactcagggccctgtgatgattaaactctttctcttctgcaaactttgctgtcttagcgtattcaactgttactgctcagtgagcacatgaacctgttggtcctataacaggatcattcttaatcttatgattgaattgcaggacttattgaatatgtgtctctgagttgtggccttcgtgactgtttcaccagcagtatagtttctttgccccatttcccccaaatccttttgctcactcctgtgttcctaagcaaagaaagactgtcaaatcaggcagctccagaaccaaaataggttcagagcaactccagggttgccacgtggtgagataatatttgtgaaccaataaaggatagtaatatacagaaaacagaaatgacgtacagaaagaactggattggcaacagctggggatttgccttgtttgaacctgctttgaacagttggctgcctgtggttgactaagactcagttgcttgttacaaggtatattacaatctgtctatacttcaagttaggttacacttcactatgtgtagaggaatctttaggccaaccttcaaatatgtagaggggaagctttagatcaaactcaatttgatatcctttaggtaagacaagaaagctagaagtttgcagtgggaggaatgccattccccaagctgggatgacgctatggcaaagccttttactgctggagaacacctttgttatggagaaggctctgagtgtttttcacaatagctatttttctcctactcctgcccagatgaatgagagaagcttgctcagaccttcacggtgagaattcgctgatgctcctggaggtaaagcactcaacaatttgcctcccaagactgtggctgccaagtaatttatcactctcatggtactccacattcagcatctaaaatttcattcaattaccatttaaaggttttttactaggttacagacccagaattgtctactcctgataagtatatcttagctttgcctctttgtacctgactctcctgattttgggtggtaatttgccctgcaacatcaattccttagtatgtgtgagaaaaataactgattttcagtttgccaagcatatttttgtagtaaaaatgaccatgtcagtgttcaacacctttacagtcagggctgaagttagaagccctgtattaactttttagttaccgatttatattatgtatacctgttagagtaggcagatagccagaaatgagcaggcaagggagtccctgggaaaagaagtcctgggagacactgcccactgacaatcagaaaaaaataaaaataaaaataaaaataaaaaccaatggctatattggctacagctggccttgtggttaggctcttccagcccagaaggggtcttaccaggccctaactggaggcaacaatggtagggacttttcctactgaggagcatgcacactcctcccataaatcaccctggagtagccttttgcttattataatagtgaaaaacacaccctggggtggagactttaaatgctaatgagacatgccacatgtgtactagtatgcacaaccacagagcatgtgcggtcaaggggaccacataaaacatgattgcaagtgacattccgtcatgccccttcatgaataatcatgtaagattctcataaagagagtcccccagcactagctgctgctggctcattctctctttcaacagcccactctgatttgtcttccagagtgtactgtctctttaaataaacactgctattgctctttttccagccaaaccagccaaggtttgtcctagggcaatcaaggctatccagtcaagggattaatgtgctcacttgggtaattgatagtgattatcaaagtgaaatattagttatgatggaacgtaaaggtctgcatattcttctccctggatcaaagatagcccagttaatactcttaccatactgggtccccaaagcccagggaaaagaaaggggaaagggaagttttggaagcacgggagccacaggagtatattggaaccaattaatcgcttatcagagacccatgattaccttaaaaattggaaataaaaatgttactagcttattggacacagaggtggatatttcaatcattagcgatcaaaactggccagaaacttggccttcggtcactcagaaacgaaaaattgtcggcatcggggaagcgcacacagccaagcagagcacacgccccctaatatgttgcgatttggagggaagaaaaacagttatacaacctctaatcatgtccatccctgttaatctttgggggcgggacctattagcccaatgtggggatcactctacagacccctttctaataatggccactgttgtaattcttcccctacccctcacgtgtctctctctagatccagtttgggtagaacagtggcctttaaagggagagaaattacaaagagcccatgaactagttgaggagcaattaaaagccagccatatagaaccatcaaatagcccttagaatttgcccatttttgtcattcccaaaaagtctggtaaatggagacttttgcatgacttatgtgctattaatgctaatttgtaacctatggggccccttcaacaggggctcccttcccccacggcgattcctcaagattggcctacagttgttattgacttaaaagagtgcttttgtactattccccttgcaaaacagggcagagaaaaatttgcgtttacaataccagctatcaataatgaaaggccagcttgcagatttcattggaaagtgcttcctccaggaatgctgaacagtcctaccatgtgtcagtaacatgtaaatcaagctttgctccccagtagaaaataatttcctaattgcaagattattcattttgtggataatattttaccagcagccccaacagagccagtacttttaagtttatattcctctgtcgtaaagaacacgcagttaagaggttcaatcatagcacctgaaaaagtacaaatgtcctctcctaggaaataccttgggcacatactaacttcccggtcagcaaaacctcaaaaggttaaattaaatactagcaacttacacaccttaaataatgaccagaaattactaggcaatattaactggcttcgccccaccttaggcataactacttataagttccaaaacctgttttctatattaaaaggcaatgctgctctagactcttctaggcacttaactcctgcagcataaagggaaattgagggagtagagcaagctatttctcacaggcaactagattgcatagctccatgatattcagttcagttgtttgtttttcccactaaacattccccaagaggattaataggacagatgggcccagggctgcactttctagaatgggttttttgcccacataataggactaaaacactctctctatatatccagctaattagtaaagtcatccattcaggccgcagacaatgcaataggttgctaggttatgatcctgatgtcatcagaattcctttgagtaaaaagcaattcgaagcagtattgcctttatctttaggcctgcaaacagcactctctgattacacaggccatgtagagcatgcccttcctgctgataaatgacttcagttcttatctcatacttctgtggttttgcctgcaaaaatagctcactcccccatacctaacattttaacactgtttaccgatggctctggtaaacatggaaaagcggctatttggtggagaccgcataattccctcattcattctggatttactagcactcagagagctgaagttggagccttaatattggccttcgagaattttttcgctcaacccatcaatattgttagtgaccctgcttactctatttatttactgcagaaccttgaaacaaccctcattaagtccactctggagcccacactgtgtgcactttttgttcgacttcagcaattgctagatcaacgtacacatcctatttttatcacatatattcgagcccacagctcactgcctggcccactggcttatgacaatgaacaagcagacctacaagtggtgacatcacggcttaaccaatccacccaataacatcaattttcccaccaaaattggagaaacttatccaaacgatttcaacttatccagagagtagctagacaaattatcctgcaatgcccagattgccagctcacaggcacatcccctccttctacaggtgttaaccctagaggactagaacctaatcagttatggcaaacagatgttagacacatccctgaatttggaaaactaagatatgtacatgtgtccattgataccaattctcatgtaattagtgctcatgcctttcctggagagtccacccgatatgtcattaaacatcttcttttaacttttgcatttatggggcggcccacaaaaaataaaactgataacggtctggcttatgccagctcacagcttcaacaattttgtcacatgtggaacatccaacattccacaggcatcccgcataaccccccaaggacaggccatagtagaacatgtccatttcacctttaaaaatatgctcaaaaaaacaaaaaagggggaatatgagttaaggacactgcaacactattggcacaagccttatttacccttaattttttaaatttaaagataaatttccatcagctgtagaaaagcactttgctaaaacctctcaagacataaaacctgctgttttacagaaagttgtaaacagtaatgtatggtatggtccaaatgaattgcttaaatgggggaaaggatatgcttgtgttcacaccccctcagatcctctttggattccagcaggatgcatcaaaccataccatggcatgactaggacccaacccataccagaaatgaagaaaatgaccctgcaggacccgcagccccagacaatactgcttcctcggatgacacaagccccagacattacctgggggatgctgaagaagacaactcaggaggccgagcgaatcctgctccggacacagacaccattcactccagataatttgttccttgctatgctctctgttgtacattgcaactcatgtagggcattgatcctttttatgctctcgctttgtctgcaatctgcacctgctgcactctattggactcatcgcttagatctgcccttcttctgccccatcacctgggcagacacccccttcccagcctctaataacataactgcttggctgggagagatagatttacccctagtggggtccctcattaatggcacacagtggactaaggtgccaggtaacactacatatcactccactatcctcccactgtgtgtaagttataaaagttctaacccttactgtgtacctgctcaaacacaattttggctacattgtggcaaaggaaatgctttaacagtcttagtagcaggtagcctcaaaccaggcaatgcaatcaatgccattttcccaaacattcctccctgtgctaaagaacaaagctgggaaagtaatggattccactttagctgggaggtctgtcacggggaacaggcctgtagcctccagttaagcaattataacatcttagactggagtcctcccagccatttgcagggcgatcgtattgatgtccatgtctatcttggcatcaatggcagttttgtagccacatcccgttcccctataatttgggccgatggggggagggatatcccagaccccaagtagagtccatgccaccccaagacactttatggcacctgggacatcttagcacttcccttaacacctggcatgggacatatcataattccagtcacaattatactatgaccttttttcataatcacaccgatcagtgcctgatttgcctgatttgcactacccatccatatgttttccttatgggaaccaatatttctattacaccccaaaactccacgtttgtgactcgaatgcagggacaggcttggttcatctcttgtatcactaattataatatatctaatttaaatattgctagtgtcatggtattgaggagacaatctgaggctttcctaccggtcaatttaacatgcaattggcaaggttcctctgcccttgccaccttagaatgtgccctgtcccaggtcagacgcaaaagatttatagttacacttatagcctttatggtctcagccatagtcatcctagcaactgctagtgttgctgtagcatctattactgaatcagtacagacagctacttttgtagataatttggccagaaatgtgtctgatgtacttctcttacagcagggtatagatcaaaagattcttgcacatctgcaagcccttgaggctgacttggaatatgtaggggagcaacaagatgcacttgcgttccaacagcaattaaactgtgactgggagcttaggcacatctgtgttacctctctaccttggaatcaatcaatacatagttgggataaggtgaaacagcacctctggggaacctttcgtgataatttaacagcagacgtaaagcaacttaaaactaaaattctagaatccctaaacgccatagacctacaagcccaacaaatagccatacggaagggtatgagagaacatctctcctggatagatccccactcctgggggtcactccttgattggaaaagaacgttgtgaattatactcatgtttgccttatgttatttactaattctaggattcaaagccagaatatgagttataaccgctgtgccagacaaacatgttgctgtacacatctgtgctcttcaatcaacaaaatctgatgcaaaaaaacagaaaagggggagatgtaagagataggtcagggtggtgggagaaattataagaaggaattataggaaaaacacaagccttggaaggccaggaggttttgcaaaagcttcaaaaatttggctgaaggcagccaaagtctcttatccaaagccagagagcaaaaagcagataacaaggaagtgtaaaggaattgatctagatcagttagtttacttaggcccgaaacctggcctttaaccatctgtgtgcaggactgctctctctggggggcggccatgttaattacccacaagatgtgttgactcaaagcctttgtcattaaatctgtagtgaatatttgcccgcagtgccggcttgttggggccatggctgctacaactctttatgtgaatggcccagtcccctagccttctctttcactggatacctgtgtctgagtacattttttatccatcgctcggtcagcgtctgccagtcagatctggcattaatgtatgtggatattttatactctcgtgaacattttactatattaattttaaaattttgatcaaaaatatgagtgaaaaatattttctcaatgttactttaatttgtgtctctgcattttctagctaggttaattagaacactaagttaatttcttacccatacgaagctggatttatgcagtgttctaagtaagactattcctctgggcatgatttaaaatttaaaattttgaaatgtcaacatatgtttttcatttgaggaaaaaagattcagtcagactgaccaggaggcacggaaggagagcagacaggacatgctcagcccgtgaggggcattgggtggatccaggggagagcaattgtcagagttcatgagtgagaccacatgcaaaaccaagtccacagagccccaggcaggctggcactcagagctctgaatccagagttcagcccactagggacagggaccctggaacccaggggaaagaagccagagggggagggagtatacgacaatgtacaggagtagttttgagaaatctgagaataacaatcatcagctgggttggcatttcactgtcttgatggtgtcctttgaagcccaaaagtttaaaatctttgtgaagtccaatttatctattttttttctgttcatgcttttggtgtcatatctaggaattatttgcctaatctaaggtcatgaagatatacccctatgttgttttctgcaaattttatagtaatagctcttatatttaggtcttttgttcattttgagttaatttttgtatatactgtgaggtaaggtcaaacttcattcttttgtatgtgcttatctagctgccccagcaccatttgttgaaaagatcattctttcccccattgggttctcttgacacccttattaaaatcagttgtccccagagacatgagtttatttctggactctcaattctatttcatggatctatacttctatccttgtaccactactgtcttgaccagttgctttgtcataaattttgaaatcaggaagtgtgagtcttcctatgttttttcttttatcaaggatgtttagactaaaatgggtaccattaatatttgacaaggaaaatcaattgtgggaatagcatttttaaaacattttatgtgtcatttttaaagaattcttacttttgtgggtacatagtagttgtacatctcataagtacatgagatgttttgatacaggcatgaaatgtgtaataatcacatcatgtgaaatggggtacccatcccctcaagcatttactctttgtgttacagacaattcaattatgttcttttagttattttaaaataactaaaaactattgaccatagtcaccctgttgtgacttaacaaaatgatctccagttccatccatgttgttgcaaatgatagaatctcattctttttgatggctgagtagcactccattgtgtatatgtaccatattttatttagccattcatctgttgatggaaatttaggttgcttccgaatcttggctgttttgaatagtgctgtaacaaacatgggaatacagatatctctttgatatactgatttcctttcttttgagtatatgctcagcaatgggattgctggatcatatggtagctctatttttagtttttggaggacccttcaaactgttcttcatagtggttatactaatttacattcccaccaacagtgtatgggagttctctgttctctacatccttgcaaacatttgttgttgctgtcttttggatataagccattctaactggggtgagatgatatctcactgtagctttgatttgcatttctctgatgatcaaacaggcagagcacttgttacatgcttgtttgctatatgtatgtcttcttttgagaactgtctattcaaatcaataaggaattctctataaatacatatatgtgaatatatttctagactctctctttagttccattgacacatttctattgttatgacaatactacactcttctgattattgtgactttataataagccttgaaattaagtagtgtaacccatgcaacttttgttgtcttttttttttaacttattacactttaagttctgggatacatgtgcagaacgtgcaggtttcttacacaggtatacacgtgttgttgtctttttaaaagttattttggctactctaagttctttgtacttatacatgaatgtgaacaccagcctgtcaatttctatttttaaaaaagtctttcaggtttttgatatggattttattgaatctatatatgaatttggaaagaatgtacatcttaacagtagtaagtcttccaactcatgaataagatagctatctccatttatttaggagacaaataccaaaataaactttatttaggcatttatccttcattaatttatcactgcaatatttcttagtttttggtgtacagatcttctacatatttcatcatagttatgtctatgtatttcatgttttctagtgttacttttattttattattttattttgagacggagtttcgctcttgctgcccaggctggagtgcagtggcgaggtctcggctcactgcaacctccatctcccaggttcaaatgatcctccagcctcagcctcccatgtagctgggattacaggtgcccgccaccacacactgctaatttttgtatttttcatagagacggggtttcaccacgtcggccaggttgttctcgaactcctgacttcaggtaatccgcctgcctcggcctcccaaagtgctgggattgcaggtgtgatccttcacgcctggcctagtgttacttttaaatcatactgtttttaatttcaatttccaatttctcattgctagtatataaaatagaattaatttttgtgtattgatattttatcttgtgaccatgccaaattcaattattagttctagaagcatttttattttagatttgtacaggtttctgcatagactaaagacggttttgcttttccctttccaatctggaggtctttttctttcttcgttgcactgagcaacaagtataatgttgaacaaccactccacctctgtgaactcaaacgtcttaggttgtagtttcctgcatgcaaacaccccgcacaacttctggcaaatgaatatctccctcatccctcctgttaaaacccaaatctggtactacacagactgagatgaacacaatgcccatagttgaaacaagactaataagatactcagtagaacaaggctgtttacagcatgagagcctgacagcctgaaggcagcgatttcagattggaaaacagaaaactgaagggacctctatggacactaggaaaagaatgcgggatggaacttttccctgacagtaaccaagaagtgagtggtcttcaagttacataggataaatttttaggagggaagtgggatgattcacatctctgcatacagctaaatcggccatattaccttggagggatttttggtaagatgtacaaaaattagataatcgtgaagggtaggagagaatggagtgagccactcaatgaggtggccatgggggaaggcttggagggaacactctctccccacgatgtgacccaccagaacttaatatggggagatggagagggtagcaggttagtttggatggctgtatagggttgctaatgaaatgctacgtttctccaaccagagcatcttggccccctcactgccacccctcccccaccatcaccacagaggtgtcaggttggtgctttgtatatttaagccttccagagccaccactggatgggtagtggctctctgactagtcaaagcttagggatgtggttcgtcattgtcctgggaggggtatatatggggaggccaggtggcctggagtagaccattgagagacgaggacaaggtgaagatggccaagaaaccataagcctccagcccagttgtggaacaaccacctgccaacaccaaagaggcgaggaggaggaagaccccttctcaatcaaggtccagaagccctatcaaggtgaggaacccacccaagctcctcctcgtcttccccttgactcctccctcccaagacttctaccctatcctggcctgacacaaccccccaccccagcctgtatcccttctcatgaaacccgtctttccatccctcctccatccacttccccaaaagcaatgcctttctgtgatctccttgttgtcctttcaggttcccaaaccagcaagggaaaagaaacactttgatggcgttccagaaaagaagcctctcccaaaatgaccactgcttgaggaaaactccaggaagggagtaggccaacactaccaggccaccgtgaccagctgaatgaggagctcaatcaaaacgagccacagcgggaccaaaaccatctccagtgtgtcccctgggcagccagtaatttcagggcaataccagagacctgagatctatctgcaaagtcaccagaggtctagtccccagagaaatagccaacaaggtctagggtacattttatacccagcagggcatgctccatggtgatgaaaattaaatgactcatagaacagaaatatataaaaatatatgttgaatgttaacaggtattttcacaggtttgacttgtttcttgatagttattcagacactaggggaaggtaaataaaagtaaatgaaataagcaactaaatgagacctaataattggcctttgattttaaatatttaatttgttattataaaccttatcaataacaataaatctaaatcaaaaaagaaaactaaatgagtctgttgtaaactgatatgtgtgtctacatgttctccgatggtggggagagaggaaggagggaagaggtagtgtgtgggaagagatggaggtgggtgttgcccggttggggtcacatgggcaaccccagccaggttgattcacagttagccaagcacataggagaaggattgggtcggggctgaattctggagacaaatttcctccttaacacattggcccatgggagaagaggaaaaggttggtatatccgtgtgtgcttgcagggctgtggacccagctggggagaggagttatgtgtatggttccagcgtcgccccccataaaaggcacacaaagtaattgccctcataaaaaccaaaaaccttcctactaaaaatcatgaacagcactctgaagcactaaattaatggtgtttggacattgaaaatccaacactgattcagcaacactctcgcttaaaaaatacctttggaatggagcagttggctaccaaggatggggtgtgggagtggctcctcccccgtgcaggcaataaaggggagcattgtctacatattattattcaagttcaatttttatttgagacaattgtagactcacatgcagttgtaagaaataatacagatagaccctgtgcaccctttatgtaccttcctctaatgataacatcttgcaaaagtgtagtacagtatcacaattaggatattaacttgatacagtcaagacatagaacagtcaccacaagggtccctcatgttgcccttttatagccacagccactttcttcctacaccaccttctcctcctcaacccctagaaacaccactcatctgttctgtatttttatcactttatcatttcaagaatgttatttgaatgcagtcatacaattatgtaagcttttggtactggctttttaaaaatctggcatgactgtctggcgattcatccagcttattgtgtgtatgaacagtctatttcttttcattgctgagtagtattccaagggacctggatgaaccacaggttttgtttgtttgtttgttcgagatggagtttcgctctttcacccaggctggagtgaagtggcgtgatctcagctcattgcaatctccgctccccgccgggttcaactgattcttctgcctcagcctcccaaatagctgggattgtaggtacccgccaccatgcccggctaattttaaatttttagtagagacggggtttcgtcatgttggccaggcaggtctcaaactcctgacctcaggtcatccacccgcctcggcctctcaaagtgctaggattacaggtgcgagccatcgcacccggccagcagttgtcttttaaaccattagtctgttgagggacatctgggctgtttccagtacttgcttattaataaagctgcagtgaacattcttgtacaggatttcgtgtgaatataagttgttagttttctaaaataaattcccaggtgtgtgattgctgggttgtttgttagttgtatatttagttctagttgttttttaatgaataggctttattattagaaaaattttggactggtagaaaattgaggagatagtacgtttcccatatactccttttgtcccctgtacaaagttttctctattattatcctctgctagtatgctacatttttcacaattaatgaactagtatcgttattgatacattgtttttaactaaagtccgtagtttacatgaaggttcactctttgtgttgcaaggatctttgggttttgacaaatgcataatattgtgtatccaccattacagtttcaccacccaatgaatatgtgtgcttcacctatttatccctcccttgctgcctccaaaactctggtaaccactgatctttgtaactgtctctccagcttgccttttctagaaagtcatgcagttggaatcacacaatatgttgtcctctcagaccggcttcttcactaggttcctccgtgggttttttgtttgtttgtttatttgtttgtttttatcgttgttgtttacagacagtgtcttgctctgtcacccaggttggagtgcagtggtaccatcacagctcactgtccataataaaccttgaactcctgggctcaagaaatccttctgcctcagcctcctgagtagctgtgactacaggcacacaccaccacgctcaactattttcttaaatttttgtacagacagggtctcagtatattgctcaggctggtcttgaattcctggccacaaacgatccttccaccttggtatcccaaagtgctgggattccaggtgtgactcatcgtacccgacctgacttatttttattgataacatttcattgtctgtaagtaccaccgtttattaattcattcacgtattgagcacctcttggttgcttccaatttttggcaactatgaataaaggaatttccactaaaggaaaacgcttgctcacaagtagagatagaatccaggcaaaaatctagtccactactagttcatgcagctccagaggcaaagaggaaatgcggtttgtggacaagttactgttggaagaatgatggtttttgatgacagctgcaaggtacacaagcccattctgtgataatagctcaaatgaatgcatcactttgttagcttccagctgcagatgctgagccacagcttctataacccccacccagaaacctgctccccagagctcttctgtaaagctgctggctccaggcatgtccctcatgcttcagggtgtggaggccctccagggctggctacaccggggtcctgagttggcctaagcttgtggaggaccagagaggttgtgccaggcagaggcttaatatcacctttcaaaattaaacaagaaaatatctttttattggaaatttctggtttctggtctggcatataaggagcttagaagtcatcactctcatcctcacaacaagaacagaaactgagcaaagcagaaatcagtaactcttctcagattcatcggagaactaaggtcacagagcaaagcagtgcccccaaaactggagagctagacaggtggatacagagaatcacagcttactgaagcagaagcccagaaacagaaatcacttttggagccagtaatggtgcagaaaacttaaactgtaactgatgaactgctggaggctcagtgtggacaaacttgagagttaaagtcttcaaggttgcccagtcttaggttgttgggttttttcaaactttattgatgtataatttacaaaccacaaaattcacccatttgaaatgtacaaatcaatgattttttactagagttactaggtcatgcaaccatcaccacagtcctagttttagaacatttccatcacacaataagattcctatgcccacttatagttaattcacgtgcccagcccactccatggcaacaactaatccactttctttctatctttaatgatttgcctttactggaaatttcatataaaaggaattatatcacatggcttatttgtttaatccatgctgtaccatgtacctgtagccctttcctttttactgttgaacagcattgcaaagatgcagcatatgttgcttatccatctactagttgatggacatttggattgttgtaacttttcagttactgtgaatatgcttcgatgaacattcctgtacaagtctttgtatggacgtatgtttccttttttttttttttttttttaatagagtcttgctctgttgctcaggctggagtgcagtggtgcaaacatggctcactgcagcctcaacctcaacctcccagattcaatggatcctcccacctctgcctcccaaggagctgggactacaggcgcgtgtcacaatgctgggttaatttttgtatttttagtaaaaaggaggcttcaccatgtgcctcaggttggtctcgaattcctgggctcaagcgatctgcctcagcctcccaagtgctgggattgcaggcatgagccaccaaatctggcccactttcttaattgtgacttttccagtaaaaaaagttttaaattttgatgaagtacaatttgttgattttttttcaaaagtgtgctttgctgatgttaataaaactttgcctaagccaaggtaatgaagattttctcctatgagttaatttttctaaggtctgctataaaggtgcaaattcatatttttgcaggtggatattcaattttcccagtgccattcgttgaaaagactattccttcccccgtggaattaatatgttagcacctttgttaaaaatcagttgatcacaaggatatgtgggcttatttatagacttttaattctgttacattgatctgtatgtctactcctataccaaaaccatacagtcatgattactatatcttgaatcggcaagtaaatgttctccagcttttttttttttttttccaaaatgcgtgtggctattctgggtcttttgcactttaatataaattctagaactagctagtcaagttcgacacaaagatctgctggaatttttataggtatcatgtagaatctacacatcattttggaaagaactgacatcttaacaatattgcatctcctgactcatgaacacagtgcatgcatctctctcattcagattcccttgcactcctctcaagaatgttgtttagtttttagtgtataagctgtgcactcattttgttagatttcttcctaagtattttattcttaatgcaattattttcttaatttcactttgggtttattcattgttagtatatagaaatgctactaatttttgtactgaccttgtatcttgtgaacttgctaaactcattgaatagttctaatactttttggtgggtttgttagaattttctgcatacaggatcatgtcaatgaataaaatcaattgcactttctttcttccaagttgggttaacattaacaattcagagttcactgactgcactcactcctgcatgacacggggtctctatcctcttgtaaacatgactcagttgttttttttgttttgttttgttttgttttgttttaatttctggagctgccgcatgtgtgttcatgaatagcgctctggtgaaatttatactttctcccctagtccagaccctgggaagccatgggaggtcagggcccacagcatcacctgtggtcagtgaattctggagttggtgctatgcagatgctgtctacagagtctctatttcttgcaatttcaccccaaactggaagctttgggccacctgcccctttgactacggaagtggcacttaaatttcaaaagcaagatggtcacaatgatcataataagcaggaaacttgagtggcaaacagggaatctcatctgcagagaggagcagactctgttaacagaacacagtgcttttagagccaagatagaagaacagacaacaagtatgttgcttaacttatatacccacatgaaatcgaggctcaataagcagtaggctgggtaaactgctccaataaagttttaatccatctcccagtttccagacctgagccaattctcagacacagaatttattaactgaacataacacaatggtagagtcctcttgaggaaaccacctgcaatactatggcaagttgatacaatagtggttttccaagcccagtttccaaaggaacctatgtctattcacctcagtaactgaacactgggaagggggaaaacactcaaacatttcaaggaccgctggacacagaatctgcattgacactgacacctaggacctgaagcttcatcatggccccctgtttgttagagtggaagcaaatgtgggccaggaataaatggagttcttgcctaggtctgacccagagtgcccatttatccagtttccaaatgggaaattgaaatggacttcctcgataatgggcacaaaccctgactgggtccgtggctgttagtagaagagctagcagagtagagaaggccaagtgcacttcctgcaccttggccatgatagtaagtaataaacaatattgcatcctgagggatggaaaatgttaatgacacccttaatacctaaaggatgtaggggtggtgatccccatcatatcttaatttaaggtagcagcctggctcctacaagaacctgatgggtcactgggactactgcaactttgcactactgcaagctcaatggcaagagcctttaacagatttgttatcttcactagaacagatcaccacggcctcaggcacatggcatgtcgctactgatcatcatgagctaggttctgtcagacccacaaagtcaggtgattccaaaagtaatctgtgataagatagaagtagcatatccaggaccagataccaccacggccatagattacaagcaggtgacctaatccccaatgtcatctgccactgttgtgtctgtgtctctccttcagctcttttttattcctatagattaatggaccaggaagttctcttatgaccagctgctggaggagtagaagtgctgagcttagataatagatggtttggccggatttagagcgcaacctgaaaatgaacttctgttgtaatactacctcaatcgtatgtggtcaagaaatacattgttgagcagaaatccccaggtggcagagcttcaaatggtgcatctgatgatccacttcatatctaaaaaagaagtgacccaaactacgaatggacttatggacagtgaaaaataaattggacagctgctcagggacttagaatgagaagtagtgacagattgcaataagcaggattggggacggaggtttattgatggacgtatgagaagggacactatatgtgaagatatttgtatcacgtcttaaggctcaagagagcattcaccatggaagagacactaaacgtttaatcaagaaaaaaatgacctaactagttgacattagccagcctcagtcgctggccacattaatgctacacaatggccttatgtgtgcaatagccacggtggaagaagtggatgctatgcatgtgttcaacagcatgggtccccattcacccaggcatatccagctatttttgccaaatgttcaaactgccagcaacagaggccagtgctgaatacccagtagggcaccattacttaaggagactaatcagccccttgtggcttgttgattgcgtccagcaaattccatcctggaaggagcagagattcatctttactggaatttgtacacattacaggtataagtttgactttcctgctcacatttctttgtcgggcaccactaacacagggcttaaagaatgttggatacactgagccaggatactccatacgatcagctgggaccaagggacccacatatagcaaaggaagtgctcagtgggcacatgaccgtatgatctaaagttgttatctcatactgcgccacccaaaagccactggtctactggaataatggagtggcttcttcacagtgcaaatgaggtgcaaatttggagatcacagccttgaggatggggtgtcattctctactgtactgtatataccctaaatctattaccattctcttccatcaatagatagaatacatgatgcagataccaaagggtggaatgacctcacttactgtcactccctgtgacctgtatgggaatttgtactttctgctacatgagtttaggttctgtagttctagaactgtgctttccaataaggtgtcactagccacatttagctatttgcacataagtttacactatttaaaattaaatttaaagttcaggtcctcagtcacactaaccaggtttgtatactcaatggtcacatgtggctgctggttaccctattggacagtgctggctagatatattggttcccaaagtaagattacttccacctggaaaaaaacaatttaatgggactctttccattaaatttcaagctattgctcccatctgcgcactttgagcttctcatgctataggaccagcaagcataaaaaggagttgccatgcttgcagggatattggctctgatcatcaggaggaggtagggctgcccttatacaatgggaacagagaggaatgtttggctctcgagtgaccccttgaatgtgtcttcgtagtcccctgccagatttctatagtatagggacaattgtaagtgccacagcctgagaaggtcgtggaggaccaggagcccagaaccttccgggatgagggtttgcactactctattgggtaagtaatagagaacagcaaagattctggttgaaaccgacagtactctagaatggatagtagacaaggaacagaattatcatcagttgtggcttagaggccagctgccacagagggcctatcgtttgtacactcttctttctcatgtgaacttctttagtaagggatcaccagaatccttgaggagttgtgctcaaatgaggtgaactttctacatgaaaaagtagggttaatccactgcttggcatatacccaaaagaaaggaaatcaggatatcgaagagatatctgcactcccatgtttgttgcagcactggtcacaaaacccaagatttggaaacaacctaagcatccatccacagatgaatggaataagaaaatgtgatacatatacgcaatggagtactattcagcaataataaagaatgagatcctgtcattcacaacaacaaggtggaactggagggcattatgttaagtggaataagccaggcacagaaagacaaactttgcatattctcactgatttgtgggagccaaaaatggcaacaattgaactcatagagacagagtagaaggatggttaacagagtctgagaagggtagtggagtggggggggggggaaggatgtttaatgagtacaaaaatatagttagattgaatgaatctaatatttgatcatacaacagggtgactacaatcaaccataatttattgtacattttaataacaaaaaagagtataattgaaatgtgtgtaacacgaagaaaggataaatgcttgaggtgatggatattccatttaccctgatgtgattatgcattgcatgcctgtctcaaaatatcccatgtgccccataagtatatatgcagctactatgtaccgcaaaacattataaataaaaaaaatagaaaaaaatgtaggtttaactgttgcaagagaagatggactgtagtggatggtatagtgctaccaagatctttgctttataactgaggcgctcattcccccaaaggtattgtttgttgatgaccgataaccagggtcctctccatggacggccctcagttgtaggaaacttcctttccggggtcagcttccttctagtgactagtcaaggaatcaatgggaggagtacgaagcccccatccccctgcttcgtatggggttacttcttcaaggctatcctggttgctttctgttttcaaaaattactgtaactactgtgctccgaaatgacagcagaatgaagtggaagttagaccctgagatatcaccactattggaggcttaagccatgggcaggggccatccctgtccgctgtcgggaactctaaaaatagactcctcaggaatttgacttgggctcaatcaaaagccagaatctcaagcctactgtgtcctgttacttgtttcagcaaatgagataacctctgtggcccactgaataaactgtaaagtactagtgagaggatgctattattgctgtcacagcaatagttctgcatcccacagtaagccagtgtggtggataagaactgagctttgaaatcaaaacacctgttatttgagagctccactgaaaaaatgcctgtgacccaccccgggctgcccagcactgcacaatgatggcagaagccattcaggatgtgaaggggcttcaccaggactggacactaggaggctgcagaaagtaagaacatttgacagatgcaacagcaccctctggagcacccgaggatcaggggaagccttaaggacgaggataactgtacacagttgacagatcatttactgtgccaggcagtgggataagtgcttcaagttcctcacagccccgtggaggacaagtttcggccatattttaccaaccttccacgagctgtcttactggatcctgaagccgcacacacaccagtgactactgaggtcaggagttgctgatttaataaacactcccatgacacttactatgtaccaggcattgtttatgtgcttgacagatattacctgatgcagtccttatatgtgcttcgtgaagtacatgctactgctattcatgtttgacagatgagggaactgagatacaaggagtttggaagctcgcccatgatcacacaactaggaagtggcagcgccaagactcatatccaggctggctgggtccagagcccctgcttccagctgtgtcccttaaacctaagtccggctaaactattctcacttggaaacaaacatgtttctaattgtacatttgtgtcctacacacaccttggctcttctgaaaccatgcagaaagaatctactaacccagccacatacccctattagatcgtgagcacctcaaagcaaggtttgaatgccatgtttggaactactggtgcccgtgataagccttagcgcccactgggagatcatgatatatttattaaataatggtttattgaaaaatcaaataatcttcttggatcaactttatctggcttccaacacatgcaacaggcttgggccctggtatgtcagcatgtaaggatacgggtgaggatgttggatcctggaaatgactcctgaaaaggccgtgcatgtgggagatggggaggtacctgggatgtccttaactgcctagggcaccactctccacacccactggctccctccaagaagggacatgtgatgtcgctgtttccggtaatgtcctgttccatcctggagcgcccacaggggtctgacccaggccattcctgggagcacccacctaatgacctggtccagggttccagctcacctcagcctccttctgctcccatgtccctctccccacagccggcccagggcagtacagctggacctggcaggtgcttctcctcacgcccctcctggggtggctgatgctcagcacagcctaatccctcaggaccccaaagccctctcacacccagctgctttccaagtcctaacgtggatctgggagtattctgcggactgcggagtgtcccgatactcaacgcccccaccatctgctacagcctttagtcttctttagctgcctgtctggggataccgaggccctagctgcctctgctaggacaccccagccccacctctctggatcatcagcctgagaaagcaaaacctcatagtcacccatttaaggtgatcggttaatcaaaagccagacattacctggggaattatttgaataatatctcctaatcatcgtgatttgtcactcatcatgtcagaatgcttattattcactaggagcctccccaaaaggcttcatcatctcctgccagttctgtcaccacaagaccttggaaggagatccttaccagggaatttatcacaatgataatcgcatatgagcatcagctccaggtcttgagcagtagttagtggggagagaggaagcgcaaagccccaagctgggcagactgaggcccgattggggcagtgtggacacagcagcaggggacatgagaacacaactatgggccccaggagaaggaaacttgcaatcccaacaagggcatttgactgctggctgccagcctccaattcaaggacacatcgtggctcttaaaatactgatgggtcatgcttcagggcccaaagggtgcagatggcaatgcaggaattcctgcagtcagcttcctacggggtgttgcttcctgtgaagacctccatccctgcccagggccttcaaagtacagaatctggcatctcgcatagaagggagcaaatgtgtatgacttaagtctctggatgtgttctcaggatgtgagaatgaaacccaaagctcccgagtctccttctatggaatctgcctcacatagcttcatgagccccagcttcttgcctgccatcccctgaggacctggtgccagttccccatctgtgtcactcctctcctcacctgaccagatcctgtcacatggctaaaggaaggggaagagaatgcttcatctcagaaggagggtgagtagtgtgctcttcccatggaggtcatgtcattcttgtgcagcctcaaactcctgcactgctcccctgacctctccctggagggttctgcccactccacagtccctcctgctgtgctcccaaaccccagtgtgtatctccagaacatgtctgcaaggacctaggcctccaacatactcttccttcttccccatcttggcatcaaatctgtcttggaggactctaggaatactagtctgatttttgtagaacatccctcagtttcagtgggtctaatgtcttctcacgattagaagggcatgcatgattatgcattattaggaagaacaccacggaggtgggaagccctttttatagtgaatacagtatctccagcacttaggtcagtgcctggagcatatgaggagctggataaatattgaatgaatgagcgaatgaaatcatgttatgttacctcttggagagtgtgtaatgattcctcaaataacttcacgcagcaaggaacggtgtgtacaaaggcagggatggcacctgtctactggcattggggagaaatcatgatggagcattctccagatgaatgcaaccttgcaaaccacgttggccacccttcctactttctccagggaagtagcatcaaagtcattggcgaacatgggacttctgtctagagcttgtccaggaatcaatgggaaagtgttacttgaactgaatgttacataaatccctttaaggcccagctgaaacccagagacatgtgagaccttgacattggctgcttgcagacccaaacgaccagagagaggagcagggaattgggacaagggccacagctgcctactggcaagagagagtgctcagatagccactgatgtttgtagccctgccttgctgacttccccaggatgccaggagcacagaccaggcgctggggcagcaggtctctggagtccctagagctcagttgcttacctgttccatgactcaacaataagagggtgctgggatgcatttaaactttgattgctgggtaattgggaggactgaaaatgccacgaggctccaatgcagaggctgcgaatactaggaccatggagctgtagttcttcatgcgtcccacagctgagtactgagcatgtactgtttgccaggcactgctctaagctctgaggatacagcattgaacaaattccctgcttctgtggagcttatgttctagcgggaggggaggggcaggcacacaatgaactgcggaacaaagttacaggtgaagtaggttttatggtgacaaacgctatggaaacaaattgaatcgagagagctaaataaggagtgctggaaattgggtggaaggagggattgcaatttttacaatggtattcatagaaggcctcacagaagagatatctcgagagagaaccgaggatgtctgggaaggaatgctaacagtattataagagcaatcgtctagaagagaacaaagacatgcagtcgctcggggccttggaacagagtgtagagggcagggtctagagacactggtctggtgagccaggtaaagggtattccctgatcctctgagccatggactgcctcagagccaggtcagctgcactgtaccatgaactggcttcttggatccaggtttctattccaggttactgacttgacctgaggactgggtacagaatacaggtctaggtgtccagaaacctttctctcgggataaaggggatggaaggcaccattggcattgaacaggcaaggctgttggcctgctgctgtggcactgctgcggcgggcaggacaatggtgcacgtgtaaagactgggtgcagaacaaagcagaaggctgtctggtgacacctagtgctcattccagagtagactctgtgtcttcaatgaggggccagatgtcttaatccaggactggatttcctatctttcaaagttcacctcaggtggaggccagaagcaggtttggctttttgttgggggggaaggtacacataggaggctctttgtgcttcctactgtactccagcaggaggcatacaacttctggctgttcaacccttgatcatattggctctgatcagtgggctcaggtggagaggtggagacagccttgttcctccattgcagagtgcgtcatcaacccttcaacaatgtttcatccattgattagcatggattgcatcagttgcattgctggatattgcaaatacttgttttccttttctctcatatgttgcattttcctcagctggaattctccagtaaggaagaaactttcctcatcaactgtagctattgtgtcatcctgaaatacagttagtacaggaaatgcaggataaatgttttattctctctcttgcagagccaattctcaatgtgaggggtggttattcttgttccttccaatggggtccaacaagtcattctttattaatgactttttattttagaaaatgtttaggcttacagaattattgcagagatagtacagagaattctcatataccccacacccagttttccctattaccatcctcttatattagcattacacatttgccacaattaataaaacggaagacaaaaacaaggacactagaggaatctgaagcctctggcatctataggtataagaaataaagcccaactcccagccaaattgacatacatcctcactgtagagatctaattgcctctgttcctatgacctcatacaacacgttcactctcaacaaaaggattgcaagggacacacgcaaaagagtaagaaaatacatagtctgaagagacaagacaatcaacagaactggactctaatatgactcagatattggaattaggaggcagataatttaaaatgactatttttaaaaatttaagaggctttaatggaaaaagtaggcaacatggaaaaacagataggtaatgcaggaagagaagtattgcgctcagcaaaatccagagtatgggaaactggacagaacacaaggcatgtcttcattttcaacaaatgagtttcaaaaaaaggtaatgtgggggaatctataaattacttaaggtggctattaagaacataaacacaatgtatagatcatatttgcaaaccgattcaaagaaactgcattttaacaggagcatatgtccaccagatacatgtgacaaataagtgaacatttcattatattaatgacttgcttacatgtttaggaaagataataatgttggctttatgttttataagagagtagttatctttagaaatgcactctgatgtatttggagatgagatcacatggtgtcttggatttgctccacattatttcagtttctgctatgcggagtaggtaggggtataactagaaccagattggccatgagttgaagattattgatactgaaagtctggtatattagattaattatagtatttaccctattattaggtgtatttgaaaatgcttgtaatgaaaatatttttgaaataaatatgatatttaatttgaaatcctaagtgaaatggataatattttaggaaaataagtacatgaacaaattgatacaaaaagaaattcaaatctttaaccaaacaataaaaagtgaaactaatctaagctcaagccatcctcaaatgtggacaaggcagcttcggaggccaattctacattgttatcaggtaaagctcaaagccaccttaagtaaactcttccaaggcatacgaaaagttgggcaattattcaaattattttcccaagctaaccattcttcattcaggtaccagaggaggacagcaccgtgaaaacacttgagccaaacttcactcacacagaggcaaatatattaattaaattagtagcatattcaacatagaagtgaattaacggattgtgtccaaggaacaaaaacatgatttaatataaaacaattttcagttgtgatttcctacgttatcgaattaagattttaaaaagtgatcactttagtagatataaaaaagcttctggatgaaattctatacaagttaatggtcaaaacatttagcaaaataagtttagcagcatattttcttttcctgagatcaatggacaacatacttaagtatgaaatgttagaagaattcttgtcatggacataggctataacctctatctttggaaactgcatgtaacataaggcaggagatatggatatcaaaagaaatcagtatgaatattgaacagaaagagttaatatttggtatgacaatatgattatctagaaaattcaaagaaatgtgcacatggaatagtcaaataacagacttcagaataatagtatacaggttactacagtaaaatcaaaatccttgcaacccaatgaaataaccactcagaacaagtaatagaaaataccccattcacaatggcaacaaaatccagaaattgtctaataagacagacaaaccatacaagatctttatggaaacaactatgcaaatactgatagattcgggtcaaaaacttcccagataaatagagccatattccatatcccttaatagggaacaggctattgaaaagatgtcaatttttctttatccaagatgtacagatataacgcttaaaatttagctggcaatatgaacgtcaagcttgggcttctgtccttcactcccaaaacgaaccctggaaaactatagaaggaagaataaaataacaaacaaacagtataaacaacaaaatctaaacaacaaaacatgagaaagctctgagggagaatgaagactgtatttaactggtacctgtaatcgaagtggccagagtgtcaaggaagttagggagagtccatagctggcatagaaggaagatgacaggatgtgtagaaggaaatgtttaaatttttgcccctattccagtgtgaaaatgtcaggtggcacctgagaccacaggtgccagtagtctggtttcattgaaacagtagtagctccagtctgtgctaataaccacctaaaaccacattaataggtgaattggcttaactgaacataaagaatggattacaaatagagtgttgagcattagaatgaaacaggcataatgaggttaagtatgatttctgatgctgaatgaaagtttaaaaatgaaaatcactgcactgagctatgaaatgttagataattccaatggcagaactccttagatttctagctgctggtcagcctactcaatgtaaaaataaatattttagggtaaaaggtttgcaaattcaacctctggctggggaagagctgccctgggaaggtgcgtgtcttctcccagaggccactacaatcacagctcctgcagcccccccacggagcacctggcctgggacccgcagccattctctgcaaggggtgcagctgggcaaaggctcagaggtgacagaaacagagtatctgccacccatcactgcatcgaaagagccaggagtcaggaggaggatcctcctgagtgaggactgaaggtccaccctccccacatagaggggccacagaatccaactcagcccctcccgtcattccctggaagaccctggcaatgttgtcgtcccgaccacacccctctcccgactgccacctcatgggactcagagtcagagacttggtctgaggggagcagagaatgggggtccaggatctgccagccatcaaggtcaggaccccgagggatgactgagggtcctccacccccattcccaaacccaccaccaccaagacctaagccctgggggtcccaccccaatccctccccctaccgcccccaattcctccccctaaacccccgcaccccacatcttaacaaccacccccacccaaatccaggcagaacccgtttctgcccatgctgtcaacccagggaagccccaggttggggcttctaaggttattcttcaccttagaacaaatatctggacaggccccacaccactggacccctagaaattttactgaggtagggccgggcacagtggctcacgcctgtaatcccagcactttgggaggccgaggcaggcggatcacgaggtcaggagatcgagaccatcctggctaacacggtgaaaccccacctctactaaaaaatataaaaaattagccaggcgtgatggcggatgcctgtagtcccagttacttgggaggctgaggcaggagaatggcgtgaacccaggaggtggagcttgcagtgagcggagatcgcgccactgcactccagtctgggagacagagcaagactctgtctcaaaaaaaaaaaaaaaaaaaaaaaaaggaagaaattttactgaggtagaaggtccctgaattttagtcggatttatttcccatcctctggcatgcaaatgtctcactactaagtccagtgtgttttctacttcttgctcactggatccaattagcataatgtcattaatgtaatggaccagtgtgatatcttgcagaagcaaaaagccatcaaggtctctctgaataagattatgacacaaacctggagagctgatatacccctgagataggacagtagaggtatattgctggccttgccagctgaaggcaaattgcttccagtgggccttatggacaggaacagggaaaaaggcatttagcaagtcaatggctgcataccagataccaggagatgtgttaatttctcaagcaatgaaaccacatctggtacagcagttgcaattggagttaccacttggttaagcttacgataatccactgtcattctccaagatccatctgtcttctgcacaggccaaatgggagagttgaatgggtatgtggtgggaatcaccacccctgcatgtttcaagtccgtaatctccgcaatccctccatggatgcaatattgtttttgatttactatttttctaggtagagacagctctaatgtcttccatttggcctgtcccaccataatagccctcaccctaccagtcagcgagccaatgtgggggttgtgccagctgctaagtatgtctatgccaattatgcattctggcactggtgaaatgtccacaggatgagtctggggacccactgggcccactgtaagtcagacctgagctaaaactccattaattacctgacctccataagcccctactttaactggaggatcacaatgacattttgggtcgcctggaatcagcgtcagctcagagccagtgtccagtagtccctgaaatgtctgattgttgtcctttccccaatgcacagttattctggtaaaaggcaggaggtcttcttggggaaggataggagaaagattcactgcataaattgtcggtaatgtagtggggtccttccttaaggggacccagcctccacttcattcaaggtgttctgggtctgtaaactggctcatgtctagaaactgatagaggggtcgtgattctctgtttttataattcaaattagtcttttgacaattctaactagaagttttctgcttgtataaattaagtaggaatgcgtaggctttctaccaacttcacttctgggaacaccatgatttattagccagtgccatagggctacacaagtaagattattctgattgccgctttgcctttgctgtccattatggtagtagctatgcccaccttgcctttggcggtttagtgctgccacttggcccctgccacctcgggatccaattatacccattgtatttaaattttgtagtttagttactgcacttcccaccattagatctgacatacagaaaagagcaattacaagtctcttcaaagatgtaggtgctgccttcacaaatctatttcacaagtcagtcttcaagggcatatcttctggaccctcccagctgggatgagtaggtctaacatgactaatacactccaccatcccaatctccattagcctttggatcccttcctctacattaaaccaaggtagatcaggcatttccagctgctcacagtgggccatcttttaatccatatttcagctatccaagcaaataagcaactacaaccttttttaacttcccaagctgcaacattaaaagcagagtatttacttagtgggcccaaatcaataaattctgcctgacccaactctatgttccttccatcattatctcatgccattaatatccattctcatgcctgttctccagatttctctttacagaaattagaaaactcaagcagttcttctcgggtgtagtgcacctcctcgtggatcacactctcaacctcacctccaggggcctgccgggactttagtctagttataggtctagaagtaaaaaggggtgttggggtggcacctgaggagaatcaacattatctcacctggcaactgcctcagaggaggccaccactgttgcctcaagaagcacagggtttatctcctcagacaaaggtggaagggctgatggcagcatgggtcagggagggaatgttgccactactggggatggggaaactgttctggcaaaaaagattcatcagagtttacaaactcagcgtccccagcttcatcagggtccttccacacgtccccattccaagttgcagggtcctattcttttccaatcaatgccctcactttaacagtacccccctggtgaggctgtgcatgcatcttttgttgcaggtcagcaactcacatgataagaccttgggtctgttttcccacaattttagctctttctctacaggagataagactctcactcagggcaatcttagcagatttgaggctcagtatctgcttctgaagccgggagacagaatccctgagttcatcattttctttcatcactttgtccactgaacttaggagcaactaaccagcttcattatgttctttgattcgccgcatatggccaaaggtattatgtatagagtcactaaacttcttgcctctcacaagtgctgaatcacgaatgtcaaatgcatttattttaaataactctctaaacagttcatgtcaaaggctaaaagtgttttccatactattagaagtagagtccttagcgtttttggggtctaatcatattaggcaaccaactccagaaatgcccaaaccaacaaaagaactcaatctttaatattctctttctctagaaccactcctggtaccaaaaatctgtattagtcagggttctctagagggacagaagtaatataggatatatatcatatattttatatatatatacatatataaattatatatttaactagtacctttaatcgaagtggcagagtggcagggaagttatggggggtccagagctggcaaagaaggaagatgacaggatgtgtaggaggaaatgtttaaacttttgctcctattccattgtgaaaatgtcaggcggcacctgagaccacaagtgccagtagtctggtttgattgaagcagtaatagctccagtctgtgctaataaccacctaaaaccacattaataggtgaattggcttaattgaacataaagaatggattacaaatagagtgttgagcattagaatgaaacaggcataatgaggttaagtatgatttctgatgctgaatgaaagtttaaaaatgaaaatcactgcactgagctatgaaatgttagataattccaatggcagaactccttagatttctagctgctggtcagcctatattatattatatctatatatagatataatagatatatatatatacctattacttctgtaatagatatatatatatatatatattcccccttcccaggacttcttgattttgcttgctctgggttgtaggggtttgttgtttgtttagtgacttttctggactatattttaaagtctacattctttgtcatgtacagacactgccatctcttaatttattagcttagcggccacctagtgatttgatagagattttcttaaatgtatggaattaaaaaaaaaatcccagtatttgtagatgctatgcgtgtgtctgtgttggagcacataatacctcaaaagatgagctagtctatcttcactttggccaatttaagagtttttcatgatgatagcaataccttgaatatccacatagtatcattgtggaaaatagtcatactttatataatagtacattttcacaatgggcaattttatcctggttagccccaagggcagcttgagagaatcacaattgtgatagtcatacttagccatgatgcatcacctttcttctgagaatgaaaaaaaaaaagtcataaatggtaaataagcttcccaacacctactggggaatggatattattatacaagctaattttaaagatgagtaaccgaaatcaagttttcatctgctgaagcattaggaccctgcctcagatgtttgggtccagcttcctttcccatcctctgggtaaagtccaatgtgtagcccagaggtggttctcaatgaacactcaaatacagacgaggaactaaggcacagagaagcttgtgtaacaggtcctgagccaccaagcaagtaagggtggaggagcacagatgcaactcagggtctagctgaacctgcagcccatactgttagaaagaggtgcttgccagtgttcctatcggacagcaacatctttattaccagtgatcatgcccaaagcaggcatgaagggggagatggcttgtcagttcagacacttgaataacaggcaccattgccttttcaagagcttcatagatggaaagcactcaagctcctcagagtctagagccttgagagcagacgctattttagtgagatccagggagtcctggagctgaaccactgctctgcaggcccacaaattcagttttagcagtcctcccagagttgtccaggccccagaggctatctagcaaaagcaacatgacactgacacacaaaccagttgtcaacctcaaggtttcttactattaagtaaaaatttccagacagacaaggagaggaggctgtaatgatctctgcgatagcagatttgagttagagatattaggaagaactcactgttgacttaatattcatgcagatcattgcatctagaaatatttatagatatattaacaggttactatacacacatataatttcttgctctgtcagcagatgccaccaacaccccagtaggaatgagcatacctaatatacagatctagatttctaataccattctccaattttaaaaaatgggctcagtggagaaattgctgatggttgaagcagatcaggaaatatgcagtctattcctggaacatcttattgtgcttgacagtaaagaaatactaaaaaaaaaaaaaaatttaaacacattgacaaatgtataagaaagacatgtacaaagagaactaagagaaagtgctcccagtggccaaacctggagtaattttaacaacagaacatataaagttgtattggattttcaacaaagtgtaaaattagtatccgtaagtccacatcgagataaataaatgattacttaaatgcaaaaatgagggtgaacagacaaatttctcatgggaaagagttccaaacaatttatgcagatactctcactctcacaagaaagcagaatgtgattccccactgctcatagtgtgggctacacagagtaactttcttccaaagagaacactatgaaataggggaataaaagagaaactttacagtaaccatacttcgcgagcactacttcagccaggtgttcaaggtaaacatcattagtaataagtcatgctgataatatgtagccttgatgtgaagtgatgagaatggcatttctcctttattgtcttcttccccagaacccataaccccagcctaatcatgagaaaagtaccagacaaaccacaactgagggtcattctacaaaatacctgaccaatactcctcaaaactgtcaagatcatccaaaacaagagaagtatcacacccaagaggaatctaaagggaccttaccactaaatataatgtggcatcctggatggaatcatggaggaccaaaaggacactaggtaaaaatgaaataaatctcaataaagagtgacctttagttagtaacacgtaacgcaacaattgtagcaaatgtaccatactcatgtaggatgttaacaataggggaacctgaaactgaaggaggaggcatatagaaactttgtactatctttgaaaattattttcaagcatagaatacctcaaaataaataaagtctatgaaattttaaaaatggaggtaacaaaaggaaactttgcagactgatgaatttaatttttataaaagaaaccatacacaagcacagagaactaggaaatgtgacgccaaccatttctgagttgtcctcagacctttcctcccctgaagcctctaagctggactcgcccacaagacccgcctcttccccctgtgcgatacctcggaaatccatccctcatctccagcctttcaaccactgccctaatttggcctcacaattcctctcacttggactgtgaccagagccccctaataaggctagatgctctgggaccccatacttgctcaagaagggctatagaacacttaccaggggtaattgccacagagaaaggctggcaagagccaggcaggagatcagccccttgtcaaggaggctggagttcagagtagggggtttagccatggctggtggaacagggaggtttctcagggaagtgagaccatggctgagaggtctctcaccagcccctcagggggcaggtttggggcacctggaaaccctcaagacctatccacggatgggcacaggtatgctcccatctgctctgccctgtgatgttcagaattgtcccagtcctgtgtgatgtgtgtccatacaggaggctgctgtggaggatgctggaccctgaaatgcctgtaggagaggatgtggggtgcatggaacgtcctagctgctgcagccctgcagtccttaggaaacacagggtgagcattctccatatccctttgctctgtccaataagggacatgtggtgttgctgtttccaccaatgtcccctgtggggtccaagggcccaccctgagaccagcaagatgcaagttcttgagtacatagccaacgccaatgggagggatcccacttcttacccatccctctgcggacctgagtctccatccctcagattcccaacgccgaatgaggaggcacctcagtctaagatgggggcggggtgggccccctgtcctggggtgctgggtcccctcaggcctctctcatctcccaggaactcatagcatgcaggatcactgccaggcacttgccggtacaccaggtacttttcctgcacccaatcttgggtgaggagcttcttgggctccccaaagaggaagtgctcccttccagcatacacccccataatgctgaggacttcccacataacctccatgggacgcagttcccctccatgaagatcacacccaggactattatcaggaggccagacttgggcatgctctgctcatcacccagtatgccatcataagagaggccgagggaaacagaggaagctgggatttgtgagatccctttttcttggcatgtgagagggtaccttcttaccttcagtcttcaccaatattcctctccttgactactggtgagaggtgacagcatgctggcagccctcacagcccttgctcactctcggcgcctcctctgcctgggctcccactttggcagcacttgaggagcccttcagcccactattgcactgtgggagccccttcctgggctggcggaggctccctcagcttgcggggaggtgtggagggagaggcgcaggcgggaaccggggctgcgctcggtgcttgcgggccagcacgacttccgggtgggtgtgggctgggcaggcccgcactcagagcggccggctggccccccctgcccggggcagtgaggggcttagcacctgggccagcagctgctgtgctcaatttcttgccgggccttagctgccttcccgcggggcagggctcgggaccagcagcccaccatgcctgagcctccccctcgctccgtgggctcctgtgctgcccgagcctcctggacgagcgccactccctgctccacggcacccagtcccatcgaccacccaagggctgaggaatgccggcgcacggcgcgggactggcaggcagctccacctgtggccctggtgcccgatccactgggtgaagccagctgggctcctgagtctggtggggacttggagaacctttatgtctagctaagggattgtaaatacaccaatcggcactctgtatctagctcaaggtttgtaaacacaccaatcagcaccctgtgtctagctcagggtttgtgaatgcaccaatggacactctgtatctagctgctctggtggggacttggagaacttttatgtctagctcagggattgtaaatataccaattggcactctgtatctagctcaaggtttgtaaacacaccaatcagcaccctgtgtctagctcaggttttgtgaatgcaccagttgacactctgtatctagctactctggtggggacttggagaacctttgtgtccacactctgtatctagctaatctagtggggaggtggagaacctttgtgtctagctcagggattgcaaaggcaccaatcagcaccctgtcaaaacagaccactgggctctctgtaaaatggaccaattagcaggatgtgggtggggccagataagagaataaaagcaggctgctccagccagcagtggcaacccactcaggtcccctttcgcactgtggaagctttgttcttttgctctttgtaataaatcttgctgctgctcatcctttgggtccacactgcctttatgagctgtaacactcaccgcgaactcaccgcgaaggtctgcagcttcactcctaaagccagcgagaccacaaacccaccaggaggaacgaacaactccagacgcgccaccttaagagctgtaacactcaccgcgaaggtccgcagcttcactcctgagccggcgagaccacgaaccccaccagaaggaagaaactccgaacatcagaaggaacaaactctggacacgccgcccttaagaactgtaacactcaccgtgagggtccacggcttcattcttgaagtgagtgagaccaagaacccaccaattccggacccactggcagatcctggactccaccctgtgctgagcaggtgtctatccctctgctgacctgacaacctgcctcagaccaagggccctacctctctgagatgtgggaggcacaaagtgaaggggcactacacggacagccctgcatggcatgccaaaggctgacagatggagcagatttcagggtgcctgctctctctgggtgtcctccaggtattcagatttactcatgacaatgcctgcccctttcccttcatcccctggaggccccaggtaggggaggtatgtgccatgctcacatttctgccaggtggttgggggtgggaggtttcatggaggtgagcatctggttccaagggggtgatgataggtaggtcagcagtggagccacaattggtcagcagaggaaggagtcccaggatctttaggactcaagatgtgaacccctcgtgaggactggagatacccccatcccataatgaagggatcccacagagtctctctgtcccctgtccttgtctctttggagacctgatcatgggtggctctaagtggcaaggtcacttgtaccacaggcaggaagttggggaatcttcagggagattccctgaagattggtgtaaagggaagtcttggtgtaaagggatatgtttgctcatctcaggggttgggagtagaggaaggacaggctctggcagaagtaaagatgaaaaacccacaggaggactttggaatccccagaacagaagggtccagcctctgctgtcagccctggacaaccacatgatggggtgatgggacgtggggccccttacttctgttttggaatcttgggcaggtgagcactatgttctcagaggacgacttccagtcaacagaaagagccccgtatggtccacaactacagtggtcccaggatctgccaagagtccaggtgagaaacctgagggaggattgagggttcctcctggccagaacacagatggctgcttagaaatctgctctgcccctgctgtctccccagagagcatgtgcaggactatctgctgagatccctctcttatactgggatcattggtctcagggagggggaggcattggtctgagagggctgcacttaggtcagcagtgggagggtcccaggccatgaccagaatcaaggtgagggctgacgggacagcacttaccaaaaacatgggactcagcccttccctgccccttctgtcagccatgcgaagtccccgggaaccatgggtgtttccacttccctgatctcctcttctgatgtctcctggagatagagctttggtttaaggagatggccttaggtcaaaagagggagggtcccaggcccagatacacaccaaagatggggaccaaacaggctccttaccccagcacacatggacccagctgactatcaccacctcctgctgtcctttttgggtatccctgaattgtggatgggttttgcaggccaagaccaccatctcccagagaaatccaactaggaagtggggagctgcctctctttcctagagtcctgcctggggcctcccaggactgatggcaggggcaggatttctacctcagggataacttgttgtctgagtcctccctcagtgctctgggacttctcctggggttgacctgaggctccactcctcagaccacaacccactcctctctgacaccccaaaggcagagcgaggatgcaccacatttgggcactgtgccttggaactccaagggccaaggtccccactgaactggagtccaaggcctcctgagtcctccctcttcctcccattgatcctggcagggctgaaccagagatcccctctgcggacctgagtctccatccctcagattcccaacgccgaatgaggaggcacctcagtctaagatgggggcggggtgggccccctgtcctggggtgctgggtcccctcaggcctccctcatctcccagcagggactgggccttatctgtgctccccctaggccattctcatgataccaagcctcttccctcggtcagcccgggatgcggaaatcaggatccacttgcctggcagcaatgccaggaacttcccagggctgacagcagagagggagcctcgctctgtggggcctcagccctccctcggggtcctgaccttgatgcctggcagaacctgggtcctgccccccccaaccagccctgccctggtcacaccaagctctgaccccacagtcccttgaggcttaagcggcagggggcagaagccgaggggggtgtcggaggggacggcccagcctgagaagtccatccccatggggtgatccagggctggcagcagaggcggtgctggattatctggggtcctctatctggggagggagcgtcctcagtcctccctcagcatctcatcttgcctcctcacagagcctgggcccgctgccctcagcggatcacaagccgcccttcagaaccgggctgtcacttctctctgaccccctaatgtgcaagtccgcggtaccaagcccggaggtcctttgcgttgactgcagggacaaggatggactctggggcccctctatcaggatggggtggaacctctccataatttctcagagtcctgatgttgatgtctggaaaggccagggccccaccctttacggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctgggcccgctgccttctgccactctcaagacacccctcagagagatgctctctcttctctcagatcccagaggcagaagccagtggaggtcacatctggcccccatgcctggagcttccctggattgacagcagtggcagtactcgattctgctggggtgggggcagggggaagagtaatggcgaggggtgcagatgtggtcgagggtcatggaggtgcctcaatcctccctcaggtttctgtccttcattctctgcagagcctggagctccgtcctctgccaatggtgtctcctctcctcagaccaagtctctgactctgagtcccctgaagtggcagtgagggggaggtgtcaggtcgggggacaacattgccaaggtcttccagggctgacaggagggaccgagctggattctgtggcccctctatgtggggacggtggaccctcacttctcactcaggagactcttcctcctggctcccagctctttgatgaagtgatgggtgggagatgctctgtttctgtcacctctgagcatttgccaactgcaccccttgcagagaatggccgtgggttccaggctaggtgcttcctgggggtcttcagcacctgtgattttagtgacctctgggagaagacccacaccttcctacaggggcttctccccaaccagagctaaaggctggccctgttggttctgggatgggtgtaccaaagtcctcctgtgggttattcatctttacatctgctggggcctgccattcctcggctcccaatccctgagatgagcagacatttgccctttacaccaagaccccatctccctgtgggttccctaacttcctgcctgtggtacaagtgagcttgacacttagggccacccgtgatcaggtccccatagagccaagaacaggagacaacaagattctatttgctagatcatttttttgtaagactgttgtaagaaatgtattgaattgcctgacacagtgcctggcatatattgaatatttaataaatggtagttttcaaatattatttttagaccacatcttactataacctcctttgggaattacttctgttgttatctaaaatatctcagagaatatgcagctcaatagaacatataatatcaaattagtcaaaattgaagctttgtgaataaaagttagtaaaatttccctccgagatggcctattatttaatttgggcgtataagagtcttccccatctggatgcagctcaaagatcttgaaagttgagtgaaagaccaactcattctctccctcccagctgcttttccatccaaaccactattttcattcaatttactcc

SEQ ID NO: 25 - DNA, 59455 bp, Homo sapiens
tcaacttcttttgagaagataatatatgtagatgttataatagttaaaaagtaagagaaaggccgggcacggtggctcacgcctgtaattgcaacgctttgggaggccgaggcgagcggatcatgaggtcggcagatcgagaccatcctggttaacatggtgaaaccccgtctctactaaaaatacaaaaaaattagccgggtgtggtggtgggcgcctgtggtcccagctactcgggaggctgagccaggagaatggcgtgaacccgggaggcagagcttgcagtgagccgagatcgcgcccctgcactccagcctgggcgacagagcgagactccgtctcaaaaaaaaaaaaaagtaagagaagatactcggtgaaaactgagttgccctcgcacactacctgtctgcagctctcctctctgagggacaccactgctgggccctcggggcctttgtggagcatctgtgtgtggagaggcagacacacctacgtgtgtattcttctatttttatacaaatggtagccggctgtgcccttccctctgcaccacaacatagacctaacttcccacaacagaacaatagacatctataggattctattctaaacaaattagcactcagccataatggaacgtgtccctgtggatgaatatttaggggtctcctgacctttgctgttaccacgaaccctgaagtggcctcccctatgagagcatacaggcacgattcctagaaggagagttgctgagtcaacagggacaagtgttgaaaatgctgacacaggagactgccctccatggggctgcacccttctgacacttctccccacccctggggtaagtaacaaacagctcagattcactcgcaggttgtaagtgattccgcctttcaactcattttgtccaccccacaccctgggagaagggtctatgattgtccccattacagctgagggaggctagcagcagctcaaggccacgtttgtgaaggtgaggggctagggttggaacccaggaagcctggctgcagtgtccacacgactgcctcctgctgcttttccattaacaaacttttttatccttgctaatctgatatattttttaaaaatagttctcattgtggcttaaaaaaatcatttaatccaggccaggtgcggtggctcatgcctataatcccagtactttgggaggccgaggcaggcggatcgctagaggtcaggagttcaagaccagcctgcccagcacagtgaaaccccatctctactaacaatacgaaaattagcagggcgtggtggcacatgcctgtaatctcagctacttgggaggctgaggcaggagaatcgcttgtacctggaggtggaggttgcaatgagccgataatgctactgcactcctgcctgggcaacagggcgagactctgtctcaaaaaaataaaaataaataaataattaaataattatttaatccatatatatttctgtttacatctctaaaagataagggctttaaggccaggcgcggtggctcacgcctgtaatcccagcactttgggaggccgaggcgggtggatcacaaggtcaggagatcgagaccatcctggctaacatggtgaaaccccgtctctactaaaaatacaaaaaaattagacgggcgtggtggtgggtgcctgtagtcccagctactcgggaggctgaggcaggagaatagcgtgaacctgggaggcggagtttgcagtgagccgagatcgcgccactgcactctagcctgggagacagagcgagactccgactcaaaaaataaataaataaataaataaataaataaaagataagggctttaaaaatataactacaatgccattatcacactattaaaaattaacaagagggtttcaattccaggtaagatggagtaagcaagttccacctgcctctcctgtggaatgcagctataaaatctggacgcaactaatggagcagatacttgaggtttctgagcaggaaatagcagcaggtggattaggaaagaccagtgatatggtttggctgtgtccccacccaaatctcatcttgaattgtagctcccataattcccacgtgttgtgggagggacctggtgggagataattgaatcacgggggcggttcctcccatactgttctcatggtaactagtaagtctcacgagatctaacggttttataaaagggggaaaccacttttgcttggttctcattttctctcttgcctgtcaccatgtaagacatgtctttgccttctgccacgattgtgaggcctccccagccatgtggaactgtgagtccattaaacctctttttctttataaattacccagtctcagatatgtctttatcagcagtgtgaaaatggactaatacaaccagaattcaaagtaccactgaatggctatgagttacccattggttgtccccagatgtctctcggtctggacaagctatgacaagacatagacaagctgattctaaaatgcatatggaaaagcaaagacactataatactctaaacaattttcaaacagaaaaataaagttaaatcgtactccccacttttaagccttcctataagcagtgtagtttgggtaaagggatatatacacaggtcatttgaacaataggatccagcagtaggccacacacatacagctaactgatttctgacaaggtgcaaaaacaagtcaacagagagaagaatagtcttttcaatgaagggcgctggaacaattggacattcatataccaaaaaaagaggtaatctcaacttaaaccacaagctttatacaaaaattgatataaatgggtcataggtctaaatgtaaaaaatataacattataaaatttttaggtgaaaatatctaaaatccttgtgacctgggaaaagagttcttagatataataccaaagcacaatccatagaaccaaaaccatgctaaagctataaaactcccagaagaaaacatcagaaaaaaatctttgtgatcttggatttggtgatggtttctgaaatgtgacaccaaaaggacaagcagcaaaagaaaaattaaattgaactgcatcaaaattaaaacttgtgtacatcaaaggacactctcaagagagtgaaaagagaatccgtggaagaaaatgcttgcaaattatatatctgataagagtttaatatccagaatatataaggaactcctacaactcagcaacatcaaacaactcaattgaagaatagacaactttaatagacattttcccaaagaaaacatacaaatggccaagaagcacacaaaaagatgcccgccatcactaatcattagggaaacagatcaaaatcccactgagataccactttacacccatcaggatggttactatcaaagaaacataaaataaccagtgttggcacagctgtgggaaaattggaacctgtgcactgttggtgggattgtaaaatggtatagctgctgtggaaaacagaatggtggttcctcaaaaaactaaaaacagaattcccatacatcatagctcactgtgtgttgctatagcagaatacctaagacaggtgttgcgggaattcagggaccccgaacggagggaccagctggagctgcgatagaggaacataaattgtgaagatttcatggacatttatcacttcccaaataatactcttataatttcttacacctgtcttactttaatctcttaatcctgttatcttcgtaaactgggaaagtacgtcacctcaggaccctgtgataattgtgttaactgtacaaattgattgtaaaatgtgtgtttgaacaatatgaaatcagtgcaccttgaaaaaacagaataacagcgattttagggaacaagggaagacaaccataaggcctgactgcctgcggggtcgggcaaaaagagccatatttttcttcttgcagacagcctataaacagatgtgcaagtagggaagatatcgctaaattcttttcctagcaaggaatattgatattaatactctgggaaaagaattgcattcctggggggaggtctataaacggccgctctgagaatgtctgtcctatgcggttgagataaggactgagatacgccctggtctcctgcagtaccctcaggtttactagggtagagaaaaaccccaccctggtaaatttgaggtcagaccggttctctgctctcgaaccctgttttctgttgtttaagacgtttatcaagataatacgtgcaccgctgaacatggacccttatcagtagttctgttttgccttgtcccgtttcctcagaagcatgcgatctttgttctgccttttgccctttgaagcatgtgatctttgttcctactccctgttcatacccccccgccccgccttttgaaatccttaataaaacctgctggttttgtggctcaggcaggcatcacggtcctaccgatatgtgatgtcacccccggcggcccagctgtaacattcctctctttgtactctttctctatttctcagaccagccgacacttatggaaaatagaacctacgttgaaatattaggagcgggttcccctgataactgggtaattgataagcaatagatgtttatttgactcatggttctggaggctgagaggtccaagggcagggcaccagcatctggtgagggccttcctgcgtcgtctgtagtggaaggtggaagggcaagagagagagacagcgaaagggcacgagagcaagaggggccgtattcacttataacaaagccacttgtgagctaactgacacactcacgcgataacagcatgaaaccattcatggtggcagagtcctcgtgccctaaatggctcttactaggccccacctcccgacaccactgcattttgaggattaggttttcaacacatgaactttgctgcacacattcaaaccgtagccctgtatgatccaggaatcccacttctgggcatatactccccacaaattaaaaacaggagcttaaagagatatttgttttcttttctttttctttttttttcttttttttttttgagacagagtcttgctctgtcacccaggctggagtgcagtggcgcgatctctgctcactgcagcctgtgcctcctgggttcaagcagttgtcctgcctcagcctcctgaatagcttggactacaggtgcacaccaccatgcccagctaatttttgtatttttagtagagacaaggtttcaccatattggccaggatggtcttgatctcctgacctcgtgatccacccacctcagccggagtgcagtggcaccatctcagctcactgcaacgtccgcctcctgggttcaagcgattcttctgcctcagcctcccgagtagctgggactacaggcgcgaggccaccatgcccagataatttttgtatttttaatagagacatggtgtcaacatactgaccaggctggtctcaaactcctagaccttgtcatccacctgcctcagcctcccaaagtgatgggattacaggcgtgagccaccgtgcccggccttcttttctttctttctttttttttttttaagacggagtttcactcttattgcccaggctggagtgcaatggcaccatctcggctcactgaaacctccgcctcctgggtaaaagtgattctcctgcctcagcctcccgagtagctgggattacaggcatgcgctaccacgctgggctaattttgaatttttggtagagacagggtttctccatgttgatcaggctggtctcgacctcctgacctcaggtgatccacccacctcggcctcccagagtgctgggattacaggcccagcctcttattttttaaattagagataaggtctcactatgttgctcaggttggtctcaaactcctggactcaagcaatactcctgccttggcctcccaaagtgctgggattacaggcatgagacactgcacccggcccctttaaagagatatttgtattccatgttcatagcagcattatgcgcaatagccaagaggtggggaaaaacccgaagtccatcaacgaatggatatataaaatgtggcctatccatgcactggaatattattagccttaaaaggacagaattcctgaccacaacatggataaaccgaaaggactttatgctcagtgaaataagccagtcacaaagggacaaatgctgcatgattgattccttttatatgaggaaatctagtcaaattcatagaaacaaaaagcagaaaggtggttgcgaggggctgggagggggctgggaagctgttctttaatggataaagggtttcagttctgaaagatgaaaagacttctggagactggttgcgcaacaatgtaaacataacgccattgaactgtacaaaaatggttaagatggtaacatttatgttatgtgtactttaccacagttaaatataataggctgggccgggtggctcacacctgtaatcccagcactttgggaggcaaaggtgggcagatcacttgaggacaggagttcgagaccagcctggccaacatggtgaaaccccatctctactaaaaacacaaaaattagctggacatggtggcacacgcctgtaatcccagctactagggaggctgaggcaggagaatctcttgagcctgagaggtggaggttgtggtgagcagtcattccagtctgggcaacagaatgagatactgtctcaaaaaacaaataaacaaacaaaaagccgggcatggtggcacaagcctgtggtcctagctacttgggaggctgaggcaggtgaaatcgctcaaacccgggaggcagacgttgcagtgagctgagatggcaccactccactccagcctgggtgataaagcaagactccatctcaaaataaataaatacatacgtacaatataatataatgtaatataattaataatgctcagatgcatgctacagcatagatgaaccttggaaacatgctgagtgaaataagccaaacacaaaaggccaaacattgtgcgattccacttatactagcagcaggaataggcaagttcacagcaacagaaagtggaatcaaagttacgtggggaggggaccagcagatgctgctgaatgagtacagagcttctgtttggggtgatgaaaaagttcgggaactagatagtggtgatagtgacacaacattgtgaatttacttaacgccactgtacacttaaaaatggttaacgtaggttgggtgtggtggcacgcgggtgagcggagatcgcaccactgcaaactgtaattacacctgtaatcccagcactttgggaggctgaggcaggcagatcacgagatcaggagttcgagaccagcctggccaacaaggtgaaacctcatctctactaaaaatacaaaaattaactgggtgtggtggcacgtgggtgagcggagatggcaccactgcaatccagcctgggcgacagagcaagactccgtctcaaaaacaatggttaacatggtacattttacattatgtatattttaccataaaaaagtagtgataaattggactttatgaacatttttaagttttgttttgagaaagacactgttaagacaaaagacaaactagtccaggtgcagtggctcacgcctgtaaccctagcactttgggaggctgaggcaggcggatcacttgagatcaggagttcgagaccagcctggccaacatgataaaaccccatctctactaaaaaaaacaaaaattagctaggcatggtggcgggcacctgtagtctcagctacttgggaggctgaggcaggagaatcagttgaacctgggaggcagaggttgcagtgagctgagattgtgccactgcactccagcctgggtgacagagtgagactctgtctcaaaaaaactaaaattaactaaagactgggagaaaaaaaatgacacgtcacatatccatcaaaggatatgtctcaaaaatgtataaagaactcccaaagctcaacagtaagaaaatcaaggccaggcatgatggctcacgcctgtagtcccagcagtttgggaggccaaggcaggtggatcacctgaggtcaggagttcaagaccagcctggccaacatggtgaaaccctgtctctactaaaaatacaaaaattagccaggtgtggtggcgtgtgcctgtaatcccagctactcagggggctgagacaggagaattgcttgaacccgggaggcagaggttgcagtgagccgagattgagccactgcactccagcctgggtgatacaaacgagactccgtctcaaagaaaaaaaaaaaaaaaaaacaaccaacaacccaataagaaaaaaattgagaagagattggaatagacactccatcaaaggaggcctacaagtggctaagagacacatgaacagctgctcaacacctttagcccccagggaaacgcaaactaagaccacgatgagatcccaactacacaacaattagaatggctaaaatttaacaaaccactgataataccaagtgttgacaagtatataagtcagggttctccatagaaactgaccaacaggagatatatctgtatctatctatgtatctgtctctctgtatctatatctatatggggtggagacagagagagagagagatttattataggaattgactcatccaaacggaggctgagaagtcccacagtgttgtctgcaagctggcacaccaggaaagccagcagtctgacccagtccaggtccgaaggcccaggaaccggtgggctgatgctgcgggcaggagaagatggaggtcccagctcggagagaaaattcaccctcccttgcctttttgttctacccgagccctgagtggattggatgctggctgcctgcatggtgagggcagatccagtttactaagtaggaggctcaaatgctcatctcctccagaaaccccttcacagacaccctcagaaacagtgtctccccagcatccaggcatccctcagcccagtcgagctgacgtaaaattaaccatcaaagagaaaggtgacccatgtcctagtttgtccaggagtttcctgatttttgcatggaaagtctcaaatcccaggaaactcctcagacccggacaaagtgcagtgattggtcactctgggcgagcacgggcagcatctggagctcacacgttgggacagtggccatgcgagatagtgtggccactctggacaacagccaggcagttacctacaaactgaatattgagcattctcactaccaggtgtttatcctggagaaacggaaacctgtcctcacacgaaaacccatacataaatgtctagagcatgactgcttgtgacagccagaacctggaaatgacacagacgtccttcaagatctgatcaagtgagcagcggccaggctgcggggcacgcatgcagcagatcacgctcccgagtggaaagggtgagccttggaggcacgttggagagaaagaagccagcctcaaacattacatactgtaggattccatttacttattattatgtatgattagttttttgagacagggtctcactgtgttgcccaggctgatctccagctcctggactggagtgatcctcccgcctcagcctccagagtggctgggattacaggctctagccaccacatctggctatgattccatttgtccaatgttgtcaaaaggacacaagccatggagaagtaaccggcggcttccaggggtcaggaagcctggtcctgcagaggagcgccatgaggggctttctggggtgatgggatcacgctgcgtgtggatggtgtgtgcagaggggagcatcgcacaaacccatacaggcaggaacattgctagaactccacactaaaaaagtccgttctgctgtacgttaattttgttttattttatttatttttgagacggagtctcactctgaagcccaggatggagcacagtggcatgctcttggctcactgcagcctccatctcccaggttcaagcagttctgcctcagcctcccgagtagctgggattacaggcatgcaccatcatactcgctaatttttatatttttagtagagatggggtctcaccatgttggccaggctgatctcaaactcctgacctcaaatgatgcgccctcctcagccttccaaaatgctgggattacaggcgtgagccaccatgcccggccctgtatgttaatttttaaatgaaagcttttaaattaataattcctaaatgtcatcccatatggagtcagtgtccagatttcctatctgtacataggatttcccaagagcaactgcataccattggttcacacttccatccctccacacctgtttccttgtctcttaactctctttttgcccctgcaacggagcagcggaggatatcgagcctccagtctgtggaggccacaaactggcctttggacccggtgccacctccctgttcctcagcgcccttctcctgcgcttggcagtaggtggcaaggctcgtgggcttcttggcttctgtgggaagcccacctcctctcccgcaagcccaggtggtctttatcagactgcacactccctcaagttggggtacagtggtgtgatggtggcacatcttcctggaaagtcccataccccagggtgtctaaggacaccccaccaggcccccagccccgtctcctgcagaagctgcagcttggccttggggaggggctggaggagggcaaagcccccaggatgggtgagcaccaccctccaaccaggggccacggaaacggagggaagaggagatgtggagacaacaagcagggctgcctcgcccgggggagctgagggcccagagccagctgacccaccacgccaaagcaagttcagcctcagtcccaccggagtgccacgactgggcaagccacccctccagtacaaacccccaagtcagaggggcacggccgcagggtggcagcagctctgtcactgccctgggctgcacatttggctgtaggcctcacggatgaggaccttgcccttttgcagacctccaggtgtgactccagccagggccccgtgacggagcctccaatgggtcccaccggtccgtccgctcagcagctgcttctggaaggccatcatcagctccgccggtccgtccgttcggcagctgcttctggaaggccaccatcagctccccagccccttcactcactgtcccttgaggggttccaggaggccatggctgagaggtgctgcagccaggagtgcagaccccatcgcagggaggacagatcactcccccacgacacaaggaaggccaccccgaggtgtgggggcaggcctgggggtctcacttctgggactacgaccatgctcttcctccaggtcgcccaccttcctccttagcacagggccccaggtcacagaatgactcaggcctgggagctgggtgagggcgaggacttccccagggctgctccagacctgggttttctcagcccactgccctcaccaattgttaaccttagtggctgccctttgtgtggtccagcggatcccacaaccaccggaaggcaccagggatctctgcaggcccccccccagcccctgccacctctccctcttgctgccagtcagggagtagctactcaatgcacctgcttcatcaaggtatccatgccagctgcagggtgcccctgtgcaccttctgtccttaagagctggcccagggtggcatccccccaccagagtaagtcttttttctttctttttttttttttttagacggagtcttgcactgtcgcccaggctggagtcagctggagtcagctggtgtggtctcagctcactgcaagctccgactcctgggttcaagcgattctcctgcctcagcctgccaagcagctgggactacaggcacccgccaccacacccggctaattttttgtattttcagtacagacggggtttccccgtgttagccaggatggtctcgatctcctgacctcgtgatccgcccgcctcggcctcccaaagtgctgggtggcatgagccaccacgcccagccccaccagagtatttctaagccccttgggaagggagggtctttgggtccctctgggggcctaggtagagtagggtgcagtgttatctgctataatatgcttgtctctctcagtctttgcattccttttctgcatcatgccatatggcattttagccattttgacctcatttagaatgtgccacctttggatccaggtgccagcagcaacggggcagatgatgggaatccctccccagcacccggccaagagtcccggcccacccaatgtcaacttctattctttaatctcagccccaaatgactgtgaattcacagggcattcttctagctccaactacatcaatgagggataaactagaaagaagacatggctggactctggtatagaaacggatgaggaactcaaagcagtgggctgggattgctgtgctctgtgtctggaagcaggcgacagtggcctggcgtccagcctcagccggcggggaccaatgtcccacaggaggacggggttcaagccccactgcagagatgaggctgaaaagccaagcaatgaatgaaggtattaagtcagagccagcaggaactggaattgaaattgcttcagtcttggtgagctcagtggtaggacttgctccctggacagggccagacgggaccaggtggacactccctggtggggtctgcagggtagaatgaggggtagggccccgggaaaggtggcaggagccaacgggtgcagccccagaggttctgagtgggcgtctctcagtgcgcagactgagaccccagggacgctgggaccagacgcaggtgagctggtgcgggtcggggctgcttgccacccacagtgtactgctgtgaacttcactctgccccgctgcatcctgagtcgacccatccccctccagacagtgctctcaggccacctcgggtcggtcaagcccatcagcctggactggctttaaatggcagggtcctgaccttgcttcacccagggagggtcactgacctcaggatggaacaagaagcacttctgggcccctctcttcctctgcggaagtggccacagctgggagactgacccaaatctgaggcctgtgcctgggtaactggcttggagaatcaccattagcccgggcaccaggaggcccagggtggcttacagacagtctcatctcactccaggacagacgcccagagactgctggggggcacttcctgagatattcacagagggcctatgacagcaactgggtcccccaaccttggacaattccagagaaaatgtggccacacgtagatcaggcaggcactggaaaaggcactgggttgagagtttggggtgacagttttggaggtgcggaggctgctgttgtctgcatcccaaggtcgtggggttcagactgcaaaagggaacccaagaaacactgtaggagctgcagggcctcgagatgtgctggagccaattcccgggggtctcgggagcccagccttaaatttacaggaattctgagctggttgttaaaacacagtcattattaaaaattaattataaacacttataaccaaatgagttatattttaaaaacacagataataagaggtgggtgcagtgactcatacctgtaatcccggcactttgggaggccaaggtgagtggatcatttgaacccaggagtttgagaccagcctggacaacatagtaaaaccccatctcttaaacaataaattatcagagcatagcagttcatgcctgtagtcccagctactcaggaggctgaggtgggaggatcacttgagcccaggagtcagagactgcagtaagccgtgatggtaccgctgcattctagcctgggagtctagctaagtcagctgagacgctgtctcaaacacacacacaaatacaaacatggataataaatactggaaactcatcacttcctaattattttactacatttttctactcttgttgtgttttactctagtttggtctagggttgctctctctggagagtggacataaaatctagctccgggggagctggtggtggtgggtgggcacagtgagctttcagggacacttctttatcctggcagacggcttaatgcctgggggcctgacctgtgaccaggggcttgtttacaccagcaggtgcccttgtggctctggtctgacctgtgttgggtttattcctgctaagtggtccactctctaggagagccctaactgggaaagaagttaggttcaggtgtgtcagtcaggggagacacagaggagctggccccactaacacgtgaagctacagaagcagtttcgtgactcagatcccagagggaacagggcagcaaacctcgcagggccagtgggaaggaggaagccttccgggacacacatgtcagccagcaggtgggagccggacagcgcgggaggggctgtggctgagccctttcctgggccccagggtcctacccaggcaggctccccttggggagttccaactagcaggtttaacccttttcccatttgccccaagaatagtcaccaacagcgcttgcggctgcagcatttacccagagataactttgccacacaatatctcactttcattattttcacatcactctggtatattgacttcggaaacaaaagacgtcacgattcatagcattctggctttagtagtgatgtttccattcacaaaatatagtcattctctatggctgaaaacctcaagtcctagaaaacacagcattcctacacgtgatgttaatattgtcctcaaacagttgttggctgaagatccgtttgataaatttttcacaaatagattacttttttttttttggagatggagtctcactctgtcacccaggctggagtgcagtggcaccagctcggctcactacaacctccgcctcctgggttcaagcagttctcctgcctcagcctcccgagtagctgggactaaaggcatgcaccaccacacctggccaatttttgtatttttagtagagacggggttttacagtgttggccaggctggtcttcaactcctgacctcaagtgatccacccacctcggcctcccaaagtgctgggattacaggcgtgagccaccacgcccagccccagatggatcattctaatgattcagatgattttgacgttagttctgtttagaaataactccaagaacagttttttcttttcttttttttgaggcagtgtctcactctgtcacctaggccggagtgggatggcacgaacacagctcactgccaccttgaccccctaggctcaagcgatcctcccacctcagccccctgagtagctgggaccacaggtgtgcaccaccactcctggcctccaagaatagatttatattttattttcacattaaaaattagtcagatttgcttcagcctcaaagagtatgtttatgtaaaattaaatgagcgctagcagggagctgaatttttttttttctaaaatggaaaaaggttaaagcgagtggccaagtttcatgaactgtcggagcctgtcctgcttcagatacaagaaagttgaactcatgccgagagtatccgacttatgatggttcaatttaggaattttcagctttacaatgatgctaaagcaatatgcattcagtagaaactgtactttgaattttgatctttcctgggctagccatacgtcctaccatacccatggcaggaagctgaagctccgggtcagccgcaccaggcggagggtaagcgactcactctgcaggccactgtgtccccaggtgagtttgcccagctgcaggctgatgttagtgttctgaacacgtttatggaaagccaggctaagctatgatgtttggtaggttatgtgtattcaatgcatttttgacttgcgatattttcaacttatgatgtgtttattgggatgcagcttcatcgtaagtccaggagcatctgtatgcaaaatggatgctttatagttaacaataatatctcctatagcttcaaatagccagaaggagaatactgaatgtttccaacatgaaaaaatgataaatgtttgagatgataagctaattaccctgatctaatcactatatatgtatggaaacatcattatgtaccccataaatttatacaattattgtatcaattaaaaaataaagtaaaatatgccaggcacggtagctcacgcttgtaatcccatcactttgggaggccgaggcaggtggatcacctgaggtcatgagttcaagaccagcctggtcaacagggtgaaacccagtttctactaaacatataaaaattagctgggcatggtggtgcatgcctgtagtctcagctacttgggaggctgcggcaggagaactgcttgaacctgggaggtggaggttgcagtgagccaagatggcaccacgcactccagcctgggtgacagagcaagactctgtctccaaaaaaaagtaaaataaaagtatttaaaattgaaagctggggcaacataaaatgatatgaattcactgcgattacatctgtgtccctaatggggagtcctggctgtgggtctgatgggggacacccctggaaggatgaggatcaaccgcctggggagtagggagggaggtatgcttaagtcatggaagctgttggcagatgcagaatccgtgacgtgatacgagactcactgaaggaacacgccagaaacacacatgtcaggcccagaggcgaaggaaaagcaaagcggatgtgcagacactgggctgacaaggagagaggtgaaagccaggagggcccaggtgagcctcctggagggaggagtggccaagccagaggcaggaaagatgtcccatggggagagaaaatctttccaccaaatttaaaggagtcagaaaggggctgctgatttaggctgcaaggttcagcgtaaacgaaggtgcaatttcagtgttgtcagaaacactctgaggtgtggggtggcagccacttccaacttagccagaggcccacccagaagctgaggttgggggtcaccacacagggcagaggccacttcaagagaggggcagggggaggggggcagagactgggcattgttctgaggtttcagtcacggcccacagccaaacgtaacatgcatttcaactgagcgctcaagcactctgaggaattaggagagtggatgagagatttaaaaatccatgcttgtgagagaattcacatttgtacaaaattcacgtgcggctctgaaacgtgtttttgccaaacatcgtgccctggatgtgttcccaggtgtttcttcacgttcctaaaggccgtgtgacgtcccccatacctggaacagaaaggaagtggccgtagccaggctctgaatgtgctgagtgggaaagaaaggtgctgggggaggaggacctggacttcacacttaacaagaaggctgggatgtggcccacacctctctccttgccaggccatgctgtgtgagggcaacggtctcccaggtgggtagatgattaggccaaagacagaggctcgtctgctagagttcagattctcccttggggtcccaggggcctagaggaggaggggaggtgaagctgttgtctctctccgcctgtccagtctgtcctgtggcatttgagtggcagcagtgatgctgtgacctgggtgctgggaatagaattctgccagccacccctgctctgggcctaggctggaggcctctgtgccacccagtgggcttctcccactttgggagagtcagagaagcacccccttccagggggctccctcacagagaacacggggcgggggcggtgagcggctcgggctgtctttgggcttcaccttcctggccaggtactttgctttctccctgggagtgggttccagaagggaatccccaggttccatgggccctcaaagaggggtggggtagactgctgactctcccccaggggacccccagtcacacagtgggcccacccatcttggccatgaagcctggtggatcaagagaagtgggggagctgaggacaacattgggggctacaggagaaggtccttttggggaaagtgactctgacagcaggtgtcagagcccctgggggtgtccctgggatgctctggcagctttgcatcatcaaggaggatgcccccaacaaggaggtctcaccgccccctgggttgtcaggtgagctcctggggcagaggtggccctgggtcgtccgaccatcctggtgtgggctcagtctggacccctgggggtctctcccaccccgagacttttatccacctccccaccaactcactctgtacaggcaagcactcccctcgctgggcctgtttctcctctgtccaatggtgagtgggattctccttcagcttgtaagtgggaactgtccccaaaccagggacaccctgggggctcctctggaactggaaaggccggaagagaaactggctttctcttctgagccaaaggacaatgttcctccagcagctgggagtccacaccccaggcaggcctcgccttcccacttgtgatgcggggtcccacctctgcagcttcgggtgtctgagtctgaggcagtgctgaggatgaggtcactctggagggtggcccggggttccaggtatgggtgcattaccaggcctttaggaatgtgaaggatcgcctgggaacatgcccaggacgcgacgttcagtgaaaagtcatgtttcagagccacacacgaatcacatttccttatctctgcacagtgaccgtggatttttaaatctttcatccgctcccctaattccccagagtgccggggcgctcggttgaaatgcgagttgcgtttggctgcaggccgtgactgaagcctcagaacaatgcccagtgtttcaaaacaacatatttgtgcaaaaagaaggcctccagatctcaggaagcgggaaacagctgaagaaaaagaacgcctgcgaagggaaaggacaggtgtccctgtgggaggacagggcctgccgtccgtcgctcggctgcaggtggggcccggccgccccagatgagccccgctccgcgcccgccctgcttgcacccagccggcaagtccaccgctcgctcgcgacgccaaggaaagcagcagccccggcgcccacggaggacgacaccggccgcggccaggggcggggcgcggccatgaaaggcggggccaggcgaggggcggggccgaggcgggtgtggtcgtgtggggcggggccgcggcgggggcggggcctgtcaccaggggcggggtgagaaggggcgtggtcatgagaggaccgaagagaggggtggggctgcctccgaggcgaggaccgtgcggggccacgcgtgggggcgtggttgttggggcgtggccgctgggaggggcggggcttctctgcgcacaggtgcgaagctcccggcttcaagagcgcagtagcggccccacagggcagaagtgcccttgttggagacgggtgcctggggcaggtgggggtacccgagggtttccagccacaaggaggggtgtggacgattgggggattggggccggtgcgtggtccgcgcagccctccgttccccaacagcagatccctgtccctcggccccgtccagcatctcgctctccagccccactctctccatcggcagaaccttcagaatgtgccgcggaagggaaggggcgcggccggagggacccctgccccgcgattccggcgccacctgacctgccgggcaccgggcaccgtcgtcccccggctccaggagggtcctgtcctcctgcttcatcggccccaagattcctcgggtcacgactctgacccccgctcccagggcgccaggcgcggacagcggggaagcggcaccagggaagcccagggacgcaggcttccgctaggctgagacgcgctgaccagctggggccccgctggccggagcctccgtttccccctctgcagagcaggcttggccgaggagtaagcgcggccgctgcggagggtttggcagcggggacagggctgcgcccggtgtgtgcgcggacacctgccgcccgtcctcagcgcccggtagcctcaggccccagctccgaccagtgcgccctgacctgtcctgccctgcacgggacgtccgccccaaccccacccaacccaacccccgaagctgtgtaacccagggacaagagtctgccccaaggggacgcccagctctgtccagtgtgcccaccactgtctccggcgcctggccagctgggcgtagagtgggcatcccgttcaggggcgagatgggtgaaggacacagggaaggcgcgtgcggtgtggcagcctgggcctcccggcctcgccagactatgggagacggctgctgggacggacgggagtcaagctcttcagtgccaggactggacactgtgtctgccactctggggcactcagcgtttccaagtggatggcaacagcgtccctcagtgtccttcacaaaaccctcctgagccgggactcaccctgtgcccgcctggacttgggccaagcagcctggcccacatatcccaagaggttgcagtgctgggcagcaccccagggattcggtcacttctctgtcctcaccagaggcagctcttcatctgatgaagatgatttttttttttctatttttggagacagtcttgctttgtcgcccaggctggtgtgcagtggtgtgtcctcagctcactgcaacctccgctttccaggttaagaaatcctcctgcctcagcctcccgagtagctgggactacaggcatgcaccaccacgcctggctaatttttctggtatttttagcagagacagggtttcaccctgttggccaggctggtctcgaactcctgacctcggcctcccaaagtgccggggttacaggcgtgagccaccacacccagccctgaagctgaatttaagttttgggaacattcaaacccgttttggtgatgcccaggtgccttcgggtgcctcctaactggctgcccagcctctggctcccgcccagcctcctggaggcagccaacaccaaccctggtcactaactggactgcatcagaccccagaccaaacactggctttaccttctgagcctagactccttggccctctctggcatgcagaccctggctgtgggcttgcgcaggatggcactctcctttgtaacttgttccaaatgcagagctttaaaaacgccccttcccactgagccagcggctccacttttgagtgttagtgctgagaaaatgtcagagatgcacaatgatgtagctcaaatgtcactgggctgtttcaacttaaatacgcaatgacatgaacaatttatataagacatccatcccatggagtatggcgcagccatcaaactattgtgcataaaacatggtaatggcttagcaaggtgctcacaagctacaatgtaagtggggaaaacagacagaaaaagtgctcctattaggtcccaacttcccccttccccttctccctctttctttctctcttccctcctgtagttgcataaaaatatttcaaacatttggccgggtgcggtggctcacacctgcaatcccagcactttgggaggcccaggcaggtggatcacctgaggtcaggagttcgagaccagcctggttaacatggtgaaaccccgtttctactaaaaatacaaaaaattagccagatgtcatggcgggtgcctgtaatcccagctactcgggaggctgaggcaggagaatcgcttgaacctgggaagcggaggttgcagtgagccgagatcgcgccattgcgctccagcttgggcaacaagagcgaaactcttgtctaaaaaaaaaaaaaaatttttttcaaatatttataatggttgcctgtgaaccagattatgagtcttatgcaaattatttatattattctatattttccaacttgtataaaatgaacatattattttcatgaataggttgcctcctggggacccagaagaccagcttccaatgtgttccccagcagccgttccctccaccagggaggctgagtcactgacacagcagggagtacagcaatcccccttatcagtggtttcactttttcatggtttcagttacccacagtcgaccatggttcaaaaatatcagtacaataagttcagtaagtttgttttttgtttgtttgtttttagaaacaggatctcactctgttgcccaggctggtgtgcaatggcacaatctttggctcactgcagcccccacctcctaggcttaagtgatcctcccttctcacactcctgagtagctgggactacaggcacacgccaccatggccagctaattttacagtaagatattttgagagagaagagagaccatattcacaaaacttttattacattatattgtcatcattgtcctattttactattagttattgttgttaatctctcactgtgcctaatttataaattagactgtatcatagatatagatatatacatatacatataggaaagaacacattatatgtaggattcagtactctccgcgatttcaggcatccactgggggtcatggaatttgtccgctgtggataaggggacttatgtgtaaaggaatctccaacataaaggtgagttcacaatcagaactgccaagcatacgagcttcctactgcagctggaacagatcaccacaaatgtggtggcttcaacagcacaatttactctcccacagttctggggtgcagaaatccaaaataggcctcagtgggttagaatcaaggagtcggcagcgctggttcctctggaggccctaggagagaattggtttccttgtctttttcagcttccagaagccacctgcatccctcggctcatggccccctctccacctacaaagccagcagcagagcctctctccggcctgctcccactgcggcgtatctctctgaccctcttgcttccgttttcattttttccttttttaatgtattcccatcgttaagcacttgcttccatattataaggagtctgtgatgacattaggaccacctagataatccgagataatctcccatctccagagcctcaacttactcatatcatcagtgtcccttttggtcccatattcacaggtgccagggatcaggaccaggacatctttgggggccgttattcagctaccacaccaagcatggaagacagccaagacagaaaggaaacggcagcgcaaccgagggaaggagtcaccccactcccgcccctgggaaacataactgagaaagcaattaggagactccggaatgtgtgtagacatctcggcgagagccaggagaatgctgtgtgtgcagagagggatcagctggagaaagaaaaggaacagtacaaacatgaattcaaataaaacgccaccgtgaagggactgagtagcaaaatggatgaagatgaaaacattgacaggatgaagactgagcccaggaaggcgactccgcagattgtggacctagaaataaattgtcaaggaaaagctgagaaacacggaggtgagatccacaagtcgtcgtcgtagccatccagcaggctttccagaaggaggacagagagggaggagggcagagaggaggcaccacccacacacggacacacaggcgcacacagatgcacactcacacaccacacacacaccacacacatacacaccgcagacacacagatgcacacacacaccacagacaatcgcacagacacatacataccacacacatacagatgcacacagatgcacactcacaccctacacatacacacataccacagacaccctccccacataccacagacccacagatgcacacacacaccacagatacacacatcacacacacataccacacacacagatgcgcacagatgcctactcacacaccacccatacacacacacacaccagacacacacccccacagacccacagatgcacacacacacataccacacacacagatgcacacaccacacagatgcatactcacacaccacccatatacacacatacataccacacaaccccccccacatacacaccacacgtacacacagatgaacacacagacacatgcatcacacagaaagacacagatacacaagcacacacacagagagacacataccacacatacagatgaacacacacatacagatacacaagcaaacaccacacatacagatgaacagagatacacaagcatacacacacacagagacacataccacacaaacggatgaacacacacagatacacaagcacacacacagagatacacaccacacgtacacacagatgaacacacacacagatacacaagcacacacacagacacataccacacatacacagaaaacccagacatacacaaataccagagaccacccacctacacacgcacaccacacgtacacagaaaacacacataccacacatacccacacagaaaacacagacacaccacatagacacacacagacacagacacagacacacacaggaaaaatttccccaaattgaagagaaatgtaagttttcaggtgaaaaggggaaaacaaaatgttgacctgacacatgatagttagttttgaaaactttaatgataaagacaaatcttaaaacctgagaggggaattgtgtccccacaaaaaatatgttcaagtcccgcccccagcagctgggagtgtggcttgacttggaaatagtctttgcagatgtgatgaggttaatacgaggtcaccctggattaggatgggtcccatgaccagtgactgttatccttagacagagcgggagatttggacacagagacaccaggaggaggccacatggtgggagaggcggacgttggagccatgcagcaatgagccggggaccgccggggaccgctggcaggtgcccaagcgaggagacgggcatgcggctggccctgccctggaggcttcagaagagcacgtcctgccagcaccccgacttctggacttccagcctcaggaactgtgagagagtaagtgtgtgttgtcctaagccgccaggttcgtgtcaggaaactaatgcgggagggagggaggaggaggagggggagaggaaggctatgaggtaaagaaggaacacaaatcagattgacacgtacaactggagtataaagaccaatgggtgacagcttcaaatctatccgcagtcatcatctttcaagcatgagaggaattccaggcatttgcaaacccacccggactcagggagtttgcccccacaagcctgcttaagggaaggaatgacgggacaacactgtccacgagaaaacaaaaggccctggaatgaagccacacagcaggcagaggccagcaaagcatgcactggagtccacaggcgctgatcgtaaaccaaagagcgcagggcagccacgatccctgttatctgtgtctccttagccctctctccctcccaaaccctcctacaataacaggaaaggaattttaaaaacttccctctaaaggagaaaagcccacaagaaaaagaaaaaaagctggggaggagacaacagtagatgagagattttttttttttttttttggtgggagatcgagtctctctctgttgcccaggccgggcaaacctttgcctcctgggttcaagtgattctcctgcctaagcctcctgagtagctgggatgacaggtgtgtgccaccatgcccagctaatttttgtatttttagtagagatgggatttcaccacgttgcccaggctggcctcgaactcctgacctcaagtggtccacccacatcggcctcccaaagtgttgggattacaggtgtgagccaccgcacttggcaagatgagagattttgatgtcccccacattttagcccaaagctgaggagggtgactgacttagcaggtgtagctgtcagcctcggtggagctctgctgtggtaacaaacagccctggaatcccagtggctccggcagcccaggctgcttcctcacgcaggcacacgcctatcccagatgctctgctgctgtctcacaccccatcctcctcccactttaccccagaagccagcagccctccctgagacagagccgtcctgtgccggaaaggggcacagctcctcaaacgtctgctgggagggattgtcatcacctgcccatgccgcactggctgaggcacatcaggaggcccagccccaggcccacctgcaggacactgtcctcctcccacaggcgtggatgacgagcactgtgaccacagcatggatgaatggcggggctggggctgggagcccaggttgctatgggggacccacaccccttccctgcctcccacagccaggcccgatggcccttccaaagctgacaaaacaaggtcttctctggagaaactggatctaaggggttacagctgagggacacgggatggctaaggtctggggagaaggtggaggaggggctgcctcctgacttgtggcccctggaacccttcctgcactcggctcaggctgccattggctagacagggacccccaaccccaagcaggagacctcaggggccttcctgggagatgctgaactgcctggggaaaagacctccttttggggtccccgagaaagaagcaggccagcccccaggctctacctggacaccccacaaggagttgctagtcttgctcctcctatggaaaggcaggccttccccccaaaaaggaaggaccaaagcacacagaggagtacctgggggaaactgaggcacagcaaggagcagtgaaaatgccacctaccaaaaaggtccctaacatgacaatcctcagagagataagagatgacaccttggacccacagccaagccaatctggggaagaaaaaaaggtaaatgctttctcacattcacaaaaatggttctgaaaaccacttcaagctgggtgtggtggctcatgcctgtagtcccagctactcgggagactgaggcaagaggattgcttgagcccaggagcttgaggctgcagcgacctgtgatggcaccaatgcactttagccacggtgatagagcaagaccctgtctctaaaataaatacagaaacaaaataaaaataaaaaccacttcagttcccggctgggcacaatgactcacacctgtaatcccagcactttgggaggctgaggtgggtgaatcacctgaggtctggattttgagaccagcctggacaacatggtgaaaccccatctctactaaaaatacaaaaattagctgggtatggtggtgcacacctgtaatccagctacttggaggctgaggcaggagaattgcttgaacttgggaggcagagattgcagtgagctgagatcgcgccactgcactccagcctgggttgcagagatcccgtctcaaaaaaaataaagataaaaacaaaaaaaacacttcagttcctgagtcctgatatacgtcctttccaaataccacataaaagtaaaatgaggccaacatgaaacaccaaaacaacaaaacaccgagaaggtcaggacagagcctgggcgagcagtgcctggtctcggggcggggaagccccgttcaggccgaggctgcggaggatgggtacatttgactctgacaaaatgcgcaatctctgcacaggaagagaaagagtttgcagtgaaagtctggtgagaaatatctgtagcatttataaccaacaaaaaaaaaattcccagagaaatgggcaaattctctacctagagatcccaagagtccaatgagcaacagggggatgaaacacgcttggccttacaggtggcctgggatgtgcacagtacagccacctggtgtcaccattcatctgccggatcagcaatacttacagattttgtaatatcggccgggtgcggtggctcacgcctgtaatcccagcactttgggaggccgaggcgggtggatcacgacgtcaagagatggagaccatcctggccaacacggtgaaaccccgtctctactaaaaatacaaaaaattagccgggcgcagtggcgggcgtctgtaatcccagctactcgggaggctgaggcaggagaatggcatgaacccgggaggcggagcttgcagtgagccgagatagcaccactgcagcccagcctgggtgaaagagcgagactccgtctcaaaaaaaaaaaaaaaaaaaaaagattttgtaatatcaaggggttggcaggttgctgccagagggggtaggttccagccggggcagctctatccacagtggaagaggatgtggctggcctggctgagcctggacatgaggctgcatcaggaccccctggcctggctgaagcccactcttccagaccctgccagggagggaagggggtcggtgcatggggggtgctaaaagcaggagactgtggcccctgcttggcctgtggtcacttgcccttgcctggctgccaggctagtggacaaactctccagccgtgcgggttcccggctgtttacttagcactcatctgagtttatacaaaacccttctggtccaagctctgatccttcattagtaagaggaatgagcttctgggaaaagtgaatggggaggggctgtttgctcagggagccatctgggcaaatggggcaacaggcccacaggccttggcacagaaagtgtatggtgcccccttggtcaggtacatcccatctgatcatctgtcaccacagatcccggcatgagcagcagaccaggggcgcgtccccccttccagatggggaagggggtccaggcagcttgtgggaggagagcctccagcccagggagctcctgtccctctgtctctgcaccacacacctctcccgagggggcaacccgggtcacctgccctgacagcagctctcacgggacctcgttcagcccgtgcaaactgtaggggttattgtgcagtgctgcgcctcctggggtgcaaacagtccctggctttctgcccatggtgggatggggtgcttgcagaagcacccaagggaccctccctggaactggcccactgcagactctgcccatcacctcgaagcctctccttggagggttctgatctggaaaccagggcaatgacctcatccaggggcctgggccaagccgagagggtttgcaaattgatgcccacttaaccactttattagcttctgctgctggtcctcttaaaacatctccagggcttgaggatgctataaatttttggtcaaggatcctctggcagcctcactatgccagcatcggtcacatggcccagccctagacctcccagagagaggccggggcctgggggtgccttttctggaggcgcagatcatacattcccttccttctagaagcagcgtgaggctgcttttctgtgactcggaaccagcgcaccccatcgctcactgcaggtaggaagcatttcgttgcttcatgaagaagtagacattctgggccacgagacagaaggggaaggaaggactccgaggtttagaataagctggtctcactgccgcagatgacttggggggacccactaagggggtggggggcacaatagcagcagcccctgctgttggctgagtccactcagggctcaccacagcccatctgcctcccaggcacagggaaaccccccacgggaggtggggagacctcaggggggtccctccgcccaggaggaaggcttgcgctggccaagtgaaaacacaggaatctcattttagttctagtgggaaggttcgaccgcagcgagggtgggctgggatggtggaggtgtcttgccgcccacttcctgccctgcccacccagtattcacctcggccacttgaacctggagtgggggtgacccgtggggtggggtggggggcgttctctgaggaaacgccgggtggcagagtttgaagatgggggaagaatgttccaggaagaaggaaagtaatcttcgaggagcgggagaggaggctgcagaggcaggaggggctctggtctcactgagggtgctggggctgtccggaaggaggtggcgcggctgggacggggtggcaatggcgaagcagccaggcagctgctacctcaggagcattttgaaaggagaacgagaggtgtggcccacccacaagcggctccctccatgcagcctgggtcaccccatgcacaggaactggccaatgagaatgtcctggccccaccagagacaccaggctctgatccaactcagaatgcgggactccctcagagcgctgcagcctgtctcttgcacccgcagcacgccctgcactccagaggcttcctgcgagccgcttgtgttcggccccacccagtccctctggcctctccacgccgcgccatgccggtccacaccctgtccggcccactcataccatccacgcccctgcacatactgacagctcagtaccccttaggggctgggctcagaacagaccctctaaagaatgaggccggagtggtagggccaggcaggacccacctatgcctgaggctgccgccgctgctgaaccctccgttccccgcccccgtctcctgtgtctccttcgtgtctttttccctgcaagtatgtactttcccctgcaatgccagcgcgttcagaaactcacattccacttttaaacgctgacacccatgacaagctcttcctcaacggcaagcagcaagcccagcttataaaggacaagcggttcggtcaccttccagcccatcagggatcaccactgggaagaagccatggctccgtgggcctttgtgggcaggtactgccctcctcagaggcagcctgcagtgaccgggaggtgacggaggggtgccagcctggggcacgtgcagacacacactacccagcagaaagattccgggcggctcgccacacaaccctctgcctggttttgcaaaaaaaggaccatctgaaggccaccgggtagtgggtggagaggccagtccagagtgaggtggccggcacaaagtccaaggactctgctgccaccgacccccgtggcctgcaggctgaacgcccgcccagtcccacccacccccggcatggcatccccagtgtacctgagactgggttatttatttatttattctgagatggagtttcacccttgtagcccaggctgcagtgcagtggcacgatctcagctcactgcaacctccgcctcctgggttcaagcaattctcctgcctcagcctccggagcagctgggattacaggtgcccgctaccacacccagctaattttttgtatttttagtagagacggggtttcaccatgttggccagggtggtctccaactcctgacttcaggtgatccacccgcctcagcctcccaaagtgctgggattacaggtgtgagccaccgcatccagccgagactgggtaatttataaagaaaagagatttaattggctcacggttccacaggctgtacaggaagcatggctgggaggcctcaggaaacttacaatcatggcggagggcgaagaggaaagagacgtgtcttacgaggcggaaggaggaagagagtgaagcggaaggtgccacacgcttttaaagaggcagatctcgtgagaactcactcactatcacgagcactgcaaatcagcccccatcatccaatcatctcccaccaggcccctcccccaacactggggtttacaatttgacgggagatttgagctgggacacagatccaagctgtatcacccacacaactcacttcagggtctagcgttgccaagggcaacggggtagagtggcctctaccccaaggggtacccctcagtgagggaagtcactggagacagggaggggggctctggaagccttccaagaccggcagacctccctccccactccatgctaggggtagagtctcagatctgcctcagacccactgggcaaaggaaatggatgacagatctactcacagcatctgagatttgcagccggccagggcaggtggctgcacagaggaaggtgccctgcttctggggggcaccacacatttgtcaccgtgggagggagggctcagctcagtctccaaggcggcacaaggccacagcagccttccaggaggacaaccaggatgctcccgttctgtgccgtcaggggctggctctgtatggcagggcctgagccaaggaggagagaggaccagggtgggggaggcaagcagccgtcacatgagagatgagatagagaggagccatgaggaggtgaatggctaggctgggagaatcccaagcctgagggctggcttgaatttgcaatgttgaatgtgggcatcactgggttatggacccctctgcgccccactctgtgaccacacagcagccttgagtgagcaggctcttatggaaatccagcatcctccaggtcacattccacaggagctgatgggggcccacccgcttccacaccatccagggccaggtatgagacccaggcctgactgcttaacaccttccccatgtccagccacagctggcttggaaatggacagagtacagaagctgcccaccccaagggatctcccagagctacctggacagcccgacttttttccactggcaaagcctgaacttgtgaggtatatacagggagctgtgggctttatcctgcaattacaccaggacagtctgtctgagagtggagccatcacaggggagcacagatggaaagagactcctggatccagctatgcctgaaaccaaccgacctctctctggtcacacaaatcaacaaactgccctgtgcttaagccagtctggtgggctggtatcagcgctcagaagcccactcaccaaccagggaccgagttccatgctaggtcaacactggggcagagagaggagtcagttgcatggcaagagtggatgtaagagttctgcagagacagaaaatcagggccaaaggtgaccggagaaatgtaggctcccaagaagtcaaagcactcttgggaaattgagggctgggactgggcctcctccaggtctcagtggacaggaagacctcagctaactccagcatgacccaagttttttaaggtctgaataagggtttgcggtctaggtactccagattgcttaatctcctcatctgctctctttttaaaatttgttttagaaacccgtctttgctaagttgcccaggctgagtgcagtggctattcacaggcactacagccctgaactcctgggctcaagcaatcctcttgcttcagtctcccaaggagctgggactactagtgcggtgtcaccatgctgggcttgatctcttcataaacactgaggtcatttttttttttttttgagacaaagtctcgttctgttgcccaggctggagtgcagtggcatgagctcggctcaccgcaacctccgactcctgggttcaagcaattctcctgtctcagcctcccgagtagctgggattacagacatgcgccaccacgcctggctaattttttgtatttttagtagaaacggagtctcaccttgttggtcaagctggtctcgaactcctaacctcaggtgatccacatgcctcagcctcccaaagtgctgggattacaggcatgagccaccacgcctggcacacttaggtcattttcagttccttactgctagcaatgttccatattgaacatccagagacacagctttacctggtttctgcagctcctgggatgcagaacatgtctatcaattatgcccagtggcccactacccccatgtcagagcccaggagacggctccaacaggagacaggaagcaggaagtatgagttcattctgcacaggaggaaactgagcctgtgaatggggcaggaagttgcctgaggctacacagcgggaaggttgcaggtgtgagcttcctggtctcctgcctgcaagtacaggctcttcccctgacagaggtacttcaggaaccatggagttagaccccaaggtttacagtctggccatgcccagtcttgcagtgactccttgggcgagatcttttccctctctgcatttctgtaatgctatctacagggaatcccaaacctgactgctcttcagaaatctgaggcgcacactgtccaaggagctctagactctacattaaagagttcattaaaatgcaccctcagattttactgtactacagcttttctgaaaaagcagctaacaatgactgagcacttactacatgacatggattaagaattcagtcctcccaggctgggcgctgtggcttacgcctataatcccagaactttgtgatgccaaggcaggtagatcacgaggtcaagagatcgagaccatcctggccaacatggtgaaaccccctctctaccaaaaatacaaacaattagccgggcgtggtgtcaggtgcctgtagtcccagctactcgggaggctgaggcaggagaatcgctggagcccaggaggcggggttgcagtgagccgagtttacgccattgcactccagcctggcaacagagcgagactccgtctcaaaaaaaaaaaaaaaaaaaaagaattcagtcctctcaacaatcctaggaggtaggtattattattcttcctacttcccagacaggaaagtcatagcagatagaagttccatagctttcctagcttctggtaatgttcctgacaggtttcggtattaaaattacattgacctcataaaatgagttgggaaatactccctcatttttagtctctgtgcaggtttgtatgagactggtggtatttttttaactgttgagaagaatttctcaatgaaaccatctgaacctagaattttctttgtgggaagattttaaattacagattcaatgcatttaattggtgtaggactatccagattttctatttcttttagtgtcagttttggtaagttgtgtatcatctaaaatttcaaatgcactgtcaaaaagtcctccatactatctttttatccctttaatgcttgtagtatctacagtgatgtcctctttttcattcttgatagtgaaatttgtgttatcttttttcttactcaatctttctggggatttatcagttctattaatctcttcaaagaaccaatttttggctttgttgattttctctattttttgctttattccattaatttctgctcttatttttattatttcctttcatctttagttttattgttcttttctagcttcttgagtggaagcttagagcagtaattttatttttctttttccttttttttttttttttttgagatggaatcacactctgttgtccaggctggagtgcaggtgggatgatctctgctcactgcaaccttcgcctcccaggttcaagcaattctcctgcctcagcctccttagtagctgggattacagacacctgccaccacacccaactcattttttgtatctctagtagagacggggttttcaccattttgacccggctggtctcaaactcctgagctcaggtgatctgcccacctaggcctcccaaaatgctgggattacaggtctgagtcatttcacctggcctaattttcaatccttcttctaaagctatcaaatttcctctaagcagtgttttagttgcactgtacagcatttgatatgtcttatttttcactgttcttgtcaacatattttaatcttccactgtgattattgacccattgattatttagaagtgtgacatgtaatttccaagcatttgcagattttccagtaatttttctgttattgacttttaattcagagaggacacactgtaagatttcaatccgttgagatttgctgagacttgtataaggtccatgatatggtctatttcgataaacatcctatgtgcacatgggaagaataagtattttatagtgttgtacacacgtgaattaggccaagttggttaatcctattgttcaaactgtgtgaggttgattcaaggataaagaaataaaccagtgggatagagttccgagacacacacacacacacacacacactcttcagctgatttatgttgagatgttggggactcctccaattcggtggaaaaaaaatgatgcttttcaataaatgatgccaggtcaattggatatctacacgaaaaaaaatgagctctagccccgtaccacaccattcacaataattaatatgtaatcaatcatagatctaaatatgagccctaaaacaagcttctaaaaggaaatacaggaggatatcccaataaaaaggtactaaccataaagaaaatattgataaattggacatcactaagagtaactcctgttcatccaaagcaaaagtaaaccacaaaatagaggaagatatttgcaataacttcaataaatgcgaatccaataatccatctacaatacaaagggcatgcgtccggaccaagaacacgtctccagactctggaaagaacctctacgaacgaagaagacaacccaattttcaaatggaccccggggaacacccaggcggctggggctggctctaggtccccactgctctgccttgcgggggccgctccggcctggtcgccttctccgggcgcatccagggaactcgctcggtcctccttaagcggggaagctcggaaagcgtctccccgactccgcccccagggttgcctttcccttagaaggccaagccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggtgagcgcggcgggcgtggcgtccgtgccggggtgcccggggtgccacgggaacggcgaggccggggacacgcgcgcaggacgccagcggcggaggtgggcggccccgggccggggcggggagggccgggtcctggcagtcgccgtgggggacgcgctgggctgtgccctccgcccccgccgcccacgcactcgtcttcgagggcgggcccggcggccccggagcaaaccgccgtctccccgcggccccaccggtccctggcagcctcggggaatgtctgtagctgaattcgggctctgaaagaaggtggcgctgggtttttaaagatttggggcacaaaaaacgagagcggacccggcgccggctacggcccttcccgagggccacgcccagcccggcgccccgcgcgccccgttccccgcgccgcctccctccacccggctgagcgcttgtgcccgcaggtgcggcgccccccacccgcgtcgccgccatggaggtgctgcggcgctcctcggtcttcgccgccgagatcatggacgcctttgaccgctcgcccacagacaaggagctggtggcccaggccaaggcgctgggccgggagtacgtgcacgcgcggctgctgcgcgccggcctctcctggagcgcgcccgagcgtgccgcgccggtcccgggacgcctggctgaggtgtgcgcggtgctgctgcgcctgggtgagtgcgccctggtgggatccccagctgcgcctcctcccctgctgggccgcagcctccctccgaggccgagatgggggtccggcccaggggcgcccaccccctgcctgggacggccaggcgctcgggacagggccacccaggcgggtgctcccggatctgccctctcaggcctcccacgccacaggcccccccatcagctgcctgctcagcccagatttcagtcatgctggccataaacaatagaaagctccagaaagaataatctattagtgggtggctaagcttccacagtgacccttgttctcagctgggcacagaaaccctttgtaggagcacgtgtcccgatgtttattttggaaaacagattcttgctgttactggccgagatcccgcccgctgccctctggattccgaggcctccgaggcccccccattggaaactgcgcccaccgggctgggtagccaaaacctcagtattcgttggtgctgtgaggacatctgggggtgctcggttctggggtcacacacggtccactggctgcccccaccgtctccaaggtctggacccaagagggagggaccagccccactgtgactgtccagtcccctcaccacagctgggctgtggccgtcacctgggaatgtttatgtgatgcccgaagagggcacatggggcgcctgtggctgagcccgggaaggggaggtgacagcataggtgaaactgaatcggtggctctccaggcagggggttggagtcggagggcacgaccccgtgaggggacacgctgcctcctctcaggctggcgctggcatgggctctaggtggcccctgcccttacgtggtgggctgggcccagagagcaaagctgtgtagacctggcctgcccaggagtgtgtgtggggtgcagacagaatccatggggaccagcacagagcctccaggaggaggtggagtcccatctgagaagttcagaaggagggagaggtctctgggtgggagctagggggttggtggggctccatgagatccgccgcctgctgctgcctctagtcgggctctgagaatgaccctaggggatccttttagtggccttctgaaaagatgatgccagacccctggaatggctgggaagaagtcccagatgtctagggggaccccagagggacacagctcagacctgcatctgccctcacggctgctcagggtcagtcccttgaggccagcgctgtctccctgcccttgggcagtgcagacaggaagaagcccgggttgtgtccccaccttcagtctggggccagcctgcagcagccccggagatctgtgtttgggagctgccgggtcagtcctgggaatttccatgtcgtcccccgcccccagccagcctctcatgggctctgctctgcttccagatcttaattaatgagatacagagcagcctttatcagctgggatggtccggtcagcagcattaccctgtttgctttggctggagaactggccgggctgcggactcccaatcccagggccctgtggcattctcggcaccatctgccccgtgcctgtgcgctgctgctgccaagggtgccacaggcagcactggggcggtgggcctgtaggggccatcctcggctgccaggggcagggctgatgcagtgccacctccaagcacatccccttggcagcaagagcccaggtgggagcgtggcagtgagggtggcccaggacagcggcccagccagcccaggtgggagcgtggcagtgcgggtggcccaggacaggggcccagccagcccaggtgggagcgtggcagtgcgggtggcccaggacagcggcccagccagcccaggtgggagcgtggcagtgcgggtggcccaggacaggggcccagccagcccaggtgggagcgtggcagtgcgggtggcccaggacagcggcccagccagcccaggtgggagcgtggcagtgcgggtggcccaggacaggggcccagccagcccaggtgggagcgtggcagtgcgggtggcccaggacagcggcccagccagcccaggtgggagcgtggcagtgcgggtggcccaggacagcggctcagcctctgcatctgagtggtccctgagccatgctagggcctgagccgggctctcgggctgtcccctgctctcaccccaatgctttctctgcccagcccctccccacgtcgggctcccctgctctcaccccagtgctttctctgcccagcccctccccacgtcggggtctggccgtctgcctggtccctcctgctctgggcagctcggctgcctgtcggctgtgagtcaccagcaggcacggcccacgctctcgcaggattcccgccccaccggcttggccggctaggcttaggggctggctcgtcagaggggcgggactgggggcgccttcagtacttccttggtcttctggtccctaggggccaaggttgggggatggcccaagggaggtcagatggggtcaagtggaggtgggaatcagacaagtgaggaacaggctggaattcaagcatggtcaggtgggggtcaggtgcagggtgtgccccaagccagtcgtgtcccaggaagctgggacgtgggctgcctctcacctgctcttgtgaccacacaggcgatgagctggagatgatccggcccagcgtctaccgcaacgtggcgcgtcagctgcacatctccctgcagtctgagcctgtggtgaccgatgcgttcctggccgtggctggccacatcttctctgcaggtatgcccagcctgcccgtcccatgggacctcagggagggatccagggtctgtggctcaggctcacagggaccccacgagctggcccccacccatcctggcgctgcccagtgcccaccggtgccatctcactgctgcaggtgtcaggagctgcccagccaccagcgtgggctcaaaccacagcattcagggtctcttgtggttctgcaggctggtgggcatgctgagcagctggcacaggcttcttgattggttgtagttgtggtccagcatccgtggggccgcgtgacctgcagtcctgtggggtggcacgtcctagggctgcctggtttcctgcaggggcccccgagcggggcttgggcttctcacagcatggtgctgtgtcccaaggaggagtggcaaggagcaggtttcccagacagctcccgagtagatgctgccaggctgttaggatataccctcagaagtcacgggtaactctgctggattctgatggtcagaagcgagcctcagggctccagcgtccaggagaggggagagcatgggggtccaagcagactggctcccggagggcatccggagaacagcagcgcatctcacctggctgtgcctgcctcacctgtgaccctcctgtgcgctcccatctctgccctggagaggcatctcctggccctgcctccctgctcctgctgctcccggctgtccacatgcttctaggcccacgggaggcttagggcttgtctcccctactcggtgcccgctgtccacttgtccagctgccttggcctggatttgcccagtgtggcttctgtccgcttgccccatgtcatcaggtctggccctgcagacctcagccccctgcctttgacctctgtgaccttgggtcctgtcctggcaccccgtgctatgagctgcccctgggtgtggcaggcgctgggtgctgctgttggggtgagtggtgcgccggccctgatgtggcacctccctgattggcacattcctcagctgttttccaagtgctgtccaggtgctgggcacagctctgggccagtgaaccccggggtgcgcaggattccctgaagcttggaggaggggcatgctgttcccctggggcagttttttggaagacccctgacagcagggaggccttgcacacccttgtctgggagctggtgtgggtccgtggccagtcagctgtgtgactgtggcctgctgtcatctctgtggcctcagctgccttgtctccaggcagtcctgacagcagcaggagccaggcatcaggcgccagaggaagccacaccctcgctgtgggagatgcatcccacgccacggggtgaccctcagagccaggggtcttcagatggcctcgggacctccacccaccggagggcaaggggaagaggccaggagtgtgaggaccactgcctctcgctcaggcagaccccacctttgtggggtgtcctccagctcctctcccagacgtctcctccgacccctggtgggccagccagatggggacagagcggggctgacaccctcggctggaggccaaggcggcgggggctgcgagcattttctgacagaatccggcctctccagtgccacgcttgctcactgctgacctccctggacagaagttactgtggctgggatgcagcggcgacctggcaggctgctggagcgggaaggctgagtccagggatgggagtccaggcggggtctggtcctgcctccgggcttgtcttgttgccacagcatgtgctggagtgcctcagaccacacctggggaggggcagtgacctcaggctgtggtgtggggtcaggaggcggaaccaagctgggtgcgggcgagactccctgtctggcgctcctggggtggcctcagagcctggactctgtcactgctcctgtgttcctttgggagatcgtaaatgaatcctcattggcagtttggctccaaggcccccacgtggcagctgagggtggggggccgggcccaggccaggctgaggcgtgtcatggggcagacctgagtcggctgggggtgcatatgggtaggggctggggagtgggcaggtggtgtggctcaggggccgggtgggcagggggcagggttcacggcacagtgggcagcggaagcatggtggcaggagctggcaagctggtgcccgcccctcctgccgccagggtgacccaggcaggcacggggcaggcagtgggtggggccccggaaggaagccaggggtggaaggcatcctgggctgacgaccactctcagccctcccttggccgacgccggcgcgtgggtggccacccgggtgtctgtctcggggccgctgggtttacgagctgcaggctggctttaaaaggaacagtcatttctgagaatgcagcagcctgcccagaggtggggcgcctcccccttcggcagggagagaggatggggccaggatgcccctacccgcccggccttgcttgagcagggcctggcctgaggtgggggcggtgcctaggaaggctctggttggttctgggagggcacctgggggccagggagggctgaggggaaggggatggctggacgagcgggcacacagctgacggggaatgtgggcggcaccggccaggtggcccgggctatgtgtagagttcagtttaagtcttgttttcactggaaaaccggagcccactcccctgtggtcagcatcccccaccccacccagcgccccaggcttgtcccacgcaggcccggctctggccatgtggcagcccccacacccccacctgctgctactctgaggcggccctgcccgaggggagccacgcaggttgaagcccaagagcctcgtgacctgcaacgggtttctgaacctccctgaaccagagccacctgactagggagctagggcagggccgccccttctgcccctcaggcccactggcagttgcacccccagcccccttcacctttgtccatcccagtcctcttgggcccttttgtctacagggcgagcctccagcctccaagtgctttacacatccttgcctccctgcctgaggcccctcccacgccagccatccctgcacgctctgacccccggtcttcctccctctcctcctcttagcaggcgcccttgagggtgtgcgccctgcccagcccctccactgcaggcaagctgcacagcccgcacctcagggctggggccttggctagtgttgtgagccgtgtgagggctgcagggcagggctccgtgggggtctccaagtctccagccccaggagactcccacgaaggcagaggccaacaaatgttgtttctggctgttttcatttagggcttcaaagttcctgctcaggactttggaaaaactcatctccaaagtggtagaactcaattttcctccccatttaaaagttggcaatagtgtttatttttttctttgaatttgaattgtattttctataaatacatatgtaattttatataattcttctaattatagttttattataagaaaaataaaaatggctgggtgcagtgactcacgcctgtaatcccagcactttgggaggccgaggtgggtggatcacctgaggtcgggagtttgagaccagcctgaccaaaaagaagaaaccctgtctctaataaaaatacaaaattggccaggtttggtggcacatgcctgtaatctcagctactcgggaggctgagacaggagaatcgcttgaacccgggaggcgcaggttgcggtgagccgagattgtgccactgctctccagcctgggtgacagaggcagaccctattctttcttttttttcttttttcttttttttttttgagatggagtttcactcttgttgcccaggctggaggtgcaatggtgcgatctcggctcactgcaacctccatttcctgggttcaagcagttctcctgcctcagcctctcgagtagctgggattacaggtatgtgccaccacgcctagctaatttttgtattgttagtattatttatattattagcagacagagtttcaccatgtcaaccaggctggtctcgaactcctgacctcaggtgatccacccacttcggcctcccacagtgctgggaaaaaacacaaatcagaccatgtcacttccctgcataaagttctcgtgttgctgtgacttcccgtgtctttcaaagtaaacctaagtttgaattcccagctgagctggcccctggcagactccagcccttttcctgccacctcaacctgtgaaatacgccagacacaaaatgaacaagccgtgtgattacacttatgtgaaattttcagggtaggtaaatctacagagacagaaagtaagatgagtggctgccaggggctgtcggtgaaatagggagtgactgctagtgggcatggggtttctcgtgggatgatgaaaatgttctagaattagatagaggtgatggttgcacagctttgtgaatatgctcaaagatatcccacttttaaaagattaattttatggtaatggaattatatcagttaaaaagacacagaagagctggaaggacacagtggacgccgaggctggtgcctccggactcctgtcttcctgtctttctttcccatccacccctctggagtggaaatgttgccatcactcggaacatagtatgttcttttttttttttttaatttttgctcttttgccgaggctggaatgaagagttgtgatcttgcaacctccgccacccgggttcaagcgattctcctgcttcaccctcctgagtagctgggattacaggcacccgccaccatgcttggctaatgtttgtatttttagtagagatggggtttcaccatgttggccaggctgatcttgaactcctgacctcaggtgatccgtctgcctcagcctccccaagtgctaggattataggcatgagccaccgcacccagcgtggaatgcactgttctgatggaaccggacacctcagaacaggttgtcccgcaagccacacgcagtgctgacatcaggctccgctccccgcatggccgtgcccttgaaggaggaacagccccacgtgctggggaagtgcagcgggtagagcaggggctgtgccgggtgtgcgcatcccaccaatgacaagggcaccttcgaggttggggtggcaggaaaagggctggagtctgccaggggccagctcagctgggaattcaaacttgggtttactttgaaggacacgggaagtcacagcaacacgagagctttatgcaggggagtgacatggtctgagttgtgtttttccccatttcttttaattgacgttaaactcacatgacataattatccacttaaaagtgtgcaattcagcagcatctgccacattcccagtgtggagcagccaccagctactagtctcaggaggtctttatcaccccagaatgcctgtgcccgtggccgccaccgccattccccacccctcgcccactgccagccgtgagcctgcgtcccagctctgtccctgactgttgtggacattttgcatccacggactcacactgtatgtggctttttatgcctggcagcttccacccaagcatgtgtttttgaggcccatccatgcccagcctgcctcagagccccatgccttcttttatttatttattatttatttattttttcactctattgcccaggctagagtgcaatggcgtgatctcggctcactgcaagctccgcctcctgggttcacaccattctcctgcctcagcctcccgagtagctgggactacaggcaccagccgccatgcccggctaattttttgtgtttttagtagagatggggtttcaccgttttagccaggatggtttcgatctcctgacctcgtgatccacctgcctcggcctcccaaaatgctgggattacaggcgtgagccaccgcgcccagccatttatttatttttttgagatagaatcttgctctgtctcccaggctggagtacagtggtgcgatctgggctcactgaaacctccacctcctgggttcaagtgattgccctgcctcagcctcccgagtagctgggattacaggcgcccaccaccatatccggctaatttttgtatttttagtagagatggggtttcaccatgttggccgggctggtcttgaactcctgacctcaggtgatctgcccacctcggccttccaaggtgctgggattataggcgtgagccactgtgcccagcctgccttctgtggctgagtaacatccaccacatttgtatccatttatctgttgaaggatacttgggttctttccaccttttggcaattgtgaattggctgctgtgaatgtctgtgactgagtgtttgtttgagctgatttatgttttcataacaaatccaggttggccgctgtatgagggtggattggagagcagtgcttcatctttgcatgtacagtgtcctcaggctaactccctccagggaccactgctgactccctccggggaccgctgctaactccctgcggggatcactgctgggctgcatgttttgtggccattcagatactgccagtgccctcaagctgggcttcccaccaaggtttacaaggctgtgcagtggcctgaatcctcacactgccatttaaaagcatgtatttatttatttatttagagacggggtctcgctctgtcgcccaggctggagtgtactggcgcgatctcagctcactgcaacctccgcctccccgggttcaagtgattctcctgcttcagcctcccgagtagctgggattataggcgcgtgccaccacgcctggctaattttttgtgtatttttagtagagacggtttcaccatgttggtcaggctgctcttgaactcccaaccttgtgatctgcccgcctcggcctcccaaagtgctgggattccaggcgtgagccaccgcgcctggcgtaaaagcttttaatgcaacagattacattttgttttaatttgcctttctttggttattaatgaaggtaaacatttttcgtgtctcttattataattttcttttgtgaatcagctgttccagttctgtgctcatagttcttttttgaaagcctctcttttctcgctcacgtataagacgtctttccgtgttgaggcgtcgtgtcctgccttttattctttcccccgctgtcaccatctttcgtcctctctttcaaggctgctcccatctcagttcagcctcagcaggttaggggtctggggaaggcagtttctctgcgggcctcagcttctttatgtgtaaaatgtggacgccaggcctgttgtgggaacaggcagcccaggggtgccacccgtgaggtcactggctgctcactccatctgctgctgccctcagttccctcgcctcaccccacgttgtccctgcggcctcctgcacagacgtgggctgggcaggtgtgcagtggaggccgagaaacctgcctgcccaagaactacctgacaggcatcctgtcagggagcggtccccccttgggacggtccctggtcattagctggacggcaagcaggacagcggctcagagaggcccagccccttccttaagtgctcccgtgggcgggattcaagtcctgatcttgaccatctctctccctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatgggtgagcgcctgagtgcccgtgtgggtgggagagctggggtgcgagggtgcagaggtacaggagggagtggtggatgggtgagcctctgagcgcctggggggtgggagagctggggtgcgagggtacagacgtacgggagggagtggcggatgggtgagtgtctgagcgcctggggggtgggagagctggggtgcgagggtgcagaggtacgggagggagtggcggatgggtgagcctctgagcgcctggggggtgggagagctggggtgcgagggtacagacgtacgggagggagtggcggatgggtgagtgtctgagcgcctgtgggggtgggagagctggggtgcgagggtgcagaggtacaggagggagtggtggatgggtgagcctctgagcgcctggggggtgggagagctggggtgcgagggtacagacgtacgggagggagtggcggatgggtgagtgtctgagcgcctgtgggggtgggagagctggggtgcgagggtgcagaggtacaggagggagtggtggatgggtgagcctctgagcgcctggggggtgggagagctggggtgcgagggtacagacgtacgggagggagtggcggatgggtgagtgtctgagcgcctgtgggggtgggagagctggggtgcgagggtgcagaggtacaggagggagtggcggatgggtgagtgtctgagcgcctgtgggggtgggagagctggggtgcgagggtgcagaggtacgggagggagtggcggatgggtggtcacctgagcactcctgggggagatgggtgaggcagggggtggggcaagggccgagacctacaggcaggccctggactctcctctgcccagatccagcactgacttacccccgatcctacccctgtgctaaggacccgctgccccagcccccgccctcccgagtgggaaaagcaaggccccgaggggtgggtgtcagagccaaacccttcctctgtctccacgcccccaacttcctgccctgctccggccagaccgcagttgccgctgggccctgggtgtggagggtggctcccctgccgagagtctagccttctttcctgtacagcgggtgttggcctggtgtgtaaatcagcggccaggggtgacagcgctcagacccctctgctggggccttagctttagcatctcgagagattgaggtcacgtggtctgcgggggctgtggtctcctctgaaggctgaattgggggtgcagagggcaatgtcccaagatgtcgcacatggctacaggtgtccctcagcacagaaaccccaagacttccgtcccctcctgtcttcctcctgtggagtctggcatggggctgggcactgtgtgcccagtgggcgacgacactttgagcaacgccaaggccacaggtccaggctgcagggaaaagccttcatgtattagcaggaagtgaagggaataagagaattggacgttcattcacttccccagaaggaacttcagagtccagggagtccgtgggcttccggaaacgcagtccctgctgttgttccaggcagagtctgaatgaagctgggtttgccccttcctggtagcccaggctccaaggccccacaggaggatgacggcggcatacctgtagcccctggggggcagcaggcaggtggccgaggggagctggcaccctggtctggatgtctggagccccagcgagggccatgaaggcctctctcctgctcggcaggggccctccggccggcctgcctggctgccatctgtccccacctcccgtgcctcctggcccttcacactgtctgaatgtgcacggcatcgggtctggtcttgtgttggagccttcagtccaggccacagacctccttcccgaacagtctcctgcattcccttcatgcaattttgctgatattctggtgcacggtgctggggggcctggcggtgctgggggcctggcggtgctggctctgctttctaacggtctccctcttccctcccagactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccagaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctgctctcacctgagcccccggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttagacagaatgtcactgtgtgtgtgttaaatagcttctacctatacacaacatggtaagaggtgcggagggtttgcttgaaaataattgagggtggggagtggcgagagggtggggatgggagggttcctggaattgggtctttatcctgattagatgtaaaggcactaatgctgatttccagtagtaaaaagaacaccgatagtccatagtgtgatgtggcaatagaggtatgcatagtatcaccactgggtgctcctaattaaatacttgcagaaggcagggttctcggtggcttttgaacactttcatcaaactagagtataatgggccaggaccagtagctcacacctgtcatcccagcactttgggaggcaggaggatggcttgaggccaggagttcaagaccagcctaggcaacataacaagatcccatctctaaaaaataaaattagtcaagcacggtggcctgcacctgtggttccagctactctggaggctgaggtgggaggattggttgaatctgagaggttgacgctgcagttagctgtgattgtaccactgtactccggcctgggtaacacagtgagaccctgtctcaaaaaaaaaaagccgtgtgtggtggctcacgcctataatcccagcactttgggaggcctgaggcgggcagatcacctgaggtcaggagttcaagaccaccttggccaacatggcaaaaccccaactcttctaaaaatacagaaattagccaagtgtggtggcaggcacctgtaatcccagctactcgggaggctgaggcaggagaattacttgcacctgggaggcagaggttgcagtgagctgggattgccccactgcattccagcctgggctacagagtgagactccatctcagaaaaagtatcatgggagtgagctcaggattcagattcccagctgaagtgtcacatgaataatctgaaagttatgactgtcccaagagagactcttacctcctttagctgcgggtctgagactactgaaaatcaaacccagaatctcgcccttccagtggctggattatagcacatgtggaactcccagcctcacggtgtctgctgtgcaaatgaaggcattggttaggaaggaatgggatcctgtcagttgggatgaggatgtgtggggtgaccctgatgaacagtgaagacaacccctaaatcctgatgagtcttcagtggaagaggccttcctaaccctagtggtagcctccccaactccatctgagtgggttaaccctgtactgcctgaggaaatgggactgccctgaggctgctgactagcaggaccaagctgctgcttcccaggatctgcccccacccctctttgcttctagacatggaactagactgatgttgggcagcccctagagatacagggcgtgaccatgaggagatgcacttaccaaagagaacgtgagttttccagtttacatagaaatcccaggaccgtgggaatgcatattgagggcctgggagaatggtaggaggaacacagagttagatcaggccaagtttattgatacgggctcactaagcagagattccgcatttagaaagggctctaattggttggttggctgcttggctgaaacatgggccaaaacatggcccaccatgggataactggacatgcctggccgcccatggttagtgtagaagaagggattcaaaggcttagggagattggaatgctagagtggatttgtctgccccatgctgctttcgttcccctgctagagtggatttgtcctccctattctcctcttcctcctcctctgcagccctccactaccctcctcctacatccctcctcctcctccagtcctcctccctctccccttcccctgcaactctccaccactctccttctcccactgcagttctcttttctttgtagccctcctcctcctcccctgccagctctcctccccctcccctgcaatactcctcctccccttgcagccttcctccctctcctcctcccgctgcagccctccaccctccttccctgcagctctactcttttctttgtagccctcctccttatccagccctccacccctcccctggcagccctactccctccccttcctcctcctgtctgcagccttcaactccctcctcctcctatacttctctccctcatcttccctcaggacccagccctaatgccagcaccccaagccttcgctgacccttagcagggaagctcccgactgggtgcacgcggccgtgcccaggaactctggttcgggcctgctgcagggctcgtttgcctctccagcggtggctctcaggtgctgcggtgccgtggccaaggagccacacaagaaggcccacgacctgtgtccctcagctttgtgcatctgcttctccgggacggggcccccttgagggcaggcctggtggaccaccctgtttcccatgaggccttgcacaggccttcctgtggacactggacacgggtgactgaacctgaagtgtgagatgtttctaagatctcatgaagtgtgagatgtttctaaaatctctacatgggccgaccacaacctgctatcttctgctactgtgtgccatgctagagctcccctaccctgggaacaaacgccagggtgccctgcggcccggctctcctcggttcccctgatccatccagggaacaaacgccagggtgccctgcggcccggctctcctcggttcccctgatccgcccagagaacaaacgccagggtgccctgcggcccggctctcctcagttcccctgatccatccagggaacaaatgccaggtgccctgaggcctggctctcctcagtcctccgatcgggtccagtccattttcattcatttcactttggtctcctgtctgtctgtgcctctgggccaaactcattgcagggccatggccccgggcaggccccaccttcctgctttctgatgcagcgatattcttccctttttaggacctcactctgtcgcccaggctggagtgcagtggcgcagtcttggctcattgcaacctctgcctcccgggttcaagtgattcttgtgcctcagcctcctgagtagctggaattacaggcgcctgccaccacgcctggctaatttttctatttttcatagagatggggttttgccatgttggccaggctggtctcgaactcctgacctcaagggatccacccacctcggcctcccaaagtgctagaattacaggtgtgagccaccgcacccagctgacattctcctcttaaagcctgtctgatgccagctcaggccacagggcacattaggcttctgacaaagctggaggacaaggccccctcgcatgccccatcctctcctcgcccccccctcccccgagtgcctccttcgaagccctgcctccctctatcatgccctccccccacgcagcctcaagaaacatgaagaggggacctctggggtggtctggcaacgcctgcctggtggacagcagatgggagagaaggaaagcagccggtaggagaagagacagaggaaaggggaggaggaagcccatgctcaaggtgcccctcctgcccaggcttcctgccagatgcttcttggatcaaatactttgttatatttccagcacaagaaagtgatgttacaaacactaagagaattcagagaaacagcaggatttaaagtagcacacagagatctttgtgcatactttcagttcaaagacagagtggaagagatgacccatttttaacagcaacaaaaagataaaaatccccatgcgtaaaagaaatgtgaaaccctaaatgggaaaaactttaaatagaccataaagacaccaaagtcgattttaacaccaccatggtttgaatgaattccccaaaagttcatgtgttggaaacctggactccaatgcagcagtgctgggatgggattctggggaggtgattggctcatgaggactaatccattcatggactaatgggttctcagggagtggagcagttatcaccagggggctggttataaaagccagctttgccgtctctcatgagaccctcacataatgcccggcaccacttgagactgcagagtcttgaccagcaagaaggtcctcaccagatgcaactcctataccttggactccctgcctccagaactgtaagaaataaaattcttttctttataacttacccactctgtggtattcagtcatagcaacagaaaatgaattaagacagaaagaaagaccatgttcctggataagaaaactctcctaagcaagacaattctacaaaagtaaatttataaatgtaatgtaatccttataaaaacgccgcatgcttttccccagatctagaaaactaattataaagttcatgtgagagaggaagtgcacaggagtgtaaaaatagccaggaaaactctgcaaaagaaatggagaggtcctctgcccccgaaccatctcctggcctccgtaatggaaccacatgacaccaggacccatgtaggcaagcaggcccagggacatgaaaacccggggacagaccccagtgcctagaacattcagtctataaggtagcatatgataccggtgaggaaaggatggacttgttaatacaagtggttaaacgttaaccacttggagaaagacgaaaatgaatctgcacttcataccatacactaagacaaattccaaatgggtcaaaagtactaggaaaaagtgaattccttcatcaccggggagtgggcaaaatcttcttaaatatgacttaaaacccaggagtgataaaagacaaaatgtatactgggaaaaaagttttataacatagcacattttcaaagtgtcggtgacttgagtgggaagcagggcagtgactgtcggggactgagggtggggggatggtgttgaacgggcgcggggtctccttctggcgtgatgaaggctttggaagcacacagaagtgatggttgtacgttatgaatgtattaaatgctgctaaattgtagactttaagagatggttaaaatggtgaatttttttaaccatctataggactctgataaaaatgttgttttatgtatattttacctcaataaaaattataacttaaaatgagaaatattaggattaatattccttattcaaacgagctcatgagtttggaaaatcaagaaaatgattaaaaaaaaaaaagagagagagaaatgcaaaccaaaaccaccccaagactccatttctcacctacaagattgacccaaatccaaatttgacaccagattcggctgctgaggggggcagggacttcctacaatgctgtggggatgcagaacgcctggccccttggggacagggacaacacccagacaagccagatgagcctctccccgccgactggcaatcccacttccagaaatgtatccttaagatacgatggccagaatccacaaggatgtggaaatgcccttctaaccagacttagaagacaagcactctgcagtcccaacggaggtgctgggtccaactctgacatttgattggccaaagactggaaacaacccaaggcccagcatgaggggatctgctggctaactcacggtgagctaatccacggcgagctaacccacggcgagctaacccacggcgagctaacccaccgccagctaacccacggcgagctaacccacggcgagctaacccacggccagctaacccacggcgagctaacccacggccagctaacccacggccagctaacccacggccagcttacccacggccagctaacccacggccagctaacccacggcgagctaacccacggccagcttacccacggcgagctaacccacggcgagctaacccacggcgagctaacccacggcgagcttacccacggcgagctaacccacggcgagctaacccacggcgagctaacccacggcgagcttacccacggcgagctaacccacggcgagctaacccacggcgagctaatccacggcgagctaacccacggtgagctaatccacggcgagctaacccacggcgagcttaccggagcactcggtagctgtgctagaggcctgtgtggagcaaatgtgcctggttttacagttctgacaagaaagccagtcaaatgatttgtattcgcaaaacaaattataacaatttctagaatttaaacaaatggacttgtgtatcaagttggtgacagaagcgcagagtagttaatccaattacatcatattttaactttgtatcttcaaagggaaaggtctaaaaaagctagcagaaaaaaactttgaccagtagtcattgttaacaataccttttttggtagaggtggggtcttactatgttgcccaggcttattttgaaatgattatatgcatttatatgtagaataaagcaaataatgttaatgttgtaatgaaccaagattttcagcttaagaggtaaaatcaaagaatatttaaaaacccttataatcttaacatttgaatggaaaacagtatgaattcatatttttcaaaaatacatgtgtatatcccatgctaaagtagttaagggtgaagggtcctgatctctaatacaacctcacgattcagagaaaataaaccagaaatttttttttttttttttttttgagagagagtgtcttgctctgtcgcccaggctggagtgcaatggtgtgatctcggctcactgcaacctctgcctcgcaggtttaagcaattctcctgcctcagccccccgagtagctgggattacaggtgcccgccaccatgcctgactaattttttgtatttttagtagagatggggttttgtcatgttggccaggttcgaactccttacctcaggtgatccatccacctcggcctcccaaagtgctgggattacaggcatgagccaccgcgcctagctgagaaaataaattttagaacaattttctggttttgtccatggaaaggctgggaggtagagcagcccagccatcataagcagtcagtgctcagtctgtggcctccaattcccactccctccaattcccactccccactaacgagaaccagggctctggagaaatgggtagttccaggttctgggcaggaaaagtcagaggcagctgtggccccagagcaaggaggcatcaaagcccactggatggaggggctcctctgtccaattacgagataatctgagcatct

SEQ ID NO: 26 - DNA, 36487 bp, Homo sapiens
aaaatgaaacaatgtattctgaacatgcattttaaaaataatggattggaagagtaggctagtctgaattcatgaaaaatctgattgacagaatgtttagtatatgtgtgtacacacacatattcatacatatatgtttagccaaccttaattgagcatttaccatatcccaagcactacactaattgctcaacacatatatactcatttaatcctcacgacaattctctaaagtagttactatcattttacagccaaagcaactgagattcaataactacatctttatatttaaaatgcatttcatgtaaacatcacagaattggatcttgcttttatatccagcctgaaaatctcagccttttagttggagtgtttaatccatgacatttattgtaattattgatatggttggatttcagtctaccattttcctatttgctttgtcttctctgttctttgttcctttatttctccttgtcttcttttggattaatctagttgtttttgcttttgtttattagtgttctattccattggctttttagtcctttgcaaattttttgtgattactcaagaaattatgacatgcatccttaacttatcacagtctacttagaaataatattatgttactccacatatcatgtaagaaccttttgaaattaaaattccatttaccttcttccatctttcatgctattgttgtcatatattttattcctatatatgttataaacctcataatacattattatgttaactttaaagattcaattaacttttacataatttgagtaaagaaaaaaatagtcatttatatacgttcaacatatttaatatttccagtgtccatgcccttctgtaggtccaattatttccctttagcccaaaaaacttttagtatttcactgtggttctactggcagcaaattttctgaggttttatttactgaaaatatattttaccttaatatttgaaaaacacttttgctgagtatagaattgtagcaaagccatttttgtttcagccttttgaaaatatccttcaatgtcttctggccttctttttttctgaggagtagtcgtatccgtgttattattctcctgtaagtaatgtgttttttcccctctggttacttgtaaaactttttctatatctttgcttttcaactgtttaatcataatatgcctaggtgagtttttttatatttaatctgcttaaggtttgccgaacttcgtggatttatgggttgctggttttgttaaatttggacatttttgtctactatttcaatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattgtgagctataataaaatgttattttaaccacttaatctggggtaatttgttatgcaacaataggtagccagaggaagtagcaattatatgtcagttaacaatgggtaaaggcattgaggatttgtaagaaaaaaatacaagaatggtaggttctctgtgagttattcaggatcctaagtggatacaaatcatttcccctgggtagtaacttcagcgaggatactgtttggaccgaaaagtatgcatgtaataaagatttatatctgcaaaatgatgaaacactggacacttccattttctattgtactttctctataagaaagtcaataacatacagattgctgctgttgttactcctaataataatagtgaccaagttctgaatgccttttgtgggccagcactccactaaaagtacttcacatacactatctcactagtttttaccaagcgttagtttctgctatgtcaaatgaagatggtaatacataccttgcagagctcttgccaaagttttcttagctaagacatttcaaagtgagaatttgaacccaaaagtgtctgcctccaaaaccactgcaatgccataaaatctctttaattaaaatatctgcaataattaaagaaaatgctggccaggcgtggtggcccacacctataatcccagcattttgggagactgaggcagaaggatggcttgagcccaggagtttgagaccagcctgggcggcagagtgagacatcatctctatgaaaaatattttttaaaattagctgggcacaatggcacttgcctatagtcccagcttctcaggaagttgaggcgggaggatcacttgagcctacaaggttgaggctgtagtgagtcatgatcgtgctacacactccagcctgggcaacagaatgagacccctagctcaaaagaaaaaaaaaaaaaaaagcaaagaaaaagaagtgctgccctcagaagaatgtttttacttttatgtgagtttttgggttttgtttgtttgtttgtttgtttgtttgtttttgagacggagtcttgctctgtcgcccaggctggagtgcagtggtgcaatctcagctcactgcaacctccgcctcctgggttcaagggattctcctgcctcagactcccaagtagctaggactacaggcgtgtgccaccatgcccagctaattttttgtatttttagtagagaaggggtttcaccatgttagccaggatggtctcaatctcttgacctcgtgatcctcctgcctcagcctcccaaagtcctgggattacaggtgtgagccaccgcacctggcctatgtgagttttttaaatcaaaaataagtgaaaaattttacaactgggataggtgaaatgtgtgacttatgccttatagtacaataagactatattttgctgatccactaagttgaatcaagtggatgcatcagaggtttcaaaatcaccagctttagcaccaatccttaaataatcatgaaagtagctgtatgcacctgccaggcaatttagagaatcacttctataatgttctatttttagtggaaaatctgctgataaatttaaattttcttcaatgtgctttaaaaatctgaatacttataaactctcctcaatatctcttatttttaatttctcaatacattaaaagatacatcaaatcatgaatattgccttttggttatagattatttctttcctccagttacatatggaatgttaataataattcattaataattatcaaagaattaagacttctctcattgaaaatcctcgataatgtaggaaataatttattctgtgaactttcatattatagattaatatgaaaagtaagtgctagtctaacagtcaaggctttagaaactaaggtctaatctataccaagagctttgacagacttttaacttttgacccagtaattccacttctataaattttccctaagaaaatagagtagtgaaaaaaagttaatgtaaaaagccatttgtttcggagttaattatttatattagagagaatttggaaaggacttaaatgcttagctaagagaatggtcaaatatgaaatactaagccaggcgcagaggcacgaacctttagtcacagctacttggagactgaggtgggaggattggttgaggtcagggatttgaggctgtagtgcactatgaccctgcctgtgaatagccactgcactccagcctgggcagcatagcatgaccctgacttataaagagaaaatctgttgctatagacaatttaatcacataagaaaagcttttgtcattatgttatttaaaatatatatgtatgtatgtatgtatatatatatacttaacagaacaaaatagtttttctctgtattatcaaatgatgagagtttttttttacatttaccagcttattataaaggatattacaaaagatagagatgaagattgcatagagtgaagtatgggggaggggcgcagagcttccgccccctcccttggcacaccaccctccaggaggatggtcagctgtcagaaagttcatttcctttttgtatgaatgtgtttcaaagttttttacaataaatatgtattacctctatagtcagatgaaattaactttttaaagatcactgtgcattaaacttgaaattaatacttgatgtcaagatacatcagtaatgtattatgtgatagaaccctgtcctaaaatgttaccttaaaattaatttacctatttattagtctcaggtttcacctagggattgtatagcacttaaaaaatttatagtaacaaaatgatggcttgggcaatatatacacatcttatttttaaaataaatagtaactatttccttataccacccagagtatgcagcaaagtgcacctaatagatgtccagtaattattcacttatattctaattaatctcttcccactctaaccacttgagtgagcaaacctagtcaaaatcaaggtgactgccttccatttttttgaactataggtgaggtgggaaattaaagaaaaataaaattaaaaagaaagagaaataagctttcctatattaagctgacttgtcccagaggcagcaacaggcacagcccagacccaggaaaagtcttgataatactatttaatgtgctctggagactctcccagcactccctcaacatagggagaagaaaaacaaattttcctttgttttatggaataagtttatagatacttgttctctgtcactagtgacttcaagtattctgttttatctaagaagtacaaagaaagtcataagaagcctgagtaggcctgaactacagctgcctgggcaccatagtgaaggttatgagataaaccagtgcaaggctctttagagcaaaacctagataatgaacatctaggttgcttggcaacggtcatgtgcaatcctgagtttgtcctgcctctgtatccctgctttcacaccactgtaaacttgcttcaagctagcccacccccttttgtgaaatgtgtataaaagtcaagtgctgtctttgttctaggcccagtctttggacattgagtctgctaagtccgagtgcactcaataataaagatatcgtcctgtatacaccccaaggtctctctctggtcctcctgatcccacaacacgggcatttaaaagtaaacgggaaaaaaattgaaaatcaaattgaaacaagagttaaaaagaagctggggactggtggagagctaggcttttggctaatattcttgttcaatttattgttttgggtaacaataaattggctgtggcagcttctcttctgacatcatctaactgagtcttcttggtttatgctggtctgaagtgttctcatccccatctaattttgcagatgaaatgcaaagtcggctttttgattgccctcaaattgtttcctggcttggcatgcttctcactcattaactggggcagtttagggtgtggggaaatatctccaagggtgagaagcacagtcaaatgccacgatccaatgcccgttgaataattgaggtaggaagggggacactaggaaaatggaaggaaattagtggttggaaaaaaaaaaagtcttccttaacagaagattttaagtgttttccccttcttctgttcctcattccctcgcctgagaactcccttctctcatcctgctgatttcccatatactctttgaggtgtggactcagggactgagtgcctgctgcaatgctagtcgtaacgggaaagccagatgtcctgtgctacgcttttattgagaattaatcaatgtttcttaggggaagaaaaaaaacccagaatgtagacatgtgattaagtgaacctaactgcatgctgaattattgatctgttgatttgtgaaaactgccattggacagcaatgttacacttttcatctaaatgtttatttcatttgaaatctaatgaaggagaattagacaatgaatatttacatatatttttagttctgctggatgatttccttgaaacctcatttaaaaaaaaaaaaaaggctgtatttgaagtcataagtcctagataaaggcccagtgttgctgctaagtgtataacaggagattattcacttgccctttcaaaacatgtctccatagttttgtctgcaaaatcaggatgatccttacctgcatcacacgagtcagttatgttgctccctcactaggaggaaattcacaccctccctcaggtgaaaaaaaagtacactgtttctttttaccctttaatcttctgtattaatttgtattcatgcttctgtgaagaaatacctgagactgggtaatttataaaggaaagaggtttcattgactcacggttctgcatggctggggaggcctcaggaaacttacaataatgacagaaggggaagcaaacaggttctttctcacatggcagcaggaaagagacatgcagagcaaagtggggtagatccccttataaaaccagcagatctcatgagaactcactcactatcacgagaacagcatgggggaagcaccctgtgatctaatcacctcccgcgaggtccctcccccaacacgtggggattacaatttggattacaattcaagatgagatttaggtccctctcccaacacatggagattacaactggggttacaattcaagatgagatttgggtggggacacagagccagaccatatcatcttccaaagctgaatttttctaatcaatacgctttaagagccttgcatatttccccaacaaagaaaaagagcctcgctccataaaacagcatacttaagcagcatatctggcacatattttaatgttattttttatagagaatatataaagctttacttttttgtttttaaagtttgagattttttgcatcctctttattacttttttttatttagataaaataaaaagtgaaaattccacattccttctttttaaacctatctgctagatgtgaccactatgaacagagtactctatatttttggaattttatttatgcttattagtttgggtaggtgaattactataagaaatagacaaaaatacagacatgtaacagcccttagtgagtgaggtttactgcttgctcatgggagagtactggatggatgagtgggagcacagagcagccaccttcaggcagtcactcagggcctcaggttgctggaggcacagccatcttcagctctggagggcatctccattcctagtgtgctgtattacaaacagcttttctttcttccaatgtctccagctttctggcagcatagctagcctcctgcacactcaggccataattgcttaactcaaaatggtgtgattcaaattcaccctcagaggcatgcttgaaggcattcaaatttgaacgcctctttcacccttctctgattagatgttcttttgtactcacttctgcccttcctttcttcctatctttgaataggttttactagttgcatttgcttcttatgttacctctctatttaatgattgattgattgattgagacagagtcttgctttttcgcccaggatggagtgcagtggcacaatctcagctcactgcaacctctgcctcctgcgttcaagcgattctcatgtcttggcctcccaaatagctggaattacagacataagccaccacacccggctaatttttgcatttttagtaaaaacagggtttcaccacgttgcccaggctggtcttgaactcctgacctcaactgatccacctgcctcggcctcccacctgtctcggcctcccaaagtgcttacaggcatgcgccaccacacccagctgttatctctcaccatttagctaaactactggcagtctacgaccactccaccccttctctgcttcaggagatacttttcaaaagtcacttgtgagcaagtggtaagctgttgccttacctcagaaagcagcttcttttccctgctgttttcttgtggggtctctcattcatctttctcctttgtagctcttacatttccttctagaaatcttctcctccttcatgtttccttctctctccttgctgcctctcccacatttctcctcttccagcctccatgtaagttgccagcctcatttaatcaactgttactagcagctgcatttcatttcccttttattctctaccttttcagctgacccaggtgggctgcattttctttcactctgacgttctcttagaccactcactcaggactactcgttcaacgacagtctcttgtggagcaattttccagactgcaaaccctgctcaatttccaaactcctgcatctagtttacatctgtttgtctctggcagtagttcaaaccctcctcccccaatggaaagctctggcaaggagtttattgctcaccctggaaagagagaaccacctcaacagagattgatagtctctagaggggcaaggtgggaaaattatgagattttggagtagggtggccaactgtcacactttgcccaagacagagggaattccaaggatatgggctttgcattttaaagccaggacaaaaaaatgaaagattgtataaagaggatctttccatgcagggtcttgtttaggtaaaaatcatgacataatagtttaggattagcatagtgaggatttggaagtgaggagttctaagatcttggggtataaactgttgatgctttctgttgaagcattgatggttctttgtttcaaaaactctctgtaatgaacaataaagcaatttgcctgggcaagagtctcctggaattgtagttatgttaatgaggacaatggaccagtaagggtatattattatagacagtaagctgtgtgtttagggaggagagaggtaggtgatttctgttctcagagttaactccatcctctcttttccaaggtctgtttcatattcagtgtccttagttgaaatgcctagttgaaaaaaccagagagttttttctaattttgcaagaatgtcacaacatctccagtcccaagtccctgatgtctcttctagctttcattgcacttatgaaaataacaataataaaagcattattttagagccctaactatgtggaggccaaacataaaatccctcatgaatattatttaatcctcacaaaagccccacaaaagaggtgttgttaattgttcctattttacagacaggaaaactatggctcaaagaggccaagaaacttgtccaaggtcatataatcagaagtggcagagccaagactctatttcgagtccatctgggctattcagaaataaaaaggagtgaactactaattcatgttacaacatggatgaacctcacagacattatgctaaatgaaagaaggcagacacaaaagactgcctgttatatgattccatttatatgaaatgtccagataaggcaaatttataaagaaagaaaactgatcagtggtttctaggcataaaggagcaagtggagactaactgcagatgggcctatggttacttttgtcattgacagaaatgttctaacctgtgatgatggtttcaaaatcatgtaatgttactaaaaatcattgaactgtatgcctacatacaatgtttgaagtttatggaatgtaaattctttttcaataaaactttaaaaattacagaggtcacattctaagctttctgactggtaccaccaatgactagatgctggttcttttaggtgccactcctaaggagaaatgctaaaggtttactgggttcttatatacttttcatgtaagcatagggaatgccttaaactcttttagccaatcaacctatgttgaatatgtttaatttaaccagtgagagttcatttctagcagttacttatttctctaatgctaactgtgcattcttgatcagcatttatataaacctaagtatgtaagttactgacacacgatattgcactatacatgcagaagtgtcttcgattgctgacatgacaaaataaacccaagtgaactgtgaagacttaccacttctgtacatctggtatggcaatgacagagccttactgtccatcttgctgtgctgtcgttcatcataaaattccctcatcctcccactccaacactcattgtcttggccagaatacttataaataataaagatatttgtcttcaactcctcaccaaatcattggagggatttttcttttttctctaaatgtaaaagaaaaaaaattctgatactacaattaagaacaatgtagcccataaattaaagtggacagaaaccaagccaacaatgcaaaagagctgagcagccattgggtccccgtgaggagacaggagtagtttgtcattgatgggacccctggcagctacagcccctggggtaccctgtggcgtaaatgcatatttttctcatgaacgtttgttaaaactgatttatgttgttttgtctttgataagaacagatacggatgcattatagtgactgtgttccttgtaacttatacagagaaattcggaataccaggaacttaacttacatagaccctgatgccctcaaagagctccccctcctaaagttcctgtaagtattaaatcctctcccatcctacttttctggggggagggggtcagatttaatgctgttgtctcccaggaatctccctagatgatgtggtccaggttcattttaatggtgtatagcctgggtcgggggcaaggtatcgggtgaaatgatccacatttttaaaacctattcaaaagtcagcacataatgctggaaccagagacctgctccaagaaacaggagggagaaaatgctatcatgtatatgtggtccttaaatgtagtatttcagaacaaaacaaaacaaaattctgagagccagttggtcaattttgtttgaaaatgggtatcacaacaatattattagagtggctgttacacaggaaaaaaaacccacaaagagtaaaatacacttccatggggagtggagggaaaacagaagggacaacagtttcaacctcccactccagcactcaaatgtccagcactcactgctttgctttgaaaacaccttatgagctaaccataagctccatgaatccagggaccacaacattttttttctctgttgaatctttactgcctagtacagagtaggcgctcagtacaaatgtgttcagtggatgtgtctgtatgacctcaggccccctggataccaggtggaagagtcctttttcctacttgcatgcattataaagattagaaaacaaagagtatgaagaagaaaattgttaaaaaaaacttaatcccaaaccccaaaataagcactattaacatttcagttcatcttcatccagaccttcaaaacaaacttatgttatcatagatattttatgagataagcccttaaggatgaatagagggtatcttgaacaagaatggggagatagaaaagaaatttagctggatggaatagcatgataaagacacaaatgtagggaaccacgcagcttctttggggaactaaaaatagttgcttttttttttttttttttgagatagagtcttgctctgttgccccaggctggagtgcagtggtgtgatcttggctcactgcaaccgccacttcctgcattcaagcgattctcctgcctcagcctcccgagtagctgggattacaggtgtgcaccaccatgcccagctaatttttgtatttttagtagagatggggtttcaccatgttggccaggctggtgtcgaactcctgacctcaggtgatccacccgcctcagcctcccaaagtgctgggactacaggcatgagccactgtgcctggccaatagttgtatattgaagaggtgggtgtgagagatgccaggggaatggaagacactgatgggatatgaagatgaaaggatgtctggaaagccatgaaagcttatgggacaagacaatcactcttcttatggactctgagtttcaaataatacaataaccctttgatgtgatgatcccccactatatgctctgtggggaacatacaggtttctaagacattgtccttgcctgtaatctagttgaggagatgtgtatgaaattgaaaagtgcctctcctacagaagaataatggaaagtgacgaaggagagacatatacagtgtttgggggttcaggtaattagagaagacatcagaaagaagacccacagcatggttttaagggacttgtttgagatttttgaagaatagaaagatcttgatccaagtatatggaccccacttgactcttggacctttttccctcctactgttcttcatgagcacctattgcaattgaactagttcgtttactgtatttcaaatataccttatggaatctcacctctctcctttgttatctggaatgtccctcccatttgctgattttgagacctctggctcctgctgcctcttcaaatcctatgccttcttctctagaaggagtcaagtctgaatttgcctcagaaggagtatcaatggatatagtttttctaccagaagaccttctctagagctttactgagtagtgtctagatctcactctatgctatgccaaattctcaaaaaaaaaaaaattctaattacattcaagtagctgcaacaaatgttaaaacaactaaatctgggaggcatcaggagcctgagaattcttgtattcatggtgttttatgcatgtcttttaatcttaacatttttctgtagatgatataaactacagaaggtaaagactttgtctttgattggtttccttccttttctggacactgtctttttttgagacagagtcgccctctgtcacccaggctggagtgcagtggcatgatctcggctcactgcaacctccacctcccaggttcaagtgattctcatgcctcagcctcccaagtagctgggattacaggcgcatgccaacacatgcagctaatttttgtatttttagtagagacagggtttcgccatgttaggctagtcttgaattcctggactcaagtgatccacctgccttggcctcccaaagtgttaggattataggcgtgagcccctgtgcccggctctctggacatatttttttaaatggtactgttataatggtactctcaggtcactgctgtaggaaagatattcttggcaaaataacagcataatatcatgtagagcttgaaagaggaagctggcttaaagtcatcatatcttcctgtcccatcttcttcttagcccttcactaacaaacacataattttttccaattaaacgagaaaatcacacacacacacacacgaaaactgaatttatatttctagtaaacccacttggttaaaacaatctccagagcattctaagccgagcagatgtattgacaccagtggactggattaaattattatgccttgagggaatatcatctcatccaaccatcagaacttgcccatagttactcagatatttagggaaggtgttgggagtttgactacaggttgtcttcagaacccatgctttcagctattacattattctccttcctatgtgttgatttttttacctaaattctatgcttttttttctctttttttcattaatttagtggcattttcaacactggacttaaaatgttccctgacctgaccaaagtttattccactgatatattctttatactgtaagtatgcacacatgccatgtttgacaatattttgtttgtcactgacaagaactagaatacagtcatgagggtaggttgaagataagtaaagcaattgtttcaaggagtaagcaatgatcaggtgtgactacactggcatgaagtaaggcaaggactgagaaataaccactggctttagcaatgtggtttgttggtgactctgccaagaacagttccagtggagtgctggttggagtgggctcaagagagacttgggtagacagaattagaaagagttaccataattaactcttttgagaggttttactattaaaaggagcagaaaatagctcagtaattgcaagatattgagtcaggagaaaagattttgtttgtgtgtttttgtttttaaatggaagaaattatgcaatgtttctttgccaatgggaatggttgaatagaaggaatatttgatgataactatgataccttatttttcatagagttttaatagttttttaaacactttcccacacatgacatttgctcctctcagccaccttataaggtgtaaaacaaagttactgcttttccatttatgaatgaggaaactgaggaatagaaacctcaagtgattttgtctgagcagtgtctcaaggaacagtcagaagtggtactcaaattactgcctgtgacctttgattggcacccatgtgccctttttcaaagctggtgacatgggtcagttgtcttactaattgtataggaatgaaaggacgtaaggcagagagaattacaagttgagtttgcattaaagagtcagcaaaatgtagaatgataagcttcaaactcttggggttttgctagaaaaaaaaattgatcatacttctttgttgcaaaagagctcagttcaaaatgtaagcaatcttccagaaactagaatggcgtagaaaggttctccaggagcctggcgaagtttggcaagtgaaggacattttagaaatactcattaaatgaaatcctttaatccttttatcctgaccttcttaaaggtccatgcatgtagaaaactctagttgttgtggacaaagtgttgcagattcgggagaagcctctcaaatccatctgcctaccccaagatgaggattaagtcagggacctccacccacacctaaagctctcacttaccccacatttgggctccaggtgcatgtcatctaggacagctctcaccacctcaccagacctctgagccactagcggttaagaagggtcagtgaaacttaaaaagaaataagattaagctatattgtgtcctgttatttaagtgcatatgcgcagcaagacccctgctgcagaaggaaagcattttttcattaagtgtttttgtccctctctcttgcagtgaaattacagacaacccttacatgacgtcaatccctgtgaatgcttttcagggactatgcaatgaaaccttgacactgtgagtattaccagttctactccctccatcaactaaattctattttgagccattttcatatgtttacagaccatccaagagccatactgccttatcatatatactctatagagtacaaagtgttttacacaattaaataatagtattgtcttatgggatggtactctgtagactacaaaacagtttaggtaacaagacaagaggattccattacggcagtggttggtacatttttcacgtgaagaaccagttaggcattacagaccatgcaacctctgtaggaactggtcaactctggcattgtgtggcaaaaaccgcagtactcaatatatacactaatgagcatgtctgtgttccaataaaactttatttatagaaagaggcagtggactagatttggcctgcaggccttatggaataatcatctgtatccaagtgtccccattctacagaagaagaactggggtttaagcaaattgaagtgacttacccaagatcactgagttaaaaaaaagtggtgccactaagaactttataaattctgcactcacacttttactcagtaatcacaaactgttattaagctcctgtaaggggatattacatagaaagcatagtgctgctataggtcagcatttttccagagcctgaatgggggcaaagccctttagatggtcaaaagtagatgcttaattagggatattcacaaaatgttctaaaggagaagatctaatagaggtataaaggataagttaattctccaagctggtagaaagttcctctctcattgtgtaagtcacaaagtagagttggagctacctctgcagggtctcctctctattttcaggaccactgcccaagttcaagcctggtgaagtttttgtctggattgtcaccccagtttcatttctctgctcacactaaagttggggtggaggtctttatcagatacaaacctgatcaaattactcaccagaaaaatggatccaagcttcatacagttcttctaaggggctattttctgagccattcctagtttatcagtttgggcccaatgaagttacctcaacttctgagagcaatggagcatttcagatgatccttctcatcacaacctggtgagcggtcccttgaaaagacaaaggaggctccttctcagtcataatttcttcttaccatgcagaaaaggcccaggctcttagcctgctcagctccaaacttcaaagccatttacttcctcagtaaagctttccattgcgccatatagtgctcatcataaggaaactcctacatgctaaacttctttatagaatattacctctaccccttgacaccatttctctaaaacccccatatctcaagcacccccctcaagtgaaagctcattgtcccacacctagcatagagcccagcatgtgtttctagaaacatctgagtgagggaagcccatatttcctaaaatatagaggagaggatggcatggattattcatgatcttttcagatgattatttctacattttggcaaaagtccttgcttcttcgaagctcaggctcaaaaaactatcaacttgaaaagacacatgttccaacaaccgactttgtacctgtattcctggtaggagaaagtttcagtcaaagtttgtaattcttttgtcttgcttcaccatgttcccttttcaaggccgatttgttcattaagaattctgtttaatatctgaaatgcaattcaaacaagtatttttaatgtccaggactctcaacaaatttaggaaaattaaaatgccatatgcacagttctcacatcttcataaaagagttctagtttagaaaaaatttacttatccacagagttttctcagccattgtgcttatattcctgggatattgcaatcctcacccaggacatgttagtagctggaattaaactcgctatgtaattatttaagatgaaacaaaaacaaacacatcaacaatgacaacaaagccacgagaatcttgctcagtttcccacaactatataggataaatccaagttttagaattctccttttatttatttatttttttaattttttttttttttttttttttttgagacagagtctcactctgtcacccagagctggagtgcaatggtgcgatctcggcttactgcaacctccgcctcccaggttcaagcaattctcctgcctcagcctcccgaatagctccttttaacatggtcacctaataagtgttcctcactttgttaaatatatagttatttgatcctctctgcaaccttttgattgggcattacatttatgtactaatttatcacatttttagagataaactgaggataagacaggttgagaaattctcaggatcatccagctattaagtggcagagccaggtctaattccaaatttgaactttcctgtgtgcttcttattgtgttcccaaggttcacatgtggtagattactgtggttttcaaggttcccttacaactgccactaggagttctcactagcagtgcctgagtgtggttatagctgtcttctcttatcttcatgccaataaccaccaataacctcttgcattcccatatagcccagaggtcccaaggctggggctccttctcctgcagaaaggggggctgcttttggtaggtggaaataattatatttgaggttggccaggcacagtggctcacgtctgtaatcccagcactttgggagaccgaggcaggcagatcacctgaagtcaagagtttgagaccagcctggccaacatggtgaaacccccatctctactgaaaaatacaaaaattagccagacctggtggcaggcgcctgtaatcccagctactcaggaggctgaggcaggagaattgcttgaacccgggagcagaggttgcagtaagcagagatcacgccactgcacttcagcctgggcaacagtgccagactccctgtcaaaaaaaaaaatcatatttgaagtcagggatcctaagtctcaacagtcctagaccaatgtgtttttggcaagtcaccctcatgtctcagtaacttcaataggaaatagaagtaataacatttcagactggctccctgaatcattaaatgaattaattagtcatagaaacacagcaacaagttaaaacattaacatttccagcccagtggttcacacctgtaatccccagtgtttcgggaggctgaggcaggcggatcacttgagcccagactagcctgggcaacatggtgaaacctcatctctacaacaaatacaaaaattagccaggcatggtggcacatgcctatagtcccaactgtttgagaggctgaggtgggaggatcgcttaagcccagggactcaaggctgcagtgagccgtgattgagccagtgtactccagcctgggtgacagagtgagagaccctgtctcaaaaaaaaaaaaaaaaaaatccataagaggacatggtctatctactttcttagattcatctatgaggtttaatttaattcagcccataacccttaaacatttaatctgtgataagctctgaggataaaaagatggataaaatacaaaggtgaaataacatttaaatattaatagaaaaataaaaacatacgcattcagatgaatgtctttcaaaatgtttatcttaagagactgcagctgctcctccactattgacattgggttaactattacctcaaatccctttttctgaatgtatgtggaatattcttttaaaatcttcaatggtaacaagtttgttactcaaagtaaatatgattctgagaaacaccttaaatttactaggagctaagtcaggagaatgggcattcaaactgagaaatattatcttgtttccaacaacttgtactggaaagttttcttgtgggatacatatgtgggacctgaaaaacctttatgtacatttatgacactgaagaaatatagtccaactctccagaaacaggccagcaccacttctcaccagtcactgatttctcttctctctgttggttgtaggaagctgtacaacaatggctttacttcagtccaaggatatgctttcaatgggacaaagctggatgctgtgtaagtcaagggtagccatgaaaactgtcactttcccttaccctaagaaccatccaatggggcagaatgctgttgagagataggttctaccagagcatcttccacgccagagttagtgtgaccaacatggaaatgaggtcaaggaacttggcaggggcccactttagtgggcgcttacgttagctccaatggtaagttccaaagcttttctccctggtgtgtgtgtgtgtgtgtgtgtgtgtgtgtaaatgttcatctattatgtacatgaagtaaaaggatatctttaatgaagcccaaagctgttcagaaaataaggtggtttctcttttagtcctttctgacatgtttttgggaaagatgtcagtttatatttgattcactcagaaatagctaaaaaatcatatccaacttttgccttttcaaaaaataaatagtgctgggaacagctgaaacagcaaacaatagactttgtgtttgatgtgttttataacactttttgagtatttctttacaaatgatatattttttctatttcacctttttctatttgttgtttttttcaaatttacctgctcatttttgctagtgtcttgttatgtattcatttttgtaattatattatttgtttcactttaaacatttcatacatagtaattttatgttccagaaatgatccctgcaaaatctgaaggccttatgacacaaaatctgttgcgtatggggcttctcaaaccttcctgggcatcagaccctctgagaggtcttatcaaaatacacagtctgattctgtagctctggatttggcctcgggattccatatttctaacaaactcccaggtgatgccgacactgctgttcatagaccacactttaagtagcaagggtgaggtcaataagctgtctaaccctatgcagtggctctggatggagaagaacactcatgtagattatgtgattttggttgatgttctggtttaggggttaggtggtaggttctggaacaattccatttttaaatggtaaatggtaaaaaggtgtttgaactcattacactgaggcaaggctccctgagttctgtttgaagtgaagtctcactctttgctggcttttgtgcttcataccagtctttatgaaatgaagagttacagtaccattctctcgattgtctggttgtggagtcataatggttcatttccattatttttttactacataattataggcaaagtctaaaaagactctatcgagtaaggtgatacttaccccctcaaatttatttacagaattggagagaccctccttccatcttaactttatgatactaacttcttacaatctttcatctacttttcaacatatttattagacacttgcaatgtaccaggccctgtgccattcactgggaaaacacagatgaacaggagccatgtgctccctgcccacactgagcgtacattctggtgggggtcagctcaagggcagcaacatcaaagggcaaagtacattagggagaagtgtacccaatccaaaatatgcatctcagatagaaaataactgaagcctaaatatcgaataacattgctttccttctttggagatacaagctagattttttctaggtttatcccattgttttttaaatcattattaaaattaatgttttagaaatgaattatcctatattccaggtttcaagttctttttctaatctagcattctggaaaggtggcatttgattttaatattgtatgaatttcaccaaatattttcctctttgattcaactattcctagaaagctatgactcttagggtaatgatcttcaaattcaaattttctatgaatggagtatggagagttcttaaaataatgaagatagtttgtaggtacttagggtataaagatttcagatgactatcacacagttctagacatagagtgcaccaaaagtttagttagcataaaggcaacaaagactcacattagcaggggcagggataggaggtagtaaggaaatcttcaaccagggaaaccaaagctgttaatatggctcctgaattcagtgtgttcacctgactcttgcctgaactagaactgcctttccagaatggtggattagagaaagaacctgaaacctgggatatagggtaattgatttctaaaacattaatttttccacaagcaaaagattttggagcccaagataagaatctatgcttcaaattaactgcctgtttttcctgccgtatttagtcattggaagatatgaccctcagacactatcaattatcatttattcaagatagagtataaaattcagaccttaaggtctacagagcaataattctcaacattagggagttttcaaagcactaatgcctaggttttgccgtcagacattctggatgtagcaggatcatggggatttaaaactctctccaagtgagtccaatacagagcaaaagtcaagaactactgctgtaaaatacattatcagtcttcttgtccaattgtcacgttttacatatgaagggaatgaagcccaacaagaacacatggctttttttttttaacgtggctgttttaatttgatagagcttcctagtggccaagtcaaagctgagacctgggtcccctggttcagaactctttccctgccctctgctgggattcatcatggctgacttaccagccatcaccaaggtgtgaacatccaactctggcaagtgcagcttgtttcttagccctgaagattgcttagacttcttagctcaatctattaaaggcgctaaacacagaagttaaaatatcttgatcctgaaaagaatgagatcatgtgagagaaagaaggcaactcaaaactcgaggcataatcaggagaagtttcagaggacaatcacatcaagaaacagtgttgttagtccacgagaacctgactttaccaatgctgcaaagccattcgtgagcttccagatgaagtctggtcggcgataacctgacaaaaatgctgggatgataaaacgttattcaagtcaaagaattggtattgaacttagtttacgtatattgactattttccctcaaaacatctcactcctcctcatgattggcctcctggtcatgtttagagaactctgcaaagacttcaagagattttcaaaagaggtcttcttcaatcaggaagtgttagtgtgctaagtggatctcagtgtaggtctagcagcttattatcttatgaccagccataaaattagacacagagtatcaaaggagtttagagacattttctattgaaaggatggaaaaacgaacaagtgaacaataatttctctttgagcttctcctcagcctttgtgataagagaagggatgggagagggggagctatgttcctttaaactatatttcttcaactctctttccatagtaaattaatgggtgttactttttaaaagaaatttatgatcttataaagttaaacaagatatataagtggacttttcagatcttctaataaaatcatctgaattattcatatcaaagagggggccttagtttgcagagcttctcaagcagttctcagttacaggagcatctctctggtctggtgttctacagacttttgaggggaataccgcctctgataggtaggaaaaaaatcaaggtgtttttctaccatcacacactcaatacaacagttttgacaccaaatgtttggaggcttttcccccacacaacaagtaatcaattctccaatgcacaccagctggatgtcctacaatttaactcagttctgatactctacctggagatagcatcagatccacaggttaagggctcagtcccacaagactgcctgctacttcagatgccagtcacagctcccaggttgtgtcctatgcttctgactgaccaattataaatcagggttcccccagtcccctcctcagttcagttaatttgctaaagcagctcacagaactcagggagacactttaaaggatattacaaaggagcagctgtgtggcaaagatgcatagggtgagaggtaggaaggagtgcagagcttccatgccctctctgggcacacaccctcccctcagctccacatgtgccttgaccaccttccagctacctggaagctcatccaaaccctctcctctctggctttgtatggaggtttcattacataggcttgatttattacatcactggccattggtgatcatctcaatcttttcagcccctgtctcctacctgaaggtgagaaggtggagctgaaagtccaaccctctaattatttattgatctttctggtgaccagccctcatcctgaagctatctagggattgacagtcaccagtcatctcatcagcatacaaaagacacttgtcactctggaaattccaagagttttaggagctgtgtgccaggaaacagataagaccaaatacatatttcacaatattacactactgaagaagaatctttcgatataccatctgcttgggaagcaggtaaatttaagaaggtttattcaagagatagctgtggagattctaagaactagtaaagatttcaaatgatcagatggccttctgaaattaaccctatggaaaaagtacgcaaagtcctcacttagcatcccagatagggtcttgaaaactacaacttgaaatacaaacaatgtataatgaaaccaattttaccataggctagttgatataaataggagttgagtttctatagcatatttctggtcacaaaaacaaccaaacttttgcataaggaccaaaatgcttctaatgttaaatatggaaacaaatatgagctatacatacatttaaggtaggttaataaaaacaagagaattatttgcccaattattccagttcaaggtcacaggtggccacagcctattccagaagctcagggcacaaggtgggagccaaccctgaacaggacgtcaccccaacatgggacacaatcacacataccaccacactcacttgaactggcaccatctagacacaccaagaaacctgatctgcacatctttggggtgtgggaggaaattggaatacctggagaaaacccacacagacatggggagtgtgtgcacacttcacataaacagtagccctggcctggaaaggattttattctcattaaaactaagcaggccgggtgtggtggctcatgtctgtaatcccagcactttgggaggctgaggcaggtggatcacaaagtcaggagatcgagaccatcctggctaacacggtgaaaccccgtctctactaaaaatacaaaaaaattagctgggcgtggtggcgggcgcctgtagtcccagctactcgggaggctgaggcaggagaatggtgtgaacccgggaggcggagcttgcagtgagccgagatcgcaccactgcactccagcctgggagactgagagagactccatctcagggaaaaaaaaaaaaaaaaactaaacaatagtgaatgagacaatattattagaggatctgctgtatatatagagactctccgtacgttcacaccagctttctcctcagaccatatcatggattctgtgggaggcttagctgacggcagagatattctgtcagtgacaatggattttcaattcactggtgccatgacttactgtctaactatcccttgaaacataggaaagaaatcagtgtactatttcacaatactttcttgacatttttatgttaagtattaaagttatttggaagagtttaacaaatgtggaaactatttctttgttaagaatcttttgtgtcttggtttctaaaagtctagatcaggggtcagcaaactttttctgggaaaagcccagatagcaaatatttggggccttatgggacatatggtcttagttgcactacttaagtctgcctttgtagtgtgaaagcagccatagacaatatataaacaaatgagcatggttatgttccaataaaactttatttacaaaaacaagggcaaggtaggatttgactggagggtcatagtttgtagacctctggataaaagtattcagtgaggatgaccattgtgtggcgaaatatgtactctgtttctctgaatttctggtaaaggttaaagggcaagcgtgggatcaagataaaaagtatctggattaaaatatttggcgttagaaagtacagatccaatcataatagaaaacaaatttttttaatcagtattttgaatccaagctggaaactgctcctgttataaaacaatgctccatcattctaccctaagtttctgactcctagtcaatagaaatttattctttcctagatttaagcacttcagtaaaaggtatcatgtaaatccagtgtaaaatcaaaatgatggttgtgataaggagccctgggactggaggaagacaaggattgagctataggtgaaggaaagaaaggtcaaggttccatggtaataataaaatagtattcacattgtgtttttaacatagggatgttgcttttggtgtcaatgctaattaagattttaaactaaggcaaacacatcaatctcctgtaattatcttaatagtgttcaaggatttcacatggcatgttagcaatttggtaatttctccagaagtttgtccaggtatcattaggttctcatttaaacaatgtgtcatccaaaagagcaatcatcccctatcattccacttcatgacaatttactgaaattagcagatcgacctcatttacactcattttttaaaatgtaactgaataatacaattacagccaagctggacaaattccacatcgagtgcaagtgctgatgcctcagcagcagtcaagcaattagttaggatttcatgaaaatgatggcagatgtgtaaaagcacattgtcctatgacttcctatggcgccaagaatgttgtcatcactcagaggtgaaattaataataatacaagcatcccttgctcaacagaagttgaactgtacttggtcacaagttaagtcacacattcattgtttggaatttcttttccatcctctttccacgcaatctgcgtggggatatgttgcttctcacagaatgtctgattctctgtatcacatttcctattgtcaaactctagtaactagctactatctgacagtaaacatttaggcaggaataaaaataccattttgatatgctaagagcccaccaatacactaattattatgaacagagtcaacagaattaatgtgctaattagcatcatgcattagctgattcgaagtaaaacaccacatcttggcacactgggaaaagacaatgatagagaatattataggattaagaaggctattatttatcatggggtaagtatttgaacagcttgtaggatatactctaaggctgacttttccctctgcctattgagagcttgagtattttctcacaggttactatttacaaacagctgtcctgatttctgctacaaaaggatttccatagagcaatccagcttctctttaaactaacatgagaggtaggcagggggtccctttaattttctgaattagcaacgctgtgggaggaaaacatggttccccacagaagtgttcccatgagagtctcacaacataatcaaggcccagcccaagttccccataaagggactgtggaggcacaggctgaaattccatcttggagctgcaatgtatcctaaaactccccagagagccaagttcagcagcaatagcaaattctcttgccacgacatcacactcctctctctggcatagatcacgtctttctaaacctggtatagagggtgcctctttctaggagtcacccaacaatcaggctttcattccttcctccagcaagtctttactgaatggccgctatgtgccacgagtgagtccaacagaaaagggcgtacataaacacacatatagtacacataatactgagtttgtcaatcgaatattttcctcagctcattcctcaccaccttcattttcctgactgcattggtcttccctaactgtgaactattcacaatcttaaatcagggcagggcttcttaactccatgtatggaaatctgacatctcttttctcagaagaacttcatttcttccaacaggttctcaaagaggaataagaccccaagcggtgaaaagctgttgaacacatagagatgtagccatgtctatcttatttttaaaggaaataccagttcttttctcataagccctttccagcatagatatttagaaaccctgactttcaaaaagtatttcctttcgtctcttactacaagccttttgagtctcttttaagctactttatgttcatcttctccttgcaagggatagtttttatcactcctctctaaaataatcattttctagagtaggttaaccagatagcctaccaagatttgtgactgatttatccaagctggttacaaatgtggatttcagaagaatcaaggtaagtcatggtcaaggaatcagtttaactagactgataatcccaggaaatgtcatgtgataaatgaggttgatggaagcactttcctggatatcaaggcttctgtatatgtatttcccctccccactgtcttgacttcagatggaaggcaagagcagcaagctgatgcaaggttgaaaagctaaatgaggcagccctcaaatctgctgaaggcagagtgatggtttcacttttaagcatctaattaactctaagaggtaaagtaccccaacagcagtgctggttttagagaacacagtctcctgaagtgtcagttcatctccgttcatcttggccagggctcctctgcatcctcctcctcccctcctggactctggctggcttttccagtctgaagtcttctgcagagtttctggtaaactgcaatgcttatcaaccaggctccttatcctcaggagtatattaaatatcagatgaaaacactgcagaattggacaagcaataatttagttttacaataatttctaatgattagaaagaacaagctgaatttcacttgcagcagttagagatgaagaggaaaaactgagatgagttcaccggctcttacttgattttcaacagcctgggaacagaatgtgatctgcaagctgcattgtccagagaatacaaaaagagatgcaagccagtgcagcccttgtactgaacttagttgtctttttacaaaatcatgctgttcaatatcttctctgcagttgtttttttttttcaaggtggattttgcccactctgggtgtcactgaccaaaggaattccatggacatagtgggttaaaggagagtcaaacaatgatcaagtggggattgtgattgaagccactgggaaggcacagattggctgctttagcatcttagccaggtctctgaatgcatttgagatttattgactctccctttgtcatacttaacaatgccctgaatactgggtgttctgccactaccagaagatgccaagtttgggctatacccttgaggtgtttgtaaaccagatgcctcaaaaatcactacctcaacaagaacagttggtcaaatgccaccacaccataagccaagtcttctattttttcactctttatgattttttctttaaagcaatcgtctgtgtcaccctaagagtttaacactgcccactttactgtcttgatgaaaaagtatgttgatttattttctactcattcacatattcatccaacaaatagttacagagatggtgaacttggcactgggtagacatagaactttcattctggctggggagacaaaaaataaagtaaacaaataaataaacaaggtaataattatggattgtgataatgctgtgaaagaaatagagagtgtatggaggcaaaatggtaatggctactttagattagctagttctcaatctctatttaagaagaaaattgggccggcacggtggctcatgcctgtaatcccagcactttgggaggccgagttgggcagatcagttgaggtcaggagctcgaaaccagcctggccaacatggtgaaaccctgtctctactaaaaatacaaaaattagtcaggcatgatggcgatcgcctgtagtcccagttactcaggaggctgaggcaggacaatcgcttgaacccaggaggttgcagtgagcagagatcgtgccactgcattccatactgggcgacagagtgagactccatctcaaaaaaaaaaaaaaaaagaagaagaagaaaattgaaagacccaaaaatatataccaatttatgacatgtcattttgtggagtctcagcacttactcgtcatttagtgattccctcatcctgcccagaaaggagagatttcttcagcactggtgattggtaaaactcttcttcctcccacggtttcaacgaagactcatgcctgggtccagttaaccaggagggaagtttctctgtgagggctctggagaagaaatccttccgactgaaggcttaatattattattaaccattacccttaaaaatgttccaccatgaagagcaaaccccgtaagtagaataatggaagcattagccatatctaagcagaccttctgagggtctctgctatattcttttgcatcaacaggtggccactcactaatgtttaagtggaccaggttatgttgtgagttattctaaatgtgtaaattgggagcatttgtaacaaggatatatatatgtgctatgcttctttttagataattttgttgtgtaataaagttatggggaaacagccagtttcaaaatccttggaagcttttatccatttggagggaattttatttcaaaatcactttgtaacttaaattgctccaaaaacattttaccctctaatgcccagtgtgtttttaaaatggaatggccaatgtgcccaccaaacctcttccatggaaggttgatgagattactctgtaatctcatctggctaaacactgctcacacacacactattgggttgtcagatcaaatacaggccacccaatacaatttgaatttcagatcaacaacagacaacttttaatataaatattttttaaattgcatggcaaatatttttactaaaaaattattcattgtttatctgaaactcaaatttaactggcatcttgtatttttatttgctaaatctgacaactttacccaaagaaaacatctgaatctctgacagtcctcagcatctctcaccaccctcaccatcttcattccattcctaatttaagcctagtcttcaaagttaaattggaatataaattaatactaacaaacaaaatttggtattacagaggattggcattaaagagaattaaaaaatacagttgccactggcctgaaaaatagggaattaaaacaacttttaagaaatttaggtatgcaaactagatcataaacatgctcattttcaaaaacttctgccataattaatgtgtaaaactttatacaattgaaacctagaatgttttaagtgctcaagccagaagaagataaagtatcttctaaattcttgaaatcagtcaatactatggtcacattttattctgatatttgtactaatttgatgtgatttcttaaaatcacctaattcattctctctctctctttctctctctccctctagttacctaaacaagaataaatacctgacagttattgacaaagatgcatttggaggagtatacagtggaccaagcttgctgtgagtaagacatacaaaagaatattttagtctttttttttctttttttttttttggaataaatggagacattaaggggagaatcttatgttcaagggtagaaaatgttgctgtctcgggtaaaggcttctgcaagtccctcttttcctggctgtataggctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaataaaaacattttttaaacagcatgaaaacatacctatttgtgcatttcctttgatttacacccccacatccaatcagtgatcaggttctattgattctgcttccctgaagcctctgtatcattgccaccttcctcattcccttggttttgcctcagtttagaatctcatcattgagcatccactctagtccttgccaaagtggatcacaggccgggcacagtgtctcacacctgtaatcccagcactttgggaggccgaggcgggcagatcacgaggtcaggcgatcgagaccatcctggctaacatggtgaaaccctgtctccactaaaaatacaaaaaattagctgggcgtagtggcgggtgcctgtagtcccagctacttgggaggccgaggcaggagaatggcatgaacccaggaggaggagcttgcagcgagcccagatcgtgccactgcactccagcctggacgacagagcgagagtctgtctcaaaaaacaacaaaaacaaaaacaaaacaaaacaaaaaaacaaagtggaacacagcaccgtagagatacacaagataatctgttaggggcgagaggaaatattagaggttctatttatacttatttttaaataagaacaaattaagttttattaatcttttatttatagatagccactgtccctcaggtgtcaggtaggggtggatgcctcctagagaagggtgagtgatccacagtcctgagcactggataccttcactctttcacctttaacaatgttatttcactttcagactgaatgcacccagtgcatttaaggtcctgttctcttaacacatacgctccatccaaataagaggtcagagtgatcttgaaaatctgctgtgccacgtgggggttactgttaattcatggcaaagtacttaaaattattatgcatttttctttttacaagaagacaagtggggaaaaaatgtattaaccttttctgtgataaagtccctgtcagtaatttttaacctggaagatatttttcaataacacttttatatctgcttcttcaagattaaggtactacttcgccaagtaataagaaaagtcattgctttttcaaagaaatgtatgctttagagaaaggctttagaaacaggtatttggaaatattcacatattatgcgattttcctgataaaaaattgtcaatgccataaaaattctgtttggttcaaatcagaaatagaattttaacttgtttttaaatctttcaaattaagtttgttatgaactaaattgtatctgtcttcctaaattcaaatgctgaagccttaacctctagcatcttagtatgtgactgtatttgaagatagggtctgtaaagaggtaattaaattaaaataaggctgttaggtgagccctaatccaatctgacaggtggcctcataagacaaggagattgggatacacagagagacaccagggatgggcgctcacagaggaaaggccacgtgaggccacagcaagaaggtggccatctgcaagccagggagagaggcctcaggagaagccaaacttgctgacactttgatcttggacttgcagcctccagaactgtaagaaaatacatttctgttgtttaaatcagccaatctgtggtattttgttaccatagctctagcaaagtaatacagagttgtagcaggtttaaaatccatgtgtataaaatgtgaaaatgaaacacctccagatcaccttgcaaaaacaactgattgacatcagaaaatataaaatttcattaaaaacatgtatttaattactgaattagattgaaaaatgagaatcttagtttaataaatgcagttaagcctgctctattcttggtgaaacacccatctttggtaattttttcaactaggacggccatttaaaccaaaatcaaaataaactgaaccaaaagcagactttgaacagccatagccaaaagggttaaaaataattttcaaaactaattaagcatatttgataacattgcttttgcttttatgaaactttaaaaaatatatattacttatcttcattgcattattttaaaatgtatgtttagtgtgttatggtatatattatatagtattacaaaaatacatgtatagggttcatgactgttcatatgttagtggtacatactcagatattttttacttattaatatgtgagattgaaagaatttgaagaccaatagtgtagaccagaaccactcaaagtgagttcattacaaggtaagtggctgtccaggatatacagcaaagcacagcttcttttttggagaaaatcttgtcatgaaaataaagtcaaccaaactcaacagtgtgtttagttgaagtagctggcttacatccagcatacgcttcttatccttggaatggtaagaagctattggccaatgggcaccatacgttgagtagcagtagtctagatgattagcgtctccaaatctggctcctgcctttatttagtcttggttcctctcaaatccaccctccccaaacctctttgggttcacatgcaaatagaatcttaaacccaatactggcctcccattcccctcaggatagaggtcttggtgtggcttgcaaggcattgccataatcttcagctttgtcttttacactactttacgcctctgatcaatggtccatccatatcgaacctcttagctcccttaattctccaacctacttacactgttatgctaaactcttactcttcctactgtctggaaaaccctgctataatcttgtctttctgatgagcacctgctggcattttaattctgccttagagggcagaattgtatttccacaattctggttcatattataatgcccaaaacacagtatgagcttaataaatatttgtgaaattaatatggtacccaataaataattaaagcactcttctgtaaacattatagcacttaaagagcaatcatattttaaagatattttagtctgttgtcctcaagggaatgtgtccatttctacttctttggaagtggtcaattaaactacctgcttgtactgcctcgaagttgttttttatatttatggcaagattttctacaagactctcccaccaagttaagaggatttgtgaaactgcctgaaaatgctttccctgcctcttggtggcattccaggttgtggaaagtgacaaagatgaggagttatacctggagttgactcccagccccatcacttactaactgtaagacccaagtctcagttttctcatctgtcgaaacaggataaagtaagctaataaagtttaaataagataataaaggaactaaatatatcctcaataatgttagacattattatgattattttcacttcttcctgaactttgacacttcattattctgatctgttgtaacctctctgatcactccttccccatttctctccttagctcactgcatcattcctcaaaatggggttccatcctgggtcctggctctttttcctctatatcttctcctttggttaaatcatctgctcacaagtatcatgagaatgtgaatgatttctaagtttagggcctcataccttagctcttatttggccattcacccagctgaaattcttttcttgctccctctcattcctatccaatcccaacaatctggttaaactctccctagccagcctttgaaaatgtacaataagcatttactgatgagaacttgctaagcttgggattcttcactgggaactaccagtaggggagggtcactacattaaagaacagtgagtgaaaagcctcatcaagaaggtggcaattcagaaaatatctgaaagaaacaaagggacaagcctggggacaatctgaagaaagagcattttagacaagtgcaaagacccccaggtgagaatatacctggcacgtttgaggaatagcaaggaggccattgccgctcaaacagagtaaagtaaacgggggaaaaagtaaaagctgtgatcaaaaagatgatagggttgaggagcaacttgcagatggtcttagaggccatcatcaggtcttttgatttgctctttagatagaggggaagccataggagcattttgagcataggtgtgtcacagtctgactcaaagtttcacaggaacatgccggctgttgtgttgaaaataaactgtagggaaccaagtatggaagcaagaagaccacttaggaatatgccaaaataatataggcatgagatgaaagtagtttgcactaagacagcagcagtagagatgatgagaaataatctgatcctgactatattttttaaggtaaagccaacaggacatgctgatggatcggatatagcagatgatgagagaaacgaaggaatcaaggagaactgtaattatttttgactgagcagttaggagaatgagatcactatttcctgagataggggaagttagtttgaggtcccatgatgcatgcaggcaggcagtgatatatgtgggttcaaaagtcacaataggggtcagggctagagatatatttgagactctttggaatgtagctggtgatgaggggatacaggtatagaagaaatctcaaaaaatgaatagaattgagacttctgaactttccccaccaatgtgatttccctgatctttttttaaacaacattaaaatgacagtacttctgagaaaatataaatacattaaaaagcatgtatttttaatgacaaagagtaggaaaggtgatcatgtgagtaaatgatgaatgtcttcaaaaaccaagagagagctgcacgctaagtacttgcatgggtgaaatcaataaaatgcaagctaattcaaatcacaaaatctag

SEQ ID NO: 27 - DNA, 80334 bp, Homo sapiens
aatgacagcatgaaagccttagtatgcacctgtttctgtaacataaccctatatctgaacccaccctacacctccagcatgtaatgccctgcaatactgagtccaagaagcccctcaaatttagtgatacctcaagactgagaccacaaatcctgtagacagtagggccttccctgaataccaagcactccctagtctttctcatgattaggttctcactctcacactaaggtcactccttttttctgcccaggcatacattttatcttctctgaggagggaagggagtagatggggatgctgaaaagcactttaatttgagcagttcttgccatatctttgcccctcatgtgaaaacttctcagccatggaactaacttgttcccatacccactctcatagcacagtcaccctccacccccattcatccacacccctgacatttactcacttcgcccatggcagagaccgtactggccatgctctctgcacagccctggaaagcctcttgtttctagtcactaggagagaaggtccagtctcccagcacacacttcttatctggatgtctctcattgtgagggactgggaggtctgtaggcctacctcagcctgattctggccctatctagtgaagcactcagtgatctcttgcgcccccctctggcctcagttctttagcggttgctacagcaagtggtctagttgggcctgcacttccaagtcagacccatagagggcaaccacttgccagtttatgagaaatcactctgggtgtggcctctccctttgttcacttccttttcagtgcttgtaaaattctagaaccacaggctgtcagaatcagagggtgtgtttagataacttatatttgaatatcctcatgataaagatagagaaacaggcccagagaagagatgagaccagtctaaactcagacagtgattcactctgtggcagttagggctagaatccacgtttcctgaatgccagttcagaacttttgaaacacacggccaagcatctaacccaaatgcctcattttatagttgtgaaaactgaggccccggaaagaagttgactaaggttgtacagtcgttgtgatagagctaggactcaaacccaggtcttctgaatcccagtccagattcagaaacataatgttaggcatctagttcatcctgttggtttttttttttctttatagatgaaaagagttcagagagggaatctaatttacctgaagccacagagtaaattagtgaaaatcagaaccggagcccaaggctggctgtagaactgggactgaatggaaactggggactctgacttctagtctccaagaaacctcaataacttagggaccccagtgtcttggaattaaataacagaggtagggatgcagtccttgcttaagctgactatgaatgaatccccaggaggctggaatctggggcatagtgtgtacgtgtgtgtgtttgggagggagggagtctgctctggtcccctccaaaaaactcttaagaaaagactcacctcatttctcccctttcaaggcctctggctttgagagtgagaagatgactcactcattgcccacagttgccgctgagaacataattgctagctgggacatcaccacagcatccagccatcacatttgcagagtagtgtcttgttttgtcaaagctctttcctatttttctttttctttttttttttttatttcagcttcctcaagctccagggagccagatgaggcagataccattacctcttcttttataaagaagaaactcatttatggaggggtggggggaatgaggggggacctgaactggtgttggactgactgagactaaatccccagtcctctgatttccagctttctggagtgtctgcataaatacccagagtcccagaggagacagcagtgtccctcaaatgcctgatgacagctcctccctcatttattaatcactgagctggggccagatactgtactgggctttcattggagacaaaggtgacagaaaccctgcctttaagtgttcacaatctggatattgattaagtcaccactctgcccatttcaatcctcagctttctcttcttctactagaaaaataactccaacagtgctttattttattttatttatttcttatacatttatttgagacagagtctcattctgttccccaggctacagtgcagaacttggtcacagctcactgaagcctcaacctcctgggctcaagtgatcctctcactttagcctcttctgagtagctaggaccaccatgcttggcttttcttttctttctttctttttttttttttgagacagcatcccactatgttgcccagcctggtctcaaactccaggactccagtgatcctcccacctcggcctcccaaagcactgggattacagatgtgagccacctggcccagccttgttttattatttttgagacagggtctggccctatagtccaagctggagtccagtggtgtgatcacagttcactgcagcctcaacctcctgagctctggtgattctcccacctcgccctccctagtagctgggaccacaggcatgcaacaccatgcccagctaatttttaattttttttgtagagatggggttttgctatgtggcctagactggtcttaaactcctaggctcaagcgatcttcctacctcggcctcccaaagtgttgggattacaggtgtgagccaccatgcccagtccaatagtgctttttggctggagacattgaatcaattttataaccttttcagagattgattaggagtcagaacactaacattctagttccagttctgttacttcactgtgtaatagtgagctagtcctttcctatgcatgggcttcagttttcacatctgcaaaatgattttgtgggatggggtcagaagacagtaggaatatagtttctaagaacttctggctcagatcatttaggagatgaagacactttgtaatctgtgggcagtgttgtttctttgggtaaaaggctggagggtaggagcccgctgggcctgttatgagacctttcatcctgctgtcttcctccttaactttgtgaggtacccttcccaaggagcagggaacttgggctttctgaaaacctcagagggaccccatttctacctctccttaccagcaacactcaggaagcaccagaactattttggattggaagttatttagccagattctgaggttgaagttcatgaaacagagacagaatcagagaaggagaagagagaggcataaaggaagaggcaaagagacagagaaaagaaagaaagaggtggggtcggggggaagagggaaagactaaagaggaaaaaatggaggagagataaaaatagagagcaggaattagagacagacagaaacagacagagacaggaagaaaaagaaagaaacacagagagagaaacagaagagagaaagaaacagagaagggaagaggagagaggagagaaaaacaggggaaaagagacagaaacaaggaaagacagagagagagaaaaaatatgaatgaatatgataatatgatagtggacatacctagtcccaggcagccgcatgagagaagttgcataaaatcctacgtcttgaataggatctagaagtgaaagaacccttgaaaaaatcgaggccagagagcaattgagctttgttcatagtcacacagcaagctggtggaagtgccaggactcaaacccaagactaggatagagtagttcaaaacagactggcctgagagtctagaggtcttgaggtttgtcagtctgtctttgagggactgcgggcaatgtaataacacaggaagagtgccagcacattgtctgctgcagaagaggcactggcatcagggagttttgccctcttcccccatcagctttcctctgaggacgaagacatacaacatacatgcatgcctattaaggctgactagggtaagtttggttctattacacagcacttttgggagattagaggcagacttcatggaggaggtgacttgtgggtcagggcttgaaggatgaaaacaacaaccaaaattttagttgcggctgggcatgctggctcacgccggtaatcccggcactttgggaggctgaggagggtggattacctgaggtcaggaattcgagaccagcctagccaacatggtgaaaactgtgtctactaaaaattaaaaaaaaaaaaaaattaactggggatggtaacacgagcctgtagtcccagctactgggaaggctgaggcagaagaatcacttgaacctgggaggcagaggttgcagtgagccgggattgcaccattgcattacagcctaggaaacaagagcaaaactccgtctcaaaaaaaaaaataataatttcaaagatgcacttattctttaaaaaaattcaaagtaaggctgggtgcagtggctcacgcccataatcccagcactttgggaggctgaggcgggcagatcatgaggtcaagagatcgagaccatcctggccaacatggtgaaacctcatctctactaaaaatacaaaaattagctgggcgtagtggcatgtgcctgtagtcccaactactcggtaggctgaggcaggagaatcacttgaacccgtaaggcggaggttgcagtgagccgagatagcgccatgacactccattgtgggtgacagagcgagactccatcttaaaaaataatattcaaagtaggtaggattttgataggtgcagaactgggtggttctagttcaagggaatagcacaaggggtaggagtgcttgaagaggacatgaataggcagctaagcaaggtgtcatctgccttctggagggcagagggcatgaaaaaggggtcccagattttggtcaccccatgaatgacaggtgtctgggttggcttgtgatgacagtgaggaggaaagggaggcttttgagaagggatgcagtaagaacagggttgagttctatgaagattccctctggcaggcagccctatggaggatggattggagaaaagatactgacatcagggagccgtgacagatctttgctgttgtccaggtgacagataggtaataagaatctgatgtggtgtggtgggggtgggtatagatgcagtggttttgggggtggctttctaagtttcctttagagaaaacataggatctgaatttggaccattgttgggggactaaggagagagatgagcagagggccaaaaagcagccacccaaaattccagacaggtagctgtcttttcctagcttatgattggagtgtgtgtgtctttttaaaaatttctgttggctgctctgagagtttgtgtgtctcccaatgttcgtgagcaacctcctgcatatgcatctgtgtatggatgtgcgtctccaggcgtctaaatgcgtctgtaccttcctctgtgcgtgtttcacctaatccatgctgtggttaaactgatcggctaaaggaatgacttcacattgcttcatgcatcttaaagtgcaggaataagcatctttgctcccaaacgtgcttctaaattgtgtttgctaagctaggctgtggtgcatttgattgactaaaagagctattccgaattgcctgtgctctgtggcatagctacagcttgaaatcctattactgctggctacaggaattaccataatgtgtttggcttgattttccagacaataatttaggaccttgccacctctctatgcagatctacacagctaaatgagaagcggaactgggaatcttttttgcaaacaaaactctggcccattaagaactctctgctgccttgtgaaggtaatagggaggggaatgcagtcttaaaggaccccacaaccctgattatggtttgattttgcccagagacagagatatggagtccacataggcttaaggtctcttacagaatttagaccattttttttcattttatttccattccagcctgtgaaatggcgagtgttctcatcatgctttcttctctttctcaagagccgtcagctctaccaagcacagtaagctctcaataagtatttattgccttgaaattgaattatagctgtctaagccaaaacccagagaaaaggagaaatttattcaagatctcacagaggaatttgaacttgaatcctggtttctggatttcctgtcaagaactcttgcaaaaatgtcatcctgccttgtgatagctcaggttcagacctctggcagtggagggcttatactgctctgaccaacgtgtgactgggtctagtctctttacccctctgggcctcagtgctctcatctgcactgtgtgaagattaggctacaaggtattcagagggcctttctagttctgctcctaggaatctgtgaccaacactgagaatataaacctgtgggcccttgggtggggtgaggaggggaggaagcagttggggcctgcctcataagctgtgtgtcacaccttcctccctctcccctgactccaaatctccattaaaagaagtagaataacttttccggtttgggaaatcattctctgacccaaaagccattgggcctctggaaagtgggacagcgtgtccagcccacagcctctaaatgccttatagggctagaaaggccacggtggctggctgggcgggtgggaaatggttggcttggagaagctccccatttctggaagatctaaccctggtggggaagggaggtgactgccacttagccctggcaggttgacaggctgggctgaaccagtgtgttctggaaaggccaggaatgatgtcatgggacactttgggctgcaacaacaggaaaccactgagtgtttacattggctctcagagctcaggcagcctgttttttcttcacttcctcagtctatctgtttcctctgattcaaatactatgaagagggactcattgcccaggccagggaaagtggaaaggaggcccaagaagaaagagcctccttcccagcccagaatgtcagatgcttgggagggaaggccagctttaccctagctgggcccctgccaagaatagatcttagggtagggaagcaagacagttagggcctactctgagcgttctacagctccatggatagcaacttcaaacttcttccaaagacccaagttctaaacttggaagccatcttgtattctcttcagatctaatcagttaccaaatcttgttaattaaatctaattgattccattttaaccaacagtggatttgtgtgcaaactgctgtgttgtgctgtctgtgtgtggcaggggagacaacacaggtagtgggtgacatacaaagataaaagagttcttgccctcagggaattaatgatagagtgacagagtaacagtaggatgtcctccatctgtttccatctcttcatctccaaggctgctgctccagttcaggaacacccatcatttcccagctgtatgcaacagtcttttaatgggcctccctgtttccagtctttcccctcccatgcttccttcataattatattgaagtgactccgatataattatggaggaatgctctccagctccactctccagctccactctccagctccactctccagctccacgctctctcatcaagcctcctagatggtgtggcagggtggctttgagttttgtctcggtgtcaggcagacctgggtttgagtgggtaccttaccattcactattggctgtgtgacagtgggcagtggctttgcttttccaaacagctatttgtctagctttagcttctttattgacaaaatgaagataaattctacctcacggggctgttgtgagaattaaatgaaataatgtatgtatggtgccccatacagagttaacacttgataaatggcagttctaattaccatgcctcagatgtgtcatgttcatttctatctcagctcctttatgccatctgaaacaggctcctttctcttaaagactactgtaactggtaggaaccttagagaccatatagaggagtctgattacccctactgaggccagggaggggaaacaacgtgctcaaggttacacagaaagtgaattccagatcaggtgcagtggctcacacctgtaatcccagcactttgggaggccaaggtgggtggatcacctgacatctggagttctagaccagcctggcgaacatggtgaaacctcgtctctactaaaaatacaaaaattatttgggcgagatggtgggtgcctgtaatcccagctactcaggaggctgaggcaggagaatcacttgaagttgggaggtgtaggttgcagcaagctgagatcacgccactgcacttcagcctatagtgtgacaagagcaaaactccatctcaaaaaacaaaagaaagaaaatgaattccagaaccacaactaaaacactttacaaatgttaactcattttatcttaacagcagccctgtaaggtcggtagtaggggtagtatgtactattattagatccatttaatagatgaaaggacaggctcagataggttaggtaacttgcctaaggtcatgcacctggaaatgacagatccaggttatgaatctaagtagtctgacctcaagcagctgagcacttgaaatgtgattactgtgactaaggaatttaatttctaataataatttattttaataaatctaaagttaaaatgtaatagccacttgaagctaatggctaccatgttggacaggatggttctagattatagggcttcttcagactccggaagaataagagccatatctaataaacttttatgtcattacagtgcccagcactgtgcatgacatatctaccattatgttcaaattcagttatgttagcaggctcttgtgatccaggcaaaaagtgagcctacaatatagtagtcacagtcaagagggacagaagggaacatatttgagagatcattattaacaacgtggtagtcacagtcaagagagacagaaggggacatatttgagagatcattgttatcactatcaccatcatcaccattatcatagtaaaattaataggtaattaagtacttatgtgccaggcaactggtttaggtgctttacatagattaattcatttgattcttacaacaactttatgaagtaggcttaggtaccattaccatcattcccattttgcaggtaagggaatgaggcacagaaagttgaagtgactagtaagttgcagagccaggatataagccaaggcaggctggttttagaaaccaatgtcttaacaactactctatatcatgcactggagcagaggacagatgtccagggagcaatatgacagctttggtttggttcatggtagggttgtggtgcacgtgggatgtccagagggagatagccagtagatggctggccatgtgggtttcaagctcagagaagagtgcagggttagagatagaatatttgaaatcatcagcataaagatggcagttgaagccacaggaaaccatgtcatcccacagggaaagtgtgcggtgttaatagaggttaggaaacactatgcatcaacataaaggagggattctctgatagtggatttcaggtagaatgaataggctccttctgaaggtggcagcagatcagaaataagcatagggaacaagaagggcagagaaagggattgaactaaacatctttcccccaaatctgctcttctctagtggtctctacctcagtgaatggctccaccatcaacataattggacaaacccagaacctggggatcacctctaactcttccatctccttcacctgtcatattcaatctattatcaaagtccattggctcttttcaaaatttatcctgaacctaacctcttctgcccacctccaccaccactacccttgtctaagccatcatcacacttcacctatatgactgaagtggcctccttcctggtctccctgcttccatacttacctccctacagtcaatgctcaacccagcattcagagtgatcatgttaaaaacaaaagtcggtttatgtcattcctctgttcgcacctagcccatggcttctccagcacactcaggacttacaatcctattaaagatgcctcagcctctgtcctgggctccagattaatgtttgacatctccatgtgataaattaccatttgataatttgacatctccatttggtttgacctttccgtttggtaaattaccatttggtaaattctccatttaccactggtaaatcaaagacagccaaaacagaacattgccactccaaagcttgttcctacacaatctttcctgccaaagaaacatggcaccatcatccacccaggtagcaagccagaaatctaagcgttagctttgcctcctctttcttattacccctaaccattcagcctatcggcaagtcctgctacactcagaatatatccctaacacatccacctctctcttcatttacttcccaccaatccagtccaagtccctatcatctgtcaactggatgacttgccctagcctccttacaggtctcctggcttctacccttgccccctacaacccattctttacaataaatccagaagaatctttgtaaaacatagatcatgctaatcccctgcatgaaactctccagtgtctttccatcacatgaggaccacaagccaaattttttgctatagcccaaaagagcctacatgatctagtccctgcaaatgtttccaactccttctcctactactcactccttttctcaccgtgattcagccactctgatcatttttctggtatttgaacagctcaaacccatcaccacctcctctccttactaatcacctgattcactccttcctcaggcatcagctcagatattcactggctctgagagactcttttccatatcccagactaagaaattccttctgtgtgtcactctcacagcatcccgtcattctccttcacagcgttaagcctaggttcaatcgttaatttcattaattgattaatcaatcaatttttgagacagggtcttgctgtgtcccccatgctggagtgcagtggcatgatcacagctcactgcagccttgacctcccaggctcaagcgatccttctacctcagcttcctgagtgactgggtctacaagtatgcaccaccataccgaggattttttttgttttttgtttgtttttatgtttttttttttttgagacagagtctcgctctgtcaccaggctggagtgcagtggcatgatcttggctcactgcaacctccgcctcctgggttcaagcaattctctgcctcagcctcccgagtagctgggattacaggcgcccaccaccatgcccggctaatttttggatttttagtagagatggggtttcaccatcttggccaggcaggtcttgatctcctgacctcgtgatccacccgcttcagcctcccaaagtactgggattacaggtgtgagccaccacacccggcctgtttttatgttttgagacagagtcttgctctgttccccagaccggagtacagtggtacaatctcggctcactgcaatctccaccttccaggttcaagctattctcctgcctcagcttcctgggtagctgggactacaggcatgtgccaccatgcccagctaatttttgtatttttagtagacgaggttttgccatgttggccaggctagtttcaaactcctgaactcaagcagttctcctgccttggcttctcaaagtgctaggattacaggtatgagccactgagcccaggctgatcatcaatttaattactagattgtaacctccatgagaacagggactgtccatcgtagaattctgtcccatatgcctaacacagtagctgcaatatagtattaattcatttgcttattcattcatgcaaaactatttatcaaacagtcactatttgcaagttactgttctaggagcttgaggtacaaaacagacataaatgacttgccttcatggagcttatattccagtgggtcacacactgagtggcaggaattatatttgatatttattggatctgtgatattaagcctgagtagaactgtattacttagtttattcatttattcaacaaacatctaatgagtattttcaatggaccaggtattttatacatcttttcatttaatccgtgaaataaccctgtgagagagatatcactagccccatttctaagagagagaaattgaggcgagagaagtttagcaacttgccttaggttaagtagtaagcagtcaagtgcatgtagtttgaccacaaagcttgccagcttactcatcacactataacatactgcttttgacaagtcagttctggctctaaaatgatacaaaggaacccctgcagggcctctgacccagagggagatcttgagaaaatgaagctatggagaaaactcccagcctacaccaagcctgatataaccccgatgtactctccattccttgtggtgatagagtagacctcataactgggtttcctttgacagatggggaaaatagagacacagggtcagggaaggagtcacccaaaggcacatttagcagtgaagaaagaccctggcatccttgtattcatgatatcatagaataaggcactgagagttaacttcaggaaggagaccagtggtggtggctacagaacaagtacccaattgtcaatcttaagcctgggttcttgggtaaggtcctgtctccatgcctttatgtgaacccaggaggtctttgctattccagaccattccctgccctcacttccaattctgccctatcctgagccaaatgtttgaaagacaggaggcaggggacatggttctggggctcaacctctcccaccataaaggcaaatataaggaaaagtcactgggcgtggtgacacatgcttgtaattgttgctactcaggaggttgaggcaggaggatcacttgagcccaagtgatctgcccaagtgagcccaagactctgtctcaattaaaattaagaaataaaaagatacaaggaaatgtattcaacactgaaagggaggcagggtgcaagggcaggtggaaaggggcatagccctaccagactgcccttccctgaggtgcaggacaaagctctgtctgtgtagtcatctctgcgaactgattccaaatgccacggtgtggggcagacaaacaaggaaagggggtgggaaggatttacaatctttggatatgggctgggcagagcctgtcagtcggtatgagactgtgtgtgagttaaatgaagacagttttgcatggagacagggcaggcctgggagaggaggagaaagggaggagcatgaggcagggtgagtgaagaacctctgtacccagttttgttgctagaacacagttgtgactgtgtatttctaggagatgtgttcatacctgagtgggtaggtggaaggtagggcttatttatgcaaggcccatgcaggaatatgtgtatgtgaggtgtgtgtgtgtgtgtgtgtatgcgaagtgtcaggggagggaaagttgtgggtgtcagtgtccttgtaaagtcagtctggatgtgcatttcagtttttgtgtggaatgcaagaaacacaggatataggcaggcagtgtgtatcggggagattttatatgtgagacatgtaaggggaaaatggggctaagcatgcagtgtgtgctgagggttatggggaacattgaggtgaggtgttggcagagtacatggcatgctgtctgtgtggagtaaacaagagctttggaatggtctaagtgtaccaggcattctcagtaacctcagccatgtctctctgaacctcagcttctctgctgaaaaaggataagccccacccacatacagggttgtataaaaattcagtgagttaatcaatgagaattgtcctgctcacaataggtgctcaagaaatggttactaccatgattctggttgtgaagtgaaattgccaacacctgagacagagctcattaaatgtctaccaaactgaagaataaatgacttcttggtttggttttgcctgcttaacaccaaaaagccaattggtaacttaactggggcttgtattagctcattattttttattcatttatattttattttttattatatttatagctccagggctctcaatgagagccctggagctatatatacaaagtccctgaaggtgttggtggggagtagggaagggaagagattgttggaaagccaatcagacaggcctgggcaaaaaccaggggaagaggccaagaacactctatgcacccaaggaactgagtcaaggagaagtaaaagccagtgaagtgtccagaatgcaaggggatatagggtttccatgcctaccctgggctccgttattccaaggcagctcttgagtttaaggctcaggcctgcccagaacaaggcaaaattgacctcttaaagagcagaggaaagggaggggcagagactgcttgtacaggaaatgcccattgctatgaacttgatcacatataaagcacgtagctctacaacctagtctctagggcttgacccaagccagggctcagcaagtggtcatggagaacagaagccacatagtcccagggccataacagtattaaggataaagagtagatttcctggccaggcgcggtggctcatgtctgtaatcccagcactttgggaggccaaggtgggcggataatgaggtcaggagatcaagaccatcctggctaacacggtgaaaccccatctctactaaaaatacaaaaaattagccgggcgtggtggcatgtgcctgtagtcccagctacctgggaggttgaggcaggagaatcactcgaacccgggaggcagaggttgcaatgagctgagatcacaccactgcattccagcctgggtgacagagcaagactccacctaaaaaaaaaaaagtagatttcctgacaacttatttgtgtgtatgttgtctgtctcctctcactagaatattcttcactactattttcccggtacctagacctagcatggagtaggtacttcataaatggttacaatagattatagccataagaattatatttattgtacccgttattaccattttttcctttttggtatttttttaactgtggcaaaatacatatcacaaaattttccaacttaaccattttcaagtgttcaattcagtggctttaattacattcacagtgttgtgcaaccatcaccacttatctatttctgaaacgttttcatcaacccaaacggaaactctgtaaccattaagcaataacttcctactccctgcctccctcctgtccctggtaacttctaatctactttctgtctgtatgaatttgcccattttgaatatttcatataagtgtctttatataatatttgtccttttgtttttggcttatttcattaacaatgttttcaaggctcattcacattacagcatatataagaacttcattccttttaacaaatgaataatattccattgtatgtatataccgtattttatttatccattgatctgttgatggacatatgagttgtttccatattttggctattgtgaataatgctgcagtgaacattggcatacaggtatctgtttgaatacctgttttaaattcttttgggtgtataccaaggagtggaattgctgggtcatatggtaattctatgtttaactttttgaggaactgccaaactgcttcccatagcatctgcaccattttgcattattactaacaatgtatgaaacttagaatttccccacaacttttcaacatttactttctattcttttttaaagcttttaatacttgtttatttttaactgtagcaaaatacacttaacatgccactgcactccagtgtgggtgacagagtgagactcctcaaaaacaaatacacataacataaaatttaccattttaacaatttgtagatttacaattctgtagtgttaagcatattcacattgttatataaccaatctccagaactcttttcatcttgcaaaattgaaattctatacccattaaacaacaactcctcattttgcccttccaccaggcctagggaaaccataatttttctttctgtctcaatgaatttgactacttcaggtacctcatacaagttaaattatacagtttcttccatccttcctttctttctttctttctttctatttttttttttttttggagtcttgctgtctcatccaggctggcgtgcagtggcacaatcttggctcactgcaacctccgcctcccaggttcaagcgattctcctgcctcagcctcccaagtagctgcgattacaggtgtgtgccaccatgcccagctaatttttgtatttttagtagagacggaatttcaccatgttgcccaggctgatctcaaacttttgacctcaggtgatccacccacctcggcctcccaaagtgcggggattacaggtgtgagccactgtgcctggccagtatcagtatttctgtgactggtttatttcacttagcataatgtcctcaagcttcatccatgttgtagcttgtgtcaaaatttccttcccttgtaaggctgaataatattccattgtatgtctatacaacatttagtatatttcattcatcctttgatggacacttgggttgcttctacctttcagctattttgaacaatgctgctgtgaacttgggtgtatgagtatctctttgagaccctgctttcaattactttgagtatatacccaggattgaaatttccagatcacatggtaatttggtttttaattttttgaggtattgtcatactgttttccaaagtgcctgtaccatttaatattcccaccaacagttcacagaagctccaatttctctatatcctcaccaatactccactctttttgggttatagccatcctaatggttgtgaagtggtagctcattgtgggtttgttttgcattttcctaatgactaaaaatgttgagcatatttttatgtgcttatttgatattttatatcttctttgaagaaatatctatgcaagtactttgtccattttttaaattgggttgtgctatggtttgaatgtgtccctccaaaagtgtgttggaaacttactccccaatgcaacaattgggaggtgggaggtgggacctaatgagaggtgattaggtcatgaagtgtattaacacaggagtgggtttgttattgtgggaaaaggctcattataaaaggcaagtttggtccccttttctctctctctcaccctctcttgccctctagccttccactatgtgatgacacatcaagatagccctcactagatgctagctccttaatcttggacttcgtagcctccacaagtgtaagccaatacttttctgttcctcataaattacctactctcgggtattctgttatagcagcacaaaatggactcaggttattcatctttttgttgctgagctgtagcaattctctatatattttggatactaactccttatcatatataatttgcaactattttctcccattttgtagcttgtcttttctgtttcttcgtaatggtttttttttttgtttatttttgtgaagcagggtctcgctctgtcacccaagctggagtgcagtgttgcgatcttagctcactgccacctcctcctcctgggttcaagcgatcctcctgcctcagcttctcaagtagctaggactacagacacatgcccccacacccagctaatttctgtatttttagtagagatggggtttcaccatgttagccagactggtctcaagtgattcccccgcctcagcctccaaaagtgctaggattacaggtttgagccactgcacccgaaccatggtgttttttttttttgggggggggtacgatacaacttttttttatatatactttaagttctgggatacatgggcagaatgtgcaggtttgttacgtagatatacatatgccatggtggtttgctgcacccatcaactcgccatctacgttaggtatttctcctaatgttatccctccccttgcccccaacccccaacaggcctcagtgtgtgatgttccctgtgtccatgtgttctcattgttcaattcccacttatgagtgagaacatgctgtgtttgattttctgttcctgtgttagtttgctgagaatgatggtttccagcttcatctatgcccctgcaaaggacatgaactcattcttttttatggatgcatagtattccattgtgtatatgtgccatgttttcttcatccagtttatcattgatgggcatttgggttggttccaagtctatgctcttgcaaatagtgctgcaataaacatatgtgtgcatgtgtctttatagcagaatgatttataatactttgggaatatacccagtaatggattgctgggtcaaatggtatttctgcttctagatccttcaggaatcgccacattgtcttccacaatggttgaactaattttcactcccaccaacagtgtaaaagcatttctatttctccacatcctctacagcatctgtttcctgacgttttaatgattgccattctaactagtatgagaaggtatctcattgtggttttgatttgcatttctctaatgaccggtgatgatgatctttttttcataagtttgttgacagcacaaatgtcttcttttgagaagtatctgttcatgtcctctgctcactttttgatggggttgtttgatttttcttataaatctgtttaagttctttgtatagtctggatattagccctttgttgaatggatagattgcaaaaattttctcccattctgtaggttgcctgttcactctgatgatagtttcttttgctgtgcagaagctcgttagtttaattagatcccatttgtcaattttggcttttgttgcaattgcttttggtgttttagtcatgaagtctttgcctatgtctatgtcctgaatggtattgcctaggttttcttctagggtttttatggttttaggtcttacatttaggtccttattcatcttgagttaatctttgtataaggtgtaaggaagaggtccagtttcagttttctgcatatggctagccagttttcccaacaccatttattaaatagggaatcctttccccattgcttgtttttgtcaggtttgtcaaagatcagatggttgtagatatgtagttttatttctgagacctctgttctgttccattggtctatatatctgttttggtaccagtaccatgttgttttggttactgtagcctggtattatagtttgaagtcagcaagtgtgatgcctccagctttgttctttttgcttaggattttcttggttatacgggctctttttttcttccatataaaatttaaagtagttttttttctaattttgtggagaaagtcaatggtagcttaatggggatagcattgaagctataaattactttggacagtatggccatattcatgatattctttcttcctatccatgagcatggaatgtttttccctttgttgtgtcctcttatttccttgagcagtggtttgtaattctccttgaagaggtccttcacatcccttgtaagttgtattcctaggtattttattctcttgtagcaattgtgaatcagagttcattcatgatttgactctctgtttttttttttcttttatttatttatttattttttcttttttttttttaattatactttaagttttagggtacatgtgcacattgtgcaggttagttacaaatgtatacatgtgccatgctggtgcactgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgagttggttccaagtctttgctattgtgaataatgctacaacaaacatacgtgtgcatgtgtctttatagcagcatgatttatagtcctttgggtatatacccagtaatgggatggctgggtcaaatggtatttccagttctagatccctgaggaatcgccacactgacttccacaacggttgaactagtttacagtcccaccaacagtgtaaaagtgttcctatttctccacatcctctccaacacctgttgtttcctgactttttaatgattgccattctaacaggtgtgagatggtatctcattgtggttttgatttgcatttctctgatggccagtgatggtgagcattttttcatgtgttttttggctgcataaatgtcctcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccatgcccatgcctatgtcctgaatggtaatgcctaagttttcttctagggtttttgtggttttaggtctaacgtttaagtctttaatccatcttgaattgatttttgtataaggtgtaaggaagggatccagtttcagctttctacatatggctagccagttttcccagcaccatttattaaatagggaaccctttccccattgcttgtttttgtcaggtttgtcaaagatcagatagttgtagatatgcggcgttatttctgagggctgtgttctgttccattgatctatatctctgttttggtaccagtaccatgctgttttggttactgtagccttgtagtatagtttgaagtcaggtagtgtgatgcctctagctttgttcttttggcttaggattgctttggtgatgtgggctcttttttggttccatatgaactttaaagtggttttttccaattctgtgaagaaagtcattggtagcttgatggggatggcattgaatctgtaaattaccttgggcagtatggccattttcacgatattgattcttcctacccatgagcatggaatgttcttccatttgtttgcatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagttttttcccattcagtatgatattggctgtgggtttgtcatagatagctcttattattttgaaatacgtcccatcaatacctaatttattgagagtttttagcatgaagagttgttgaattttgtcaaaggccttttccgcatctattgagataatcatgtggtttttgtctttggctctgtttatatgctggattacatttattgatttgcatatattgaaccagccttgcctcccagggatgaagcccacttgatcatggtggataagctttttgatgtgctgctggattcggtttgccagtattttattgaggatttttgcatcaatgttcatcaaggatattggtctaaaattctctttttttgttgtgtctgtgcctggctttggtatcagaatgatgctggcctcataaaatgagttagggaggattccctctttttctattgattggaatagtttagaaggaatggtaccagttcctccttgtacctctggtagaattcgcctgtgaatccatctggtcctggactttttttggttggtaagctattgattattgccacaatttcagctcctgttattggtctattcagagattcaacttcttcctggtttagtcttgggagagtgtatgtgtccaggaatttatgcatttcttctagattttctagtttatttgcgtagaggtgtttgtagtattccctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtggacatttagtgctataaatttccctctacagactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggtattgagtgagattcttaatcctgagttctagtttgattgcactgtggtctgagagatagtttgttataatttctgttcttttacatttgctgaggatttcttcacttccaactaagtggtcagttttggaataagtgccatgtgatgctgacaaagatatatatgctgttgatttggggtggagagttctttagatgtctattaggtccgcttggtgcagagctgagttcaattcctgggtatccttgctgactttctgtcttgttgatctgtctaatgttgacagtggggtgttaaagtctcccattattaatgtgtgggagtctaagtctctttgtaggtcactcaggacttgctttatgaatcttggtgctcatgtattgggtgcatatatatttaggatagttagctcttcttgttgaattgatccctttaccattatgtaatggccttctttgtctcttttgatctttgttggtttaaagtctgttttatcagagactaggattgcaaccccttccttttttggttttccattggcttggtagatcttcctccatccttttattttgagcctatgtgtgtctctgcatgtgagatgggtttcctgaatacagcacactgttgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtcttgatggtctttatattttggcatgattttgcagtggctggtaccggttgttcctttccatgtttagtgcttccttcaggagctcttgtaaggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatcttcgtggcattctctgtatttcctgaatctgaacgttggcctgccttgctagattggggaagttctcctggataatatcctgcagagtgttttccaacttgattccattctccacatcactttcaggtacaccaatcagacgtagatttggtcttttcacatagtcccatatttcttggaggctttgttcatttctttttattcttttttctctaaacttcccttctcgcttcatttcattcatttcatcttccatcgctgataccctttcttccagttgatcgcatcggctcctgaggcttctgcattcttctcgtagttctcgagccttggttttcagctccatcagctcctttaagcacttctctgtattggttattctagttatacattcttctaaatttttttcaaagttttcaacttctttgcctttggtttgaatgtcctcccgtagctcagagcaatttgatcgtctgaagccttcttctctcagctcgtcaaagtcattctccatccagctttgttccgttgctggtgaggaactgcgttcctttggaggaggagaggtgctctgctttttagagtttccagttcttctgttccgttttttccccatctttgtggttttatctacttttggtctttgatgatggtgatgtacagatgggtttttggtgtggatgtcctttctgtttgttagttttccttttaacagagaggaccctcagctgcaggtctgttggagtacccggccgtgtgaggtgtcagtgtgcccctgctggggggtgcctcccagttaggctgctcggggatcaggggtcagggacccacgtgaggaggcaatctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggctggcctccttgatctgtggtagtctccacccagttggagcttcccggctgctttgtttacctaagcaagcctgggcaatggagggcgcccctcccccagcctcgctgccgccccgcagctccatctcagagtgctgtgctagcaaccagtgagactccgtgggcgcaggaacctccgagccaggtgcgggatacaatctcgcggtgcgccgctttccaagcccgtcggaaaagcgcagtattcgggtgggagtgacccgattttccaggtgccgtccgtcacccctttctttgactcagaaagggaactccctgaccccttgcgcttcccaagtgaggcaatgcctcgtcctgcttcgggtcgcgcacggtgcgcacacccactgacctgcgcccactgtctggcactccctagtgagatgaacccggtacctcagatggaaatgcagaaatcacccgtcttctgcgtcgcttactctgggagctgtagaccggagctgctcctattcggccatcttggctcctcctcctccatgatgttttttgatacataaaagtcttaaattttcatgaaatccaatttacctatttttttttcttttgttacttttggtttcctttccaaggatccattgtcaaatactagattatgaagattttcacttttttttttttttgagagttttacagttttaggtcttatattttggttgatacttctctgttgttgttgtttttgaggtggagtctccctctgtcgcccaggctggagtgtagtggtgtgatctcggctcacggcaacctccacctcccaggttcaagccattatcctcctgagtagctgggaatacaggtgtgtgccaccacgcctggctaattttttgtatttttagtagagatggggtttcaccgtgttagccaggatggtctcaatctcctgatcttgtgatccgcccacctcggcctcccaaagcactgggattacaggcatgagcctccgtgccctgcccagattgatactttctaaaattttagtaacgtgtgcaaacaaggttgatacattttgacttgatttttgtacatggtgtcagataagggtccaactttattcttttcatatagaagttcaattgtcctggcaccatatgttggaaaggctattctttcccccagtgaatggtttcaacatccttatcaaaaacgattagccacagatggctgcattcatttctggcctttcaattttatttcattcatctatatgtctatacttatgccagtactgcactgttttgattttagtaccttcatagtaattttagagattgagaaaaatgtcctccaactttcttcatctttttcaagattgtgttagctattcagggccccttgtagtttcacataaattttaggattaaaaaaaaattttgaggattagccttcccatttctgtaagaaaaaaacctgttggaatttgctacagattgcattaaatctgtagaccatttgagatagtattgtgttttaaaaaaatattaagccttcataccaattaacatggaatgctttttgtatatttaggttttcttaaacttatttcatcaaagtttcctagtttcagtgtacaagttgttcaactccttggttaaatttatttttagctattttattcttttagatgccattttaacagaatttctttactaatcacctttctggattctgttgaatagaaatacaagtgattttgtgtgttgacattgtaccccacaatttggctgaatttgattattagctctaatagcttttgttgtggattatttgggatttttaaatatatgggatcatgtcatctgtgaatagaggtagttttatttcttcttttcttttcttttttttttttttttgagttggagtctcactctgttgcccaggttggagtgcagtggctccatctcgacttactgcaacctctgcctcctgggttcaaacaattctcctgcctcagcctcctgagtagctgggattacaggcacctgccaccacacctggctaatttttgtattttttttggggtagatgtggggtttcaccatgttaatcaggttggtcttcaactcctagcctcaagtgatccacccttctcagcctcccaaactgctgggattacaggcatgagccacctcaccttgccttatttcttctttttcaattctgatgttttaatttctttttcttgtcttattgctctagccagaacttctagtacaattttgaatagcagtgatgaagctaggcatctttgttttttttttttttttttttttctgagacggagtttcactctgtcacccatgctggagtgcagtggcatgatttccgctcactgacacctctgcctcctgggttcaagtgattctcttgcctcagcttcctgagtggctgggattacaggtgcacacccctacacccagctagtttttgtatttttagtagagacagggttttgctatgttggccaggctgatcttgaactcctgacctcaagtctagcctcggcctcccaaagtgctgggattataggtgtgagccactgctcccagtcagcatctttgtcttgttcttgatcttaaaggggaaaagttttcagtttttcataattgagtatgttagctgtgagtttttccataaatgttctttttcatgttgagaaagtttccttttattcctagttttctgagtgtttttatcatcaaaaggtatagattttgtgaaatgcttttccagtctcaattgagaagaccatgtgggtttttcctcttccttcttattaatgtaatatattacattgattggcttttcttaggttgaatgttccttcaattcatgtgataaatcctacatgattatgatgtataatccttttaatatgtgactagatttgctttgttagtatttagttgaggacctttgcctctaaattcataagggagtttagtctgtattttttttttaacattgtatgccttcatctggctttggtattaggttaattctgtcctcaaagaatgagttagaaagtattcccccttctatttcttgaaagagtttcataagggatgttagcctgtaatttctttctttcttttttttctttcttttcttttttttttttttttacattgtatgtcttcatctggctttagtatcaggttaattctggcctcaaataatgagttataaagtattcccccttcttctattttttgaaagagtttgaaaataattggctttaattcttctttaaatatttggtagaatttggccaggcatagtggctcatgcctgtaatcccagcattttgggaggccaaggtgggcggatcacccgaggtcaggagttcaagaccagcctggcctacatggtgaaaccccgtctctactaaaaatacaaaaattacctggggcatggtggcaggcacctgtaatcccagctacttgggaggctgaggcaggagaataactggaacccgggaggcggaggttgcagtgagccaaaatcgtgccattgcactccagcctgggcgacaagagagaaactccgtctcaaaaaaaaaaaaaaaattttggaatttataagtgaaatcatctggctctggtttttcctttgttgggaggtttttcactgctattgcaatctctgcttgttataggtaggttaagattttctatttcttcttgagttgctttagggaatttttgtgtttctaggaatttgtccacttaatctaatttattcatgagcaattgtttatagtattcttttgtaataatttttatttttgcaaggctggtagtaatatctccactttcatttattattttacttactttttttgttgctgttattgttgcccaggctggagtgcaatggcttaatctcggctcactgcaacctccgcctcccgggctcaagtgactttcctgtctcagcctcccaagtagctgggattacaggcatgcaccaccacacccggctaattttgtatttttaatagagatgggggttctccatgttggtcaggctggtcttgaactcccgacctcaggtgatccacctgccttggcctcccaaagtgctgggattacagacatgagccactgtgcctggcctattttacttacttattccctctttcttctattgtcattctgtgcaaaagtttgtcaattttgttgatttttaaaaatgaaccaactttgggtttcattcattctttctactgtttttctattctccattttgtttatctccactctaatgtttattatttcctcccttctgctagttttgtgtttagtgggttttttttttttttcctcagtgggtaaagcgaagttgttgacttgagctctctctttttattttttaatgtaagcatttagaactataaatttccagtcccagctactcaggagactgaggcacaagaattgcttgaacctgagaggtagaggttgcagtgagccaagatcgcaccactgcactccagcctgggcgacagagggagactctgtcaaaaaaaaaaagaaagaagaaagaaagaaaagaaaagaaagaagaaaaaagaaagaaagaaaaagagaaagaaaaaaagaaggaaggaagaaaggaaggaaggaaggaagaaaggaaggaaggaaggaagcaagggacgaactacaaatttccctctaatcagtgtcttcactttattcccaaatttttggtatgctgtgttttcatcttcattcatctctaagtatactctaacctcctttttaatttcttctttgactcattggttgcttatgtcatttaacttccacatatttgcaaaatttccagttttcctttagttattgacttcactgcatgtggtcgaggaagatactttgtatggtttcaatgtttaaaaaatttattgggacttgttttatgacctaacatatggtctattctggagaatgtttcatttgcacttcagaagaatgtgtgttttgagaagaatatgtattctgctgttgttgaatggagtgttctatatttgttggtctagctggtttatggtgctgttcaaatcctctactttcttattcatcttctgtctatccattgtttagaatagggtattgtgtcttccactgttattttagaacagtgtatttcttccttcatttctgtcagcttatttcatattttgaggttttaactgtttgttgcacatatgtttataataattatacattattaatgaattgacccttttatcaatatataatttcattctttgtttcttgtaacagtttgttttgtttgatacatatattgccacccagctatcttttggttactatttgcatggaatgctttttctccatccttttatgttcaacctatttgtgtctttgaatataaagtgagactgttgtagacagacaacatatagttggatcatgttttctaactatcctgccaatttctgccttttgattggatgatttaatcaatttacatttaaagtgattactgatatggaagaacttacttctacctttttgctatttgatttttgtatttctttttcccttttaaataatttttatctctttattgatattaaaaatttcaaatatatatctgtcctgattttcattagtaccttgtccaagttttcctttagctgtttgaacatatttaatacagctttttttttttttttttttttgagatttagtctcactctgtcgcccgggctggagtgcagtggtgcaatctcagctcactgcaagctctgcctcccgggttcacaccattctcctgcctcagcctccccagtagctgggactacaggcatccaccaccatgcccggctaattttttgtatttttagtagagacggggtttcaccatgttagccaggatggtctcgatctcctgacattgtgatccacccgccgtggcctcccaaagtgctgggattacaggcgtgagccaccgtgcctggcctcttaaagtctttgtctcaagtccattgtctggacttccttgaggatggcttctatccatttattttgctactttcccatttttttgtatgctttgtgatttgtttttgttgaaaactgtacgtttgaatattatagtgtggtaactgtggaaatcagattctcctctttcttcagggtttgctgtttcgttgattgttgaaggctgttgtagtctgtatgtttagtaacttttccaatctatttttgcaaaggttgtatcccttgtcacgtatggtcactgaagtttctgggtttttttttaaaaagcttatgttcagctggtgttttcatagagatttccttgaattccaggagctggaaacaaaaacaaacaataaacaacaacaacaacagaaaagcaaactcttcctcctgctgaaaaacccccaaatcaaaaccaaacacctctcccagtctttgcagattgtctctgtgctgagacaatccaacacttatccaggcttacactgagcctgaagtgaatgcttagtatggtctaagttctgagttaaaataaacaaaaacaagtgcctgtgtcagtctttcaggaagcccctagagagactagaatggacttacactatgatttgtgattaatacctgctatgctattcctggaaccagggatcagggtcccacactgggaacatgggatgccactgctttaagactgccactacaccctggaggagatgggacaaggacaagtaaacacactacacaatttacttaccattttcagctgccttttttcccttttttccttgatttacttggttgttgtaaacattttgactgttttccagagttttgacaaagttggttctgacagtttctgcttgttttttgatatttctgtggagggatgagaacttgaagctgtctatactgccattttgctgcatggtctataatttttaaataagagctttattgagatttaactgacatatgtattagtccatatgtattaatacatatgtattagtccatatgtattaatacatatgtattagtccattttcatgctgctgataaagacatacctgagactgtcgagaaaaagaggtttaattggacttacaattccacatggctggggcaacctcagaatcatggcaggagacgaaaggcacttcttacatggcagtggcaagagaaaatgagagagaagcaaaagtggaaacccctgataaacccatcagatctcatgagacttttccactgtcatgaaaatatcatgggaatgaccggcccccatgattcaattacctccccctgggtcccattgtgggaattctaggagttacagttaaattgagatttgggtggggacacagccaaaccatatcattttgccccagtcccctccaaatctcatatcctcacatttcaaaaccaatcataccttcccaacagtccccaaaaatcttaactcatttcagcattaacccaaaagtccatagtccaaagtctcacctgagacaaggcaagtcccctctgcctataagcctgtacaatcaaaggcaagctagttacttcttagatacaatggtagtacaggtattgggtaaatgcaaccattccatataggagaaattggccaaaacaaggaggttacagggcccatgcaagtctgaaatccagtggggtggtcaaattttaaagctccaaaatgacctcctttgattccagttctcacatccagttcacaatgatgcaagagatgggttcccatggttttgggcagctccacccttgtggctttgcagggtacagcctccctcctggctggcattaatatctgtggcttttccaggtgcacaatgcaagctgttggtggagctaccattctggggcctggaggacggtggcccacttttcacagtgccccagtagggactctgtgtgggggctccagccccacatttccattctgcacttccctagcagaagttctctatgagggctccgccccagcagcaaacttttgcttgggcatccaggtcccatacatcttctgaaatctaggcagaggttcccaagcctcaattcttgacttctgtgcacctgcaggctcagcaccacatggaagctgccagggcttggggcttccaccctctgaagccacagcctgagctctacgttggcccctttcagccatggctggagtggctgggacacagggcaccaagtccctaggctgcacgcagctcagggaccctggggctggctcacgaaaccactttttcctcctcggccttcgggcctgtgataggaggggctgcagtgaagacctctgacatggcctggagacattttcccccatggtcttggggattaacattaggctccttgctacttatgcaaatttctgcagcaagcttcaatttgtccttaaaaaaaatgttttttttttctactgcatcatcaggcttcaaattttctgaatttttatgctgtttcctttttaaaacagaatgtttttggggaggtgcagtggatcacacctgtaatcctaacactttgggaggccgaggtgggcggatcacctgaggtcaagagtttgagaccagcctggccaacatggtgaaaccctgtctctgctaaaaatacaaaaaattagccaggcgtgatggcgggtatctatgatcctagctactcaggaggctgaggcaggagaatcgcttaaacctggaaagtggaggttgcagtcagtgagccaagatcatgccactgcactccagcctgggcaatagagcgagactccatctcaaaaaaaaaaaaaaaggaatgtttttaacagtacccaagtcacctcttgaatgctttgctgcctagaaatttcttccaccagataccctaaatcatctctctcaagttcaaagttccacaaatctctagggcaggggcaaaattccaccagtctctttgctgaaacataacaagagtcacttttgctccagttcccaacaagttcctcatcgccatctgagaccacctcagcctggaccttattgttcatatcactatcagcatttttgtcaaagccattcaacaagtctctgggaagtttcaaactttcccacattttcctgtcttcttctgagccctccaaactgttccagcctctgcctgttacccagttccaaagttgcttccacatttttgggtatcttttcagtagtgccccactctactggtatcagtttactgtattagtctgttttcatgctgctgataaagacatacccgagactgggaagagaaagaggtttaattggacttacagttccacatggctggggaggcctcagaaccatggcaggaggtgaaagacacttcttacatggtggtggcaagagcaaaatgaggaagaagcaaaagcagaaaccccagataaatccagcagatcttgtgagacttattcactatcatgagaatagcgtgggaaagactcgcccccatgattaaattacacccccaccggtccccaccacaacttgtggaaattctgggagatacaattcaagttgagatttgggtggggacacagccaaaccatatcaccatggaattcagtcttttaaagtgtacaattcactcaggcgaggtggctcacacctgtaatcctagcactttgggaggctgaggtgggccgatgacttgaggtcaggagtttgagaccagcctggccaacgtggtgaaactctgtctctacaaaaaatacaaaaattcgctgggtgtggtggtgggtgcttgtaatcccagctactcgggaggctgaggttcaagaatcgctggaacctgggaggcgggggctgcagtgagccaagattgtgccactgcactccagcctgggtgacagagcgagcctttgactcaaaaaaaaaaaaagtgtacaattcattggcttttagtgtcctcactgagttgtgtaatcatcaccactatcaaaatgtaaaacatttgtgtcaccctaaaaagaaaccctaaaggctgggtgcagtaattcacacttataatcccagcattttgggaggctgaagcaggattacttgagcccaggggtttgaaaccagcctaggcaacatagtgagagtccatttgttaaaaaataaaataaaacaaaaaagaaaatgctagctgggtatggtggtatgtacctgtaataatcccagctactggggaggctgaggtgggaagatcttttgagcccaggggctggaggatgcaatgaactatgatcgtgccgctgcattccagcctgggtgacagaatgagaccctgcctcaaaaacaaaacaaaacaagcaaacaaacaaaaaccctcaaaaaccctgcaccttttaccagtcactcccattcctttcaccctccttaccccagcgctaggcaaccactagtctactttctatctctatggatttgccttttctgaatatttcatataaatgaaatcatacattttgtggtcttttgttactgatttctttcacttggtacaattttgcatggttcatatcatatcatgtgtcaatacttccttttaaaaattttttgaaattttaattttgagataatagtagatttacatacagttgaaataaatactatagtcccctgcatttttcctcagttacctgcactcataaaatcttgcataactattgtgtaatatcacaaccaggatattgacatcgatatagtcaagatgcagaacattttcactaccacagagatctctcatgttgtcctattatagtcacacctacctcccatctacctctatatcctgcttcttttttttttttttgtctgagacagagtctcgctctgttgcccaggctggaatgcaatggcgccatgtctgctcactgcaacctccacctcccgggctcaaacaattctcctgcctcagcttcgagtagctgggattacaggcgcccaccaccatgcccggataatttttgtttttttagtagagatgggatttcaccatgttggccaggctggttttgaactcctgacctcaaatgatctgcccacctcggcctcccaaagtgatgagattacagatgtgagccaccgtgcccagccccctacatccttcttaaccgctgacaaccactattctgttttccatgcatttaattttgtcctttcaaaaatgttatatgaatggattcttacaatgtgtaatccttgagattgacttttttcactcagtatgattcttttaaagttaatccaaattgtcacctatatcaatagttcattcctttttactgctgaatagtattccatgttattgatgcaccgcagcttgtttatccattcacccactgaaggacatttgggcagtttctagtttggcgctattattattactttattttgagacagggtctcactctgttgcccatgctggagtgcagtcgcatgatcatggcgcactgcagcctcaaccttctgggctcaagtgatcctctcacctcagcctctcaagtagctgggacaagcatgtgctactacacctggctgattttttcatttttatattttgtagacatggaatcaaactaaagacccaggctcgtttcggattcctgggctcaagcaatcttcttgcctcagcatcctaaaatgttgggattacaggcatgacccaccccaccccaccatgcccagcctgggctattattaataaaacagttatgagcattcctgtacaggttttcttgtgaacagaaatgtttaatactctgggataaatgcctaaatatgcagttactgagcgatggtttgaatgtgtcccccaaaaatcatgtgttggaaacttaacccctaatgcaacagtgttggaatgtggggcctaataatagattgttaagccatgaggctggagtgaatggattaatgctgttatcgtgggagtgggctcattataaaaggggaagtttggcccccttttaccgtctcttccttaccctttatttgctcttctgccatgggatgatgcagcaagaaggcccttgccggatgctaacctctcgattttggactttcgagcctccagaaaacatgagtcaataaatttctgttcattataaatgatccaatctgtggtatgctgttgtagtagaatgaaatagactaagacatactgggtcacactgtagctgcatttctagttttataagaaactaccaaactatttttcagaatgactgtatcattttacattcccaacaacaatgtatgagtgattcagtttcttcacatccttcactgattcagttccttaaatttcttcacatcgttggtgttgtcgctgtttttttaattgtagccattctgatagctgtgtagtgatgtctctttgtatgacttgggcatatagtacctacctcagtgggactcgtgaaggttcacgtgtataaagtgtctggcacagctagataaatgttagctataattattactacatagatggagatgacatggtccctgccatcaaagtagttattatctcgtggaagacaaagatgtggaaacaaataatgttaatccagattgctaaatggaggagtcatgatccaaaaaatatgggactccagactgaagatgaaggatcattagggaggatttctcaggagaagtaatcctcagctaagccttgaaggataagttagcttagctaagcaaagggagggctggcatggattcatttcaggcagagaggacagaaagggcatattatggtagccacagatttaatatggctgtaggttagggaggtagtagtgggaataagccagagatgtagctggggaggacattgtgagggatcaagcaaggacctacttgttacaaaaaaagagtttagactttacccccatagacattggagagccacagaatccccaagggtgatatctgaccgaggtggagactttttttgcaccccttttcttcagaaatttctgcccagatgcccactggaaaggaggtgacttcttcatgggacccttggtaggctggcatgctcccttttcaagggcttctgttataaaaagctctttatgcattaggcatatttacaattcttctctaacctaccaccaaacaaagcacaaacatggccataaacacttaattaatcacatctcagttctgattaagacaataaacccagatcccagatttccattctttaattcactgccccagtgtgacctgtatttccccaggcctctcacaggctttcctgctctctcctttgtccctgctctagtgaaattcagaaaactttggcctgataaggaaacttgcattctcggactggtccgctgtaaactgggctgtgttcccttgggccagcctcttcttcctctgagccttagttgcctcatctgtatcaggaagcatgtcagccttcaatggtctaacattctctaaaggtatttgtaataataggaaggaacctttctcacacttgtatttttcgatagttcattctcacagaaatgccatgagaaccctaacatgatggatattagtctcattttattaagaaagaggctgtgtttcagaagaatggtcatgtgtccaatgtcacacatcagttcaagagcagagtatggccttgaacttactcggtccagtgtcttaccaccagaccacatccccttcttcaccttctttatcaattcctttcactcatctccttgtttcccctgactagctcccatgacccaaccaccacaccacaaaggacagtttcatgctaaaaagaatctactgctgtccagggacccaagaatccttggcctggcaaagaggactgagaagaacagtcagagagccattgaaacaggcccaggaggggggcatgtccttcccttcaccctgcactgcaacccagagccatggtggcagggccagattaaggctttagaggccctagaagaggaacagaatgtgatgctcccgtctgtatgtaatgcaaaagaaaaacaacaataagccattgaaggccaggtgcggtggctcacgcctgtaatcccagcactttgggtggccgaggtgggtggatcacctgaggtcaggagttcgagaccagcctggccaacatggtgaaaccctgtctctactaaaaatacaaaaattagctgggcccagtggcacacacctgtcatcccagccactcgggaggctgaggcaggagaatcacttgaacccgggaggcagaggttgtagtgagccgagatcgcaacactgcactccagcctaggcaacagagccagactcggtctcaaaataaaataaaaataaaaaataaaaaaaagccattgaaatcagcacaaggaagtttattaatattctgatcaccttcatgatgactaatataaaatgtttttaaatatcagataggaaagtattctcattttggggactagcttttttcgcacttgtttgagggtgactatctacacatctgcagtacatggtggatgtgagtgcctgatccacttgggctcactgctgcttgggctcacgtaccttggggccttctgtctgttatggcccctgggagccctgtcagtacccctcggacactggactccacagggaccactcccagggctcagcccaaccctccagcccaggctgttggcctgatgcaagggtttagggcaggacaaataattgaggctccttttttattctgtctttatggctcctactctcccttttcctctctgcctgtctctgactctgtatactttttcccatatctcttttttttcttgtccgctgtattctttcctattgcttagtatttctccttctttgccccagtctcttggactgtttctccttttgtcttatcctttctgtttgttgctctgcctcttgtcttttcttctctctcttacccatactccagtctctccttttgttttttgatgtctatgggtgtgtgtctcagtctcaacctctccctgtctttgtctgtctcattttctttcccatcccagagcccacagggacctttacagagggtaagctgttatatcctgggctctctctccagaagagatagaaatggtgacttagggctaaatttaaacttttcaggcctgggtgggggccctccagcagacagttaaggaaaaaggagggaaagctggtttattcagtcaggggacggagactggggtgggaacttggcaaagactgtgagttccaatgcagtcccagccctacactctctgactgaggccttgaggctatttttggaagctttcaaaatatcccagaaggcgtgtctatcccctccattcagtctgggatgccagaggattcactgaagatagcataactgaagcctgtcctgtattcttccttagcttccaccagccactgacaaaacaacagtaacgctgtccccagattgggacatcatggaagagaagagagtagtagcagcagatcatgagccatccagaaagtgggaagggatgaataacatgtgcctcaattcccaagaccccaaagtatccaagctggaagggatcctaaaggtcagctagtatcaccccttcaatatttatatgtgaaagccagagagggcgctattaatatcactccttaaatatttatatgtgaagaccagagagggcactattaatatctctcaagaaggaagggagaaaaaagaatctcttaaatccatttccttcatctctgccctagtttactctctctggagtggattgttgcaacagcttggtttctctgcctccagtttctccctgggcaatctagcttctatactggacagataaacctatcatattttcgggtggggtgcaggggagaggcagccctgactgtgtcacttctacttcaagttttcactagtttcccactacctagtggataaaatccaaaaccccttagcctgaaacataagcctatttgtgatttagcccccactcaccttttcaaacttctttcttacttgctatgtttccctttagaaccttccaaactctctaccactctcccaaactgacattctttcctctttgtctcgtcctctctcacatgcctgcaggtagaaattcaaacagcatagagaaatgaaaagcaggctgggtgtggtggctcatgcctataatcccagcaccttgggaggccgaggtggatggatcatctgaggtcaggagttcagcagctcgagaccagccagggcaacatggtgaaatcctgtctctactgaaaatacaaaaaaattagctgggcatggtggcgggcacctgtaatcctagctactcaggaggctgaggcaggagaattgcttgaacccaggaggcggaagctgtagtgagccgagatctcgctattgcactccgggctgggcaacaagagcaaaactccatctcaaaaaaaaaaaaaaaaaaaaaaaaaaaccagaaagaaagaaaagaaaagaagggccaggcgcggtggctcacgcctgtaatcccagcactttgggaggccgaggcaggcggatcacgaggtcaggagatcaagaccatcctggctaacacggtgaaaccccgtctctactaaaaatacaaaaaaaaaaaaaaaacttagctgggcatggtggtgggcacctgtagtccgctactcgggaggctgaggcaggagaatggcgtgaaaccaggaggcggagcttgcagtgagccgagatcatgccactgctctccagcctggacgacacagcaagattcggtctcaaaaaaaaaaaaaagaaagaaaagaatattaggccgggcgtggtggttcatgcctgtaatcccagcactttgggaagccaaggcaggcggatcacctgaggttgggagttcgagaccagcgtgaccaacatagagaaaccccgtctctactaaaaatacaaaattagcccggtgtggtggcacatgcctgtaatcccagctactcgggaggccgaggcaggagaatcacttgaactcaggaagtggaggttgcggtgagccgagatcatgccatcgcactccagcctgggcaacgagagcaaaactccatcttaagaaaaaaaaaaaaaaagaaaagaaagaaaagaaaagtaaaactctttaagctttccacaccctactcctatccaaagatagaccttcccacctctctgacttaatctcctactattctctgtccccaacccccaccccacagtgatccagtcataaagagcctccttgctgttcctagaacatatgagctccaccttagaacctttgtcctttgttaatttctctgtctagaattctcttttaccagatatcttgcttcttccctcagttcattcatgtctctatttatttcttttttttttaatagaggcggggtctcactatgttgcccaggctggtcttggactcctgggctcaagcgatcctcccaccttggcctccttaaagttctaggattacaggtgtgaaccaccatgcctctattgaatcgttacctttcagtgaggcattcgctgacctttcttgtctacatttgcaacgtcctccacacctccttctctgctttattatttagcacttattaccatctaacatactatacattagactgatttacttgtttattgcccgtcttcccccactagaatgtaagttccatgatggtagtgatttttcagcatggctatctccccagtacatgacagagtacctgctagatcatggattgtcaataaaaatattcattgcgtaaaattcaacaggtgataaccacaaattctgttacatatttcagattgcttctagattgtactctaatcatttgatttgcttgccctttctttggtagaacagtattttgtacttgatgtgtgctgccatacttttggcttctgtacatgctggtccctctgcctagaatgaattcctctcactgtgatctatgtggagaactcctgctcactctttaagtatttgcttaagctccatctttttgtgcttcccttccactctcccatagcatttctgctttctgccattgtatttatcactctgggccttgatagtatatttatacatctgcttcccctactaaactgtaagtaccttgaaggactaggaattattgatggtggcatctgcggttcctagcatagtacctggcatttagcaggagcagctgtaatcagaaagacctggattttggtttttttcttttttctttttcttttgagacaaagtctcactccttcacccagactgagtgcagtggcacgatctcagctcatggcaacctccacctcctgggtttaagtgatcctcccacctcagcctcccaagtagctgggattagaagtgtgcgcccatgctgggctaattttttgtatttttagaagagacagcgtttcaccatattggccaggctgatctcaaactcctgacctcaagtgatccacccgcctcagcctcccaaagtgctgggattacaggtgtgagccaccacaccctgccagaaaaacctggatatgaatccacctttgccatttcctagtgtgatcttcagcaagttacttcacttcctgtgtctcagttacataccttgtaatacaggcatcatgatactcactgcaaggtgttatggtaaaaatgcaatgaaataactctgcatgctagaacaaatttgtggacctttagatatctcacttgctcctcctggctcctcctgagggaaatagggcaggtattataagcttcatttttcagaagaatcaatagaggtccagaaaagagaaagttcattttcttttttttcttttctgagatggagttttactcttgttgcccaggctggagtgcaatggcatgatcttggctcactgcgacctccgcttcccaggttcaagcaatcctcctgcctcagccttctgagtagctgggattacaggtacccgccaccacacccagctaatttttcatatttttagtagagacggggtttcaccatgttgcccaggctggtctcgaactcatgacctcaggtaatccactcgcctcagcctcccaaagtgctgggattacaggcgtgagccaccgtgcctggcctgaaagctcattttctaaggttgcagggtaaataagcgaaagagccagaacccaaatcggaatctcccaaattggaggtttgctgtctgccagggaagtgggaagggtgtggactccagggttcctggtttctaagccagcatgtgggtattgtgtgttgctcttagagaagactggcacctcctggacagcatgacctgctccaccaagggaaacagagtgaagtccccctttgcctccagatcctccttagtacagggattcttggctacctcaacatcttaatcaggaagcagaaggcagtcccttactatttgatgtcggagggagtagaaatttaagagcttcctttcatgagaggtagctgaaggctaggcctgatctgggaggattctgagagggaaggtaagcacgggaaccattatacacaggacttactgtttgccagctactttctcacgtatccattaattcagattataaacatttactgagcacctactatctgccaggtgctgtgctagatgctaggggtgccccagtgaatgagaccagaaaggaaggacacacatggcaaacaggtgacaatcataaagaacacatggtagtcttcttattttatggataaagaaagggggtcttaggaggggacataaattgtcaacatcacacagctagtgtggggactcaaaatgcagatttgttcatctttaaacttgatacactttccattacaccaccccacctccctgaatctgctgcctccaaatcatttccctcacgttcctgtttcagcactcaaaatgtcaccattggctgggcgtggtggctcaggcctataatcccagcactttgggaggccaaggtgggtggatcatgaggtcaggagtttgagaccagcctggctaacatagtgaaaccccgtctctactaaaaataaataaaaaaaaattagctgggcatggtggcaggcacatgtaatcccagctactcgggaggctaatgcaggagaacgcttgaacctgggaggtggaggttgcagtgagccgaggtagtgccattgcactccagcctgagcaacaagagtgagactccatctcaacaaaacaaacaaacaaaatgtcaccgttagagagatacttctgtgggataacactagcttctccaataattcactattaaaatatcagaacagcatactccgtggcctgatattatcatatctcagtttatcagctttaatttatcagtctagtaggaagcagaggggagtgggtagcagatggtgagttctgatggagggcagagaaaggaggaaaggtatgatagcctaaatgtactagaaggaaatatgtattaataattttataatcttagcacagagccaggcgcagtggctcacatctgtaatctcagcactttgagaggccgaggtgggcagattgcttgaggccaggagtcccagatcagcctgggcaacatggcaaaactctgtctctactaagaatacaaaaattagctgggcgtggtggctcatgcctgtaattccagcttcttggaaggctaaggaacgagaattgcttgaacccgggaggcggaggttgcagtgagccaaggtcgcgccattgcactccagcctgggggacagagcaagaatctgtctataaataaataaataaatcttggcataagacagaaataataaaataagtattattttagtggtacagttgactacataaatgtaaaataaaaattattttgtgttgcaaaagttaaagcaaattcaaaagacaaatgataggctgggtgtggttgctcacgcctgtaatcccagcactttgggaggccaaggcaggcagatcacttgaggtcaggagtttgagaccagcgtggcaaacatggcaaaaccccgtctctactaaaaatacaaaaattagctgggcatggaggtgtgcgcctgtaatcccagctactcgggaggctgaggcaggagaatcacttgagcctgggaggcagaggtttcagtgagccgagatcacgccactgcactccagcctgggcaacagagtgagactcggtctcaaaaaaaaaaaaaaagtgaagtatatatatatatatatatatatatatatatatattttagcatattgacagagagtaaaatgactgatgataccaagtgttgatgagcatgtggggataatagctcttgtatccatttctcatggaaatggaagctagaaaactgtctctggagactgaaatcatgtatcaaaatttaaaatttgtttactgaggaataaatatagctaagcgtgtagaaatatatgcctaaggttatttatcataaaattgtttgatagtgtaaaattgaaaacaactcagtgttggccgggcgcggtggctcatgcctgtagtcccagcactttgggaggccaaggcaggtggatcacctgaggttgggagttcgagaccagcgtgaccaacatggagaaaccctgtctctaccaaaaatacaaaattagctgggtgtggtggtgaatgcctgtaatcccagctactcgggaggctgaggcaggagaatcgcttgaacctagaaggcggaggttgcggtgagccgagagtgtgccattgcactctagcctgggcaacaagagcgaaactccatctcaaaaaaaaaaaaaaaaaaaagaaagaaacgaaaacaactcagtgtcctttgttagcagaatggttaaataaactataatacatccatgcaatgaaacactatgaagccacataaaatggtgaaatagacctatattaattggcatgcaaagatgcccaagaatactgttgagtgaaaaaaagcaggttataaaccagaatgtagagtgtacattatggtgtgtgtgtgtgtgtgtgtgtgtgtgtgtgtgtgtgttatcctggattatactaataaatatattattttggaagaaaggaggtacattgggcagagtccgccagggtccaggtttgggcatggcataccacacaaagcgacacaagtcatagacaagtcacacaaacaagtgacaaactggagtctgtccagagggaagcaagtaggctgagagggagtggaactcaagtcagggaaacagttgaaggatctgggccagagagaatgtaaatctcagggaaactgattttgacttatataaatgcagctctttgaatccctagctctcctgtgattgagtaggctgtctagctagggactgggagtgagcttctcatcactgaaggtgtgtaaggagatggtcagggagttagatgacctctgagtccattcttttctagtttttgagaggctcagacttgacaaatgtggacgtgcatggcctgcctgaggctgatgggaaagtcaagggcaggggcctcagggaaaaaaaaccaatgggatctgctgtgagttagagcaaaggccagtcagcttagcttcccacccctatcccctcagagagatctcccctccctagccaccccatcccactcgcttctcccttatctcagagcatctgacctgtggaaactgcaggtcttctagcccttagattagaattcctccctcctcttcccttcttctgagtcagagagcttaaattggctctgttattagggtgaataggtaggtggttacctaggtggtgtgattcccaagggcactagacctattcccttgtttcaagatacctccccaatgtctgatttttcattagtgctttgtactttgaatcttgaatgctttccaaaattcctttgcaaaaatgccaatgattccgggaagaggatcaccttaagctgccaggaaaggggaggggtagggaagggcttctgtattctgcacaggactgcttctgagtgtctagaggaagatttgtaggctgggaggctgggcaaggcaagagtgggaggagacgtttggggaggggtttttctattcaagggcccaagtactctgtggttaaatcttagaaccagctaggctccatagttcctaggcccagcgcacattcgaatcacccagagagcttttaaaaatattgatgctagaaagttctagcaactgtactcaagctagaaagttctaatttaattggcctggggtggtgtccagatatagttgtttttataaaacttcccaagtgattctaatgtgcaggcagggctatgaatcactaaaccaagagaagcctagttagatgtaatctagtttgagggagaagaaaaaggggctggattagcttcttggtcccctgtcaggtgggacccactgggaaggtatggtattactccattgctccctggctacaacccattgtctcaagggtgattgagggctggaaagctaattacctatgtaaggtgacctaactttctggtttgcctgggactttcctggttttgaaacggaaagttctgcattcccagcaaactggaaatgttggtcaccctacacagggtgactgcaagtatttagaccttaagttatttgagcactgattgggacaaccacttttttctctccctcagttttctcttctgtaaaatggggccagcttttaaatccttgttctgcctctctcactggctgctgcaaaatggaataacattagcaaaagggctcagtgatatgtatagcacttcaggatggaatgttataaataataagcagtacctgccaggctgaaaaggtcacaggatgcttgccaattaaatctgtaacatcctttgtggtggtaggctggctttcatatattctttccttctctcccatgagttcctttaccttttcccctaaatcctaggatatcagagctggaagggaccatagacacttcttagtcctatcccaccatcaaacagatggaaagatggaggcctagagaggtaaaataactgattcaagatcatacagtttattagtggcagagctggggttcaaacttagcacatcattatgcccagctccgtcgtctcagaactgcgtatcactgaccaaccacctctctgacccccataatcccataaaaaggacattatgttttatttatcccacaaatactatttgagtacaaagaaaaaaggaagctcaagggacagtggcagctcagggcagggggaatcaaattcagactgaggaagcagctatggtcagggacttctcagatgaggtgagctgagactagaataaaagtaatagttctcctggtaagtgggggaagccattaggggaatgacattctaggcagtggaaacatgtccaatgacccagaggaggcagacaacatggcttttcagtccaatccagggcttgggattactggagagcagggtgatgggacaagagatgagactgatcatatatgccctgttaaggaatttggacttttccctgtaggtgtcagaacaccatgaagggatttaaatagccactcataactccagggcaaacagagggggattttaaaaacaatggaaaagttagagttacccccaatctcagaacagagctaacaatcactcttctagcacaaactgccaagtactggagctgatgccaagccctgagtcatccctgggctactgggctgggaggaggcccagccccaccctcccctgtctgggcttggtttaggctgagccatgtagactccaggcctaggctggcaggccttcaggctatccttccccaagtgtgcttcccaggctgctctgagcctggagctatcaggaccctcctcgcttctgatagctgatagctggcctctgacaatgcatccctcaaggtctctgctttgattattgctctcatctgtatcagtggagtttttcctacctctcttctgggcttcatgtaatgaaccctcctactcccaggtctcgatagcacagattttcctttctttctgctcccatggattttccctaaagcatgtttgtcgggagttgagtgtccaaagcattgcgggggcacagagaagaaagggagtttctgtaggcggggcgggggtggtggtgagggggacagcttttcttttctcagaaaatgacatttgacttgtattgtgaagagtgagtatgagttggtcaagtggaaaaagattataaaactgaggagcagaaggctcaaagacacagaactttgaatctatgtggaaatgcttaggtgtggctccaacatagaggaaacgcttggtgaggtgaaacagagcagggatgaaggaggaaacattgagataaaactgcccagctgcctccaccttgatggttcatgggtacctcaaattcaccatgtccaaaaacttcattctcttccttctgctccgcaagttggtactattatagggcttctaatcactaattcctatctgttctgtaatacctctttaatccctcaaatttatcctcttctccccatttctaatataggtctagtatccctaatccgaaaagttggcactcaaaaagtttcagattttgaagcattttgaattctggatttttggattagagatgctcaatttgtataatgcaaatattccaaaatttggaaaaatcataatttcaaaacacttctggtttcaagcatattggataatgaatattcaacctctactaccatccaagtccataactgaagcatgagtatatcttttccttttgttcaataaaaactgggtgtcccttttcacagctcagttgcatgtgacctgtggcttccatgtctgtactctattgttaataatttctcctctttcatttctcccctcaacagggttcctcagttttaacttcctgatcttcacttctctcatcctgattttaaagttgtgtttatttaattttacaattttattgctttcttgtggtgagttacttcaaatcatttgtggaatgagttgagagatgaatgagttgagagatagctggcccagaggagataacgataacatagctcacatcctcattattttttgcctgagctgttacaatggcttccaaactgagttctatatcccccatctcatctcatcccctcaattctgtcttcctttggcatgtgacattatcttttctaaaaacaaaaacctgatcaagtcacttccctgctttaaaactataagcagtttctcattatcccgaggataacattcaagacccctagtatggccgggcgtggtggctcacgcttgtaatcccagcactttgggaggccaaggcgggctgatcacctgaggtcggaagttcaagaccagcctgtccaacatggagaaaccccatctctactaaaaatacaataaattagatgggtgtggtggtgcatgcctgtaatcccagctactcgagaggctgaggcaggagaatctcttgaacccggggagcggaggttgtggtgagccgagatcgcaccattgcactccagcctgggcaacaagagtgaagctccatctcaaaacaaaacaaaacaaaacaaaaaaacaaaccctagtatgaggtacaaggccctttgtgaattcaccacctctcattcactcttattatagacactggttttcaatagagataaaaagcaaacactgttcctgccttaatgaaacttatggtttacttggggagacagacattaatcaactcaagactcaaataattgtatatttgcaaactgtagtaagttagtaagttctatggaggaaaggtggttagtttgctctatctctttttttttttttttttgagatggagtcttgcactgtcatccaggttggagtgcaatggcgtgatctcggctcactgcaacctccacctcccgggttcaagcaattctcctgcctcagcctcccaagcagctgggattacaggtgcctgccaccacacccagctaattttttggatttttagtagaggtgggattttgccatgttggccaggctggtctcgaactcctgacctcgtgatccgcccacctcggcttcccaaagtgctgggattacaggcgtaagccactgcacccagccaggtggttagttctctaaggacatgtggtagggatcctgacatatggtgggttttagagagttccacaagtagtgatatttgatctaaaggaaggattgaattggtgttaactaggtaaatggtgaaggtggggaaacatgtgctcccctgcagaatgcatagtatgcaaagaccttcatgggggatggattggaggaagcataacacattttagagatggaaaaatggctagtgtggctggaatgcaagcagtgacagagagagttggtagagagaggctagagaaataggtaggagccataccataaatgccttttaaaggccatgacaacgattcttttcatcataaaagcacaggggagaagccattgaaggtttttaagctggagaatgacatgattttgcatattgaaaatatttctctggcttctttgtggacaaatggatggaggagagccaaaaaggatgtgggaaaatcagttaggaacctgatgtagttgtccattcgactgggctgggaccagggtagtggcagtggacatagagagaagcagacagatttgaaagtttttagaatggctcattgatagaacttagcagtgggttgaaatggctggagggggtggggggggcgtgaggaaaaagaagatattaaagatgactcttagatctctggaaggggacaagtttgaggagaggaatgatcagaagggtttttgaggcctggagtggtcactcatgcatttaatcccaacactttgggaggcgcggtggctcacgcctgtaatcccagcactttgggaggccgacgtgggcagatcgcctgaggtcaggagttcaagaccagcctggccaacgtggtgaaaccccttctctactaaaaatacaaaaattagccgggcgtggtcgtgggcgcctgtgatctcagctacttgggaggctgaggcaggagaattgcttgaatctgggaggcagaggttgcagtgagccaagatcgtgccactgcactccagcctgggcaacagagagagactccgtctcaaaaataaaagtaaaaataaaaaataaataaaagagaggactggacgtggtggcccacgcctgtaatcccagcactttgggaggccgagatgggtggatcacgaggtcagaagatcaagaccatcctggctaacacggtgaaaccccgtctctactaaaaattagccaggcgtggtggcacgcacttgtaatcccagctacttgggaggctgaggcaggagaatcgcttgaacctgggaggcggaagttgcagtgagccgagatcatgacactgcactccagcctgggtgacagtgtgagcctccatctcaaagattaaaataaaataaaataaaataaataaaataaataaaataaaataaaataaaataaaataaaaaagatgtgactggaaatgagaggtaaggcctgggtatggatgaggagaaaatgccaaagatcccactgtccgtaagtggccaagtgaacacctgaatctaggctgggatgccaaatcctgtgacctttctactcaacttactacttctttttactgggaggaaaaatggttgccgaaaggcagagtgtattacttcagcagggagaagaaggtagactgctcaagatatggcctaagggaagagacaacatgggtccaatgtgtacaaccttgtgtgtgagggagaagtgctggtaggtggtagcttaaaaaaatttatatatatatgtatatatatatatatatatctatggccaggagcccgtggctcacacctgtagtcccagcactttaggaggcaggggcaggtgaatcacaaggtcaggagtttgagaccagcctgtcaatatgatgaaaccccatctctactaaaaaaaaaaaaaaaaaatacaaaaattagccaggcgtggtggcgggtgcctgtagtcccagctccttgggaggctgaggcaggagatttgcttgaacccgggaggcggaggttgcagtgagccgagatcatgccactgtgctccagcctaggtgacagagagagactctatctcaaaaaaaaaaaaaatatatatatatatatttgtgtgtgtgtgtgtgtgtatgcgcgtgtgtatatgtatgtgtgtgtatatgtgtgtgtgtgtatgtgtgtatatatatataaaattgggtacagtgtctgtctggagagctgggttccagctcactggctatgtggccttgagctgggctcatactttgtctttgccttttcatagtaggactaggaatccctaccccaccaaagcaaggaacaaatgagataacaaaaaaataacacgtgaaacagaccactaccaccaccatccacaaataacatacgcacaagctcctggcactgcacatgacacacactaggtgctccagaaaaggttctggaatgagaatcatcatttctctgtatatataggtatgaaaaaaaaaacgtgcacattgttgtgtggatagacaggtggttaatatagactccacaggcctccttttttctctttttttttttttttttttttttttgaggcagagtgagactctgtcacccaggctggagtgcagtggtactgcaacctccccctcctgcaaactccccctcctggattcactgcaacctccccctcctgggttcaagcgattcttgcacctcagcctctcaaatagctgggaccacaggtgcatgccactattcccagctaatttttgtatttttagtagagacagggttttgccatgttggccaggctggtctcgaacacttggcttcaagtgatccaccccccttggcctcccaaagtgctgggattacaggcatgagccactgcacccagccatcaagggttccttttctgagaaataaaagatgtatgtgttctcaggcttccagcttctctcctaccacgttctggctggggaggtgccagcctcctttgggctcagccccttggatgaaatggcaccccacattaaggggcattatggaggcaggatccctaaggcatgcccaagattcattcatttatttaacctaatattaattgaggtcctactctgtgctgggtgctacaatgtatgctggggctatgatggtgagcagaacagacctatttcctgccctcatcaaaatcatgatctaatgggggagtgtaatagtttaccatgtgtcccgtaacaaattatgagtggtttaaaacaacaattaattttcttacagttctggaggtcagaagtttaaaatggtcagcagggctgagttccttctgaaggctctagagaagaataaatttccttgtcttttccagcttattgagactgcctgcattccttggcttatggtcccttctctcttcaaagccagcaatagcaggtcaaatcctcacactgcatcactctgacatcctctcatgcctccctcttccactgttccacttataaagaccgttgtgattacactgtgcccacgcgggtaatctaggataatcttcccatctcaaggtcagctgattagttaccttaattccatctgcaaccttaattcctctttgtaatgtaacataatatattaataggttttgaaaattagaggccgggtgcagtggctcatgcctgtaattccagcactttgggaggctgaggtaggcagatcacttgagttcaagcgtttgagaccagccttgccaacatggtgaaaccctgtctctaccaaaaatacaagaccacaccactgcattccagcccgggggacagagtgagactctatctaaaaaaaaaaaaaaagaaagaaagaaagaaaataaaattaagatatggatatgtatgttcagggtgccatttttctgtctactacagggaggtagatattaaacaagtaaatacacagataaaatacattatttcaaactataagtgctgtgaaggaaacaaatctctgagattgagaatatggtgctctttttgtgggggatgtattctattttagtaaaaatgggcaaggaaagaagtaatatttattattattattattattattattattattattattattattttgctatggactttcgctgttcttgtccaggctggagtgcaatggcacgatctcagctcactgcaacctctgcctcctgggttcaagcgattctcctgcttcagcctcttgagtagctgggattacaggcacctgccatcccactcagctaattttttgtatttttagtagagatggggtttcatcacattggccacattggccaggctggtctcgaactcctgacctcaggtgatccacccaccttggcctcccaaagcgttgggattacaggcgtgagccaccgcacccggcctttcagttgctctttacttgctgtgtttcccttctatcagacatccctctagtcatattaacaccatcccaggccaggcatggtggctcacgcctgtaatcccagcactttgggaggcaaaggtgggtggatcacttgaggccagaagttcaagaccagcctctactttcatcccctgtgcagtctatgaggtcagagccctgaggatgggaagcaacctccctaggccagcaggcaagcccatgacccttgggatgtgctgtgctaatccagccccctggaagatgggggcaactagaatgtggagcaccggaaggctggtgcacttgcagttcagtgatgcagccagtctgagggttaatcaggacagagacctttgcccacagagccaggatgatttcatctctatggcaagcatcatcaatcaatcaggaggcctggagctggacaagtttttgggagatgagaagataatgcaagccacaatccttgcctttaggagcttttgttggagatccagaacccatgtcacaggaagagtaagacctctccagtttccaggtcagcttctaaagcttctaaacaagagaagctctcatttctcctgggtctcagatctggccctgagccatggtaggtacttgatccaggtctgctctcagcagagagacccaccagcaagcccctgtaattttttctccctccctaagaacttctcagcttctattttcagatgtcccccaaagcaacaggagcatgggatcattaatcttttgtattaacttgcttgattcttattgctcttgagtctggagacccagtggaaagaatcctagcctgggagtcaggagaactagtctttttcctgaccaactccattcacttcccttggccgtagttttctcacttgtaaaattgggacacgtagcctagatgatgttaaaggtgtaatattttaagattctgatttctgtttttactctttcattgaggatatgggagaggtggatttaggcggtgatgaaggaccatgctctaagattcagaggttctatgagttaaacatggggctctctctcttctcccaagcattctgatactcagaataaatggctggatgtctttggaaccagtcatatggcagtatatttaggactttgttggcctgcagaaagtagaaccagacctcttggcccccagtcccaaagtcttagagaagtggaggctggggagttgggagtggtgtgtgtgtgacagaaaactggagaatggcttctcatcttcccctgtggcattattttgccaacaccacattctctggagccactggagaggctcaggaacacatgatgtggctggtttgaaggggcacttcaaacctgggggatggccccgcattttccccactgagacatagccacatatgggctcacatcttcatgtaaatacatggctaggctgaatataaaccaatgcctttggtgtagtgtgaagtagggggaagtctcttaaaaatagttaggaatgtttgaggcctgtatttctcagaaaaaaaataatgttaaaatgtgttctggtctgagactagggagtaaagaatgagaaaaagtgttttaggaacgtaagtggtgggaggaaggggctactatacattaggctgacttggaaatacagattaggccgaacaacacacacacaagcaaatgggcacataaacaggcaagcatgggagcctgtttgctccatgtgtatgttatccatgtgtatggataacatacacatggccaaacaaaggcacatctgggggcccaggaagactccagaacctacatttatataccacatacacatagctatgaccacactttttctatgtggaagtatgtattttttgagatggagttttgctcttgttgcccaggctggagtgtagtggcgcgacctcggctgactgcaacctccacctcccgggttcaagtgattcttttgcctcagcctcccgagtagctgggattacagacgcctgccactacacccagctatttttttgtattttttggtagaaacggggtttcaccacattgaccagactggtcttgaactcctgacctcaggtgatccgcctgcctcggcctcccagtgtgctgggattacatgcgtgagccactgcacctggctctatgcaatcattttatggagacccttcttttttttttttttttttttgggacagagtcttcctctgtcgcccaggctggagtgcagtggcgcgatctccactcactgcaagctccgcctcccgggctcacaccattctcctgcctcagcctcctgagtagctgggactacaggcgcccaccaccacactcagctaattttttatttattttttttttgtattttttagtagagacagggtttcaccacattagccaggatggtcttgatctcctgacctcgtgatcggccctcctcggcctcccaaagtgctgggattacaggcgagccaccacgcctggccttgcaaagacccttcttatagccaaccttatatatcctcctggccaaaaatattgggaggtagctattattattaccccaatttttacaggaaactgaggcttgggttaatcaactgatttacctaaagttgctgaactagttattggaaaaacagactaaaaccaggtgttctgtttccaaaatttactgctttcaaggtggcactttctctctctctctttccctcatacatatactaaagaaaaaaaaatgtgcagctatcttgctatatatacataaaggcatatacgtatgaataaagcatatacaccaccagtggccagtaggagtttttgggttgtgctctcatggaggtcttagtaagaggagaagggtctgctcaaagccctgacccatcctgctttctgttccttgtccagtcacctatgactgttttttcagagcgttgtaggtgggagctttttatgccagggtaatagtttttattggccctgctgagatgaagtcttttatccccatacctcaacacttaggatgtggggagtggtgaaaaaatatattatattcctttttttttgtctgtctccctcactaggttgtgagccctgtaagggtagaaacttttgtttttttcatgtctgtatacacagagcctagtacagtgccttttgtgtagtaagcatacacacaaaaaattgttgaatgaatgaataataaagtcagatagttgaatgaatgaataataaagtcagataataaagtcagataggcttgtttcattataggatgaataataaagtcagataggcttgtttcattataggatgaataataaagtcagataggcttgtttcaagaccctacttataatgagatcatggccaagtgaccttacttccttgagcctcagttaccttatctgtcatatatggattgacactctgattacctaagatgttcttggtagtgaatgacataatgatttgaaaatggctctgtttttatttgagggcttcttacatattgattttatagacccttagggcatagaaattttctcttcaacctcccagagtatggggtcatgtaacctttgtcaacaaactttcaattacgaggacctcagtactttttgaatgactctctccagttttggacagctgtgactatacaaaccttctccctcgtgtcccactgtggctttctcccacttgatccagctctgcctcttggcattcagaagtctgattcagaagaagacatagacatctccctgaatcttctaataggtctaatagatcagaaacctcttttcatgatagcttgtggtttttttgttttattttgttttgttttgttttttgagacagagtcttgttcttgtcgcccaggctggagtgcagtggcgtgaccttggctcactataacctctgcttcccgggttcaagttgttctcctgccttagcctcccaagtagctgggactacaggtgcctgccatcatgcctggctaatttttgtatttttagtagagacagggtgtcaccatattgtccaggctggtctcgaactcctgacctcaggtgattcacccgccttggcctcccaaagttcagggattacaggcatgagccaccatgcctggctgatagcttgtgttttcaaaaggctgaattattgtatggatataccataatgtatttaattagtgctctggtgatggacatttatgttgtttcccttgattattatagtattgcagtgaatgtctttgtaaatgcctctttgtacacagtatagtgtttacctaaggcagactgggagcagagctgaaaagatctatgcctgtgtgtgtgtgtgtgtgtgtgtgtgtgtgtgtgtgtgtattgtgtttgttgttgtgagttgggagagagaaagtgatgacataggagaatctgttccattagtcttgtctcctaacaggataagttgaggcaatgtgaaggggaatgtgtgcccttagagaaactgaacataatacaagttgataggcctgcaaggctggaaatgagcagatccctctcttctctggcctagctgagcaacctgtcatgagctccaaggttatgcctagaagtgttctggactccttctgcatggaacaaaaactgtgatccctttatgggagcaactacagcccagcctggaatggaaaattaaaattaaaaaaagcagctgctgacaagacaaagcaggatgtgggagggaggccaaatgagcactgtgaacctactgcaggcactgcggggctgagggagacagagagcacgaggagggcaggaaagaccaagggagggctttgtgcaggaggtagggcccgggaagcccagagacaagagcaagcacacggtgctgctgcgtgcagtgagtagcccagctagagggcacggcctgtgctgaggagccgtgggaggaagagagggctgggaaggtaagtgtgtgcattggtgtgtgtgtgagggttcacctgccaattctgagcacacatgaaggctatgtttctgaagatcaccatgaagatcaccaaatgaccatgtggaggctggcctggacaggcagcctggaggcagggagacgagggaggagcctgttccaacagttgaggccagagtcggggagggctgacctggggcactggcagtggagatgggatggagtgaagctgtgaaggacacacagacagacagagagcagagcttggtgactgatggcaggggtcaggcagagttaaagatgatgaaactgtgcacacaaaagacgacgccaacagcaaaaccaccaacagatacagagctgctgggaaggggagctcgaggggagaggagggtgagcacccctcacagagcctctcatagagcctggcacctaacaggcacccagtcacagatggatgcggatggttcacagacgggccatgagctcagcaggctgttttctctctgggcacatgcagactggtcacatatgcagggtgactggtcagtgggggcagggctgggggggctgatgacttcactgggagatcctgtctatggagccaatttcatattccaagaggatagtgacttaaattaaattgatattggctggctggggaaagtgcttgaaaagcttccagctctatcaggtgaaaaaccagagagaaactttgtcctctcatggtggtccattagtgtgattaataataaatattcccagacacttgatactggcaaaacgccttatcagccctgcttatgattactcacctgctatctcgaaccattagtctgaccaccaaggtgcgggggtgatgcgaatcttaaaatacacccccttcctcgagtatgtctggtcatagctcaggactgagaaagtcacagattcaggctgatgggatgaaggtggactttggtctgacactacctgggcccagatccctgtgccaccatcaacaaatcaacaaacatgtgacttttggacaagtcacatcacttctcagatcctcaatgtcctcatttctaccaatgtaactgtcatttcttgtgagggttacattgaggttagatattgaaatggcctccctaatgctcagcacatagtaggtgccttgtttaatattatcttctctccttttacccagatgctagctttttttcctaagaagtagctacaagactgaggatggttaaaagcatgattttcctactactgcagtttgtactctcagccacattatgctgtgagagggtctttttccttaggggagacaacagtatctaaagaataagctaaagaatagtttattctcttttttgtgtaaggggcacaagtagtcaagtgtttgcactactgacccaggggaagaaaaagagagagagagaaggcctcagagtgtggggccccaagctgatattttttctcatctgtctctgacacatttctcttctatgaatgaagctagaacagcaatctcaggggcttagttaattcttcctgcaagaaaaacccaagagcaaatgtgctgagtgaaacagaaggactttccaacaatgatgaaaatgaaaagcagccctcagaaagttttgagtgatggggaactttcaattgctacccttcagtgaattgttggggtcagggggattctttttgcaaagtatcccttgctgttctccaaccagtttgtccctggtattgcctcctctgcactgcactgcatcccctgaaggaggaatgccacttgaaatgcagaagcttctttattgccgtgaacttagatctaggatgggaacaatatatttgcagatgattaaaagtccaatttcatttctctcttgagcttggacatagactttcatataaatcagcttgatttttcttttgtttttttctttttctttttcttttctttcttttttttttgagacgaagtcttgctctgtcacccaggctggagtgcaatggcgcaaccttggctcactgcaacctccacctcccgggctcaagcgattctcctgcctcagcctccggagtagctgggattacaggcatgtgccaccgtgcctagctaatttttgtatttttagtagagacaggtttcaccatgttgtgcaggctggtcttggactcctgacctcaggtgatccaccctcctcagcctcccaaagtgctgggattacaggtgtgagccaccgtgcctggctaccttttttcttttttctttttttttgagatggagtctcattctgttgcccaggctggagtgcagtggtgcaatcttggcttactgcaacctctttgcctcccaggttcaagcaatcctcctgcctcagcctcccaagtagctgggaccacaggtacgtaccaccatgtccagctaattttttgtatttttagtagagatagggttcaccattttggccaggctggtctcaaactcctggcctcaagtgatccaccagcctcggcctcccaaagtgttgggattacaggcatgtgccatcactcccggcatcacataaatcagcttcatgcagttcttgcttgctgttcccttgactttgatgcccagacttgctgcagctccagaacattcccagcccccaaggaatcctgagcctttcaaactggaccccaagtctgtccctaaagccctgaccaaatattcctttgcatctcctgcccactgactcagatgcccccggcttccttggactccagctccagaatgtccctgtaccacctctgctcatattggccctcattagctgtactgcttgaaaaagacttgcctgtctcccttagaactttctgaatttagcttgtctaaaaacccaaatctcttcataccccttatgttcctctcacagagtaaccaacctatatgtggatgtatggctcctatttctatgtcttctctctagaaacactgacataaacctcatcagatctaaacctactcatgggtattactgtggccccaggatgattgatctaactctcagttcaaataggatcacagtagggggtaaggtggggggactatcagaagtttgggcaatataggcatgaaatggtttacaaggaggtaggaaacaaagctgtttcactgccgtcttaaagaacaagatagcacctcggctgcctctgctctgctctggagacaggggcgtaactgagatgagtccctgctagccaaagggtttcatgtctagcccctaaacaatgtctagctattgaccataatcaccataacaagcttctgtttggtgaagtggggaggaaggcactacttctctggctctagccctcaaaatttattgctttatttatttgactcttagcctgaacattattggtgtatagaaatgctactgatttttgtacattgactttgtattctacaattttgctgaagctatttatcagatctaggagcctttgggcagagattatgtggttttctaggtatagaatcatatcatctgcaaagagagatagtttgacttcttcctttcctatttggataccttttatttctttatcttgcctgattgctctggccaggacttccagtattatgttgaataggagtggtgagaatgggcatccttgtcttgttccagttctttttttttttttttttgagatggagtctcgctctgttgccaggctggagtgcagtggcgccgtctcggctcactgcaacctccacctcctgggttcaagcaattctcctgcctcagcctaccaagtagctgggattacaggcatgtgccaccacacccggctaatttttgtatttttagtagagatgaggtttcaccatgttggtcaggctggtcttgaactcctgacctcgtgatccgcccacctcggcctcccaaagtgctgggattgtaggcgtgggccaccgtgcccagccaagtcttgttccagttctttaggggaaaggctttcagcttttccccattcagtatgacgttggctgtgggtttatgatagatggctcttttatttgtttgttttgttttgtttttttgagatggagtcttcctctgtcacccaggctggagtgcagtggtgtgatctcagctcattgcaacctctgcctcccaagttcaagtgattctcctgccttagccttccaagtagctgggattacaggtgtctgccatcatgcctggctaatttttgtatttttagtagagacaaggtttcaccatgttggccaggctggtctcgaactcctgacctcaagtgatccaaccgcctcagtctctcaaactgctgggattacaggcatgagccacctatagatggctcttgttattttgtggtatgttcttttgatgcctagtttgttgagggtttttatcataaaggttgttgaattgtattgaaaactttttctgtatctattgaaatgatcatacgatttttgtttttaattgtgtgtatgtggcaaatcacatttattgatttgtatacattgaaccagcctcgcactccaggaatgaagctgattgatcatggcatgttaactttttgacgtgctgctggatttgtttgctagtattttgttaaggacttttgcatctatgctcattagggatattggcctgaagttttcttttttcattttgtctctgccagattttggtattaggctgatgctggcttcacagaattagttagcgaggagccccacctcctcaatttctttttagaatagtttcagtagaactggtaccagtttttctcaagaacacatccccatttaccatagccacaaagagactgggcactgtggctgacacctgtaatcccagcactttggaaagttgaggtaggcagatcacctgaggtcaggagttccagacctgcctggccaacatggccctgtctctactaaaaatacaaaaattagccaggcatggtggcgtatgcctgtagtcccagatactcagaggtcaaggcagaagaattgcttgaactcagtaggcggaggttgcaatgagctgagattgtgccattgcattacagcctgtgtgatagagcaacactccatctcaaaacaaaaccaaacaatagccacaaagaaaatgaaatatctaggagtacagcagctaaccaaggaggtgaaagatctctccaaggagaagtacaaaacactgctcaaagaaattggagatgacacaaataaatgaaaaaatatcccatgctcatggattggaagaagcaatatcattaaaatagccatactgcccaaagcaatttacagattcaacgttattcccatcaaactaccaatgtcattctttacagaattagaaaaaactgttctaaaattcacatggaaccaaaaaggagcccaaatagccaaaacaatcttaagcaaaaagaacaaagcttgaggcatcacactacacaacatcaaactatactataaagctatcaagaccaaaacagcatggtactggtacaaaaacagacacatagaccaatggaacagaatatatagaaaactcagaaatcaggcctcatacttataaccatctgatctttgacgaggtcgacaaaaacaaacaataggaaagaactccctatgtaataaaaggtgctgagatacttggctagccatatgcagaagaatgaaactagacccttacctttcaccatttacagaaattaactcaatatggattaagtatttaaatttaagatctcaaactataaaaatcacagaataaaacctaggaaacacacttcttgacataggccttggtgaaaaatttttgtctacgtctcaaaaagaattacaacaaaagcaaaaattggcaagtgagacctaattaaactaaagagtttctgcacagcaaaagaaactatcaacagagtaaacagacaacctacagaatgaggaagacatttgtaaactattcaactgacaagggcttaacatctagaatctatagggcacttaaacaaatcaataatctaaaaataaataaccctattaaaaaatgagcaaagggccaggcgtggcggctcacgcctgtaatcccagcactttgggaggctgaggcaggtggatcacctgaggccaggagttcgagaccagcctgaacaacatgctgaaaccctgtctctactaaaaatacaaaaattagcaaggcgtggtggcatgcacctgtaattccagctactcgggaggctgaggcaggaaaatcacttgaacccaggaggtggaggttgcagtgagccacgatcacgccattgcactccagtctgggcaacaagagtgaaactttgtctcaaaaaaaaaaaaaatgagcaaaggacgtgaacagacacttctcagaaaaagacatacaagtggccaacaaatatatgaaaaaaaaatgcctatcatcactcaccatcggagaaatgcaaatctaacccacaatctaacagatgtaaggtggtaaccttacatcagtcagaatgactagtattaaaatgtcaaaaaaaacaacaaatgctggcgaggctgtggagaaaagggaatgcttatacactgttagtgggaatgtgaattacttcagcaactgggcaaagcagtttgaagatttgtcaaagaacttaaaacagagctacatttgttccagcattcttattactaggtatatacctaaaggaaaatagatcattataccaaaaagacacatggacttgcatgttcatagcagcattattcacagtaacgaagacatgaaatcaatgtaggtgcccatgatcaatggttgactggataaagaaaatggttgactggataaagaaatggtcaactaaggccaggagcggtgactcatgcctataatcccagcactttgggaggccgaggtgggctgatcacaaggtcaggagatcgagaccatcctggctagcatggtgaaaccccgtctctactaaaaatacaaaaaaaattagccgggcatggtggcgggtgcctatagtcccagctacttgggaggctgaggcaagagaatggcatgaacccgggaggcggagcttgaagtgagccgagatcacgccactgcactccagcctgggtgacagagtgagactccatctcaaaaaaaaaaaaaaaagaaagaaatagtcgactggataaagaaaatgtggtacatatacaccgtggaatactatgcagccatagaaaagaataaaattatgtccttagtagcaacatggatggaacaggaggccataatcctaagtgaattagtgaaggaacagaaagccaaataccgcatgttctcacttataagtgggagcttaacattgagcacctacagacataaacatgggcacaacagacactgaaaactactagaggtgggagggaagaggacatgggttgaaaagcttcctaatgagtactatgctcactacctgagtgcaatatatctatgtaacaaacatgcacatgtaccccctgtatctaaaataaaacatgagaaaataatatttaaaaaatttcttgcttgtactattgccagagcttcttaactgagctctttgtcttctgtacattagctatctggccttgggtaagtcttttcctctttctgatccccagttctcctgacctggagtgagactggactaactagtctctgatagtttatgctctctctctatttcccatcctctcctccccagaggtccaacctcatctttctccctcagcccctttccccctatttcttagctccccgagcctctgacaccccctgcccctgcttggacttctatgccccctttctttttttttttttttaagacagtgttttgctctgtcaccctggctggagtgcagtggtatgatctttgctcactgcagcctctgccttctgggttcaagtaattctcctgcctcagcctctcgagtagctgggattacaggcacatgccaccacacccagctaatttttgtatttttagtagagatggggttttcccatgttggccaggctggtcttgaactcctgacctcgagtgatctgcctgcctcagcctcccaaagtgctgggattacaggtgtgagccaccacacctggtccttgtttcccttttagtagtgtcttcagctacttgacactctctacccaactctcccctgtgtatgtgtgttgtggggagtggttggcatgggaggtggggaatgacacaagggagtttccactttccagaaagttggagtcgccaagtaaattctttgtctttaggcatttagcttcatgccaggtccctgtaggttctaggtgaacatgagtgaagaaatcagttgagttccttgaacatctggtggaaaagggccaatggcagtattaaggcgtgtgatgagctgtcattgctactcctgctgctgaggctttctggtgagtgctgctcttccttggggacaactgctcatggagactgtttgggctttccgatgagtgctgctctttgaacaaatgcttagctcaaggaaatgatcttggcagggaactttgtttaccctagcacacatcaatgaatcttgttagcagtgagagaaaccgaggcacactgaatcgtggacactgttggtctgggaaggcaaaggaagaggatggaatcagactactggttcctgagtgcaaatgcaagaccagcccatatgcaatcctgttaggctcatctattgtcctagggagtatacttcctttctcatccctttataatgtcagagtgggaaaggaccttggaagccccggagtccagtcctttcttgctacagaaatggaaactcaagcccagagagggggagggaattacccaaggccacatagtggtcataggatgagttaatggcagagctatacgtagaagccaggtgtcctgacctctcaagtatcctttccattgtctcaaactggcttaccatctgtggtgccttacctcacaaaggatactcagaccatgccttcacatggttgccagtggagaggaggaaaaaaggactatggccagccactttcaaactaaaactcggacttattttattttactttttttggagacggagtcttgtgctattgcccaggctggagtgcagtggcccaatctgggctcagtgcagcctccgcctcccggaagcgattctcctgcctcatcctcccgagtgcctggaactacgtgccatcacacccggctaatttttttgtttttttttttcgcatttttaatagagatgaggtttcgccatgttgagcaggctggtctcaaactcttgacctcaagtgatctgcaggtcttggcctcccaaagtggtaggattacaggtgtaagccactgcacatggtctcacttactattattattattatttttgagacagagtttcactctgttgccctggctggagtgcactggctcagtcttgactcactgtaacctccgcctcccgggttcaagcgattctccctcctcagcctcccgagtagctcggattacaggcacgtgcccggctaatttttgtaattttagtagagacggggtttcaccatgttggccaggctggtcttgaactcctgacctcaggtgatcagcccgcctcagcctcccaaagtgctgggattacaggagtgagccactatgcccggctctcacttattttttttgtatagatatgggagggggtcttgatatgctccccaggctggtctcgaattcctgggctcaagcaatcctcctgcatcagcctctcaaagtgttaagattacagtcatgagccaccgcactcagcctaaaactcagacttgaccagacgacttcaacagtctagaacactgccatcctgggattctgtgaccttgacaagaaggagaaagggagctggcagacaaaccccaagggtgtggactagggaggtcacatctaacctgagggaattatagccagccccatcaggacatcagaaagtgaatgtactgggagaggggctaaaggatcaggtcactgatttgaggaaggtgaagactgggatttagatgaaggaaagataaatgaggactgagcaaggatgggtaggaaatatgatggggagagtcctacggaagagaatggatgaagtgttttaagaggtgaggcagtttagccaaaagaagagaagtttcctgtggacctgagatcttcaggcctttgaggagctgttagggacaacaggggatctgtgtggcctcagggagcagaactgagatccatggatggaagccatagagaaaaggagttcagacacggcaagaactttctaagagccagagctgtctagagaaggaaaagataggtagtgagctccccatcagtggaaagttgcagtcaggggctgagtaagcatctgtcagggcccagggtctgggccctgagtgggggtggggctggaaggccaggacgtggaaggctaggggctgtgaccagggtgggagaggagccgggtgggtctgggtggggagtggtagctaccctaggtccgcccgggcccagccgggccccccacgtggccgctgtggcctggctgcgccgggcctggccaggcggggctgggcggggcaaggccagcggtcggcggggaggcgggcgcgagggcggggagcggcgcggaagccgggccacataaaggagcgggcggcgcgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacggtgagtgccggaggtgggcgctgtcgaccccaatggctctggctgagcctcatagccctttgctgatggctgagggcttggccagccaccggcccgcctgggacgccgcgccctccgccatagccaagggtagggaggggaccggagtgggatcctggtctggtgcgccctcaggggttgagggggtgtccaggctggaagtttggacggggcgaggcctgcctctttctcaggttccagttccctgtgtctgagatgcaacagtcaggacggcttcgttggggcctggggtttccccttttccctgatgggccatgggcacagaggagaggattctggtccagaagacaacactttccccaacccaggaattggcacctttctggggcaaggctgccaatgtccaagaggggacatgggaacagagaagcagggagaaaggagggagccgctcggggcggatccggcacccccactcatctttcccacagcctcaccgggtggctccagctgttttccactaggaggtgaggagagagatgtgaggaaatcgtcatcgaggctgcacccgagagcaccaacacttatttaggcaccagtctgaggagaggcctaccccatctcctgggagagaggaccggtttctccctcctctccacctccaaatccctgcccctcctattgcttaatgcctctctatctcctcctatcccctccggactattttgtgtggtgtgggttttctcgtggggccacacctttctagagtggtggttgatttggggatgcgtctccaccccactggctgttacgagaggaacagaagcctcctgggagtggggataggggggccggatgcccaggagggagaggggaggaggggtgtgcctgactaatgagctctgcttgcttttgtgcaagtcatgccaaatggctgctgaggcccttcccttgctcagaaaggcctggtgaccaccctggcttgagtcccttaggccaaacagcttgttgagctggcctaggcaatgcagtgctcccaaacatgtctccccaggactgcttgagccttgtagaggtgagatagtgactagtagccttgaaaagggctgaaggtcccctgggatgagaggaggagagttgggggcccagccttttgggtttgtgatgagctttggttgccacgttactgtataccagcctcactgccaagtcgttcttgcctttccagaaccttgtccttcagaaacaccaagttttcaaaaagtatgtgctttcactgtctatctcctttaaattgcttgtggttttaggacatgaggcttttacacactttgttccctagtccccgcccccaaagagagagagtaatggttttggagagaggggaaaatatcccattgtctgccaaaacaagattataaagatcctgtcaggagcggctctttgggtctctctctgtggttgactcctgactcctcttaaggtgcggctttgcctgaacagttgggtggatctctgggaatagacattgctccacggtctttcttctgtagtggcatatctcatcctcagttctgagatagcccactttgaaacacagcttcatgggcctggaagttgcttcaaacttgcattaaccgtctcatctgagtcaaagtggcaaagaagacaagacagcgtgtttattgttttcctgggaatggagagagaatggagtataagctgtttgtagtcaggcctggagtaatgagggtacctaaatactgaaggcatttttatgcagattgactgaaacctgaatcaaattggaaggagagggctgaattttgatagactggaagtattagagaattttctatactttgactcaaggaatggtcaacttttaggaaaagcaactatattatgtctgttaagatcatagaatcttaacctgaaagggaccttggagactatttagtacaactctcttaaaaaaaaaaactaaaactaaaacaaaaatctaatgaggctattgagacctacagggaaagacctacctaagggcacatggtgactgagccaagattggggtccaggctttctgatgctcatctcattgaccctttattctgacccaatgattgagttcttgacatttgagttccctttcttgctccaaacaaattgcccactgttctcagacctttatggtcctcagataaaaggaaatgagtaatttgagcaaagtggccaaggttgacatttgtgtggtctcctggtaaggttcggtagtgtcaccaggtgccttctgttacttttcttattcctcataccaaggccaaggtgttcaggggcacaccctagttcactgaataccaaccagtaattttaattaaaaggggaaaaaatttccctttctctgctccattttcatttatgtgctttaggctatttctagcgtgtgacagatggagaaaggtagtggaaaatcaaactcgttcattcatattgcagcatgtctacaacctatctagggtcggtttcacttttatagctaattgtccctcctagtcagcccaacctcccctacatttgttaaaacacgccagccgggcgtggtggctccagccagtaatcccagcactttgggaggccgaggcaggcagatcatgaagtcaggagttcgagaccagcctgaccaacatggtgaaaccctgtctctactaaaattacaaaaattagctgggcgtggtggtgtgcgcctgtaatcccagctactcgggaagctgaggcaggagaatcgcttgaacctgggaggcggaggttgcagtgagccgagatcacgccactgcactccagcctgggtgacagagtgagactccatctcaaaaacaaaaaaagcaaaaaaacaaaaaaacatgcctcactacccaccgccacccttgccttcttgccattccttggactctgcttctggttgccagtttcctgagtctgctttagtagccagaatggaaaagcttattaattgccatctacattttttggtgatgatgacagttatatatatatatatatatatatatatatatatatatatatatatatatatatttaaaaaggcctttccccctccctaccttctttaatttttttcttttaggatcacaaaggctttgaggctttcttggatttcctaaaaaaagagtgttttgaattttcgagatgttcttgagtttctggtttccttccttgggatttattagatgttagtattgaaaaggctctccacaactataaagtccaattcctctcattgtatagatgatgaaactgaaactcatgttagggggagactaacctagagtgatgcagtatgccagttgcaaaactaggacttgaatctaggtcttagttagagggtcagtcttggtgaaacacctctttgatctgctggggttttagccatagatcaacagatcaggggaaaggcaatcgagtggtcatttgatgggaccatcaatgtgagcagacatagagcctagatccttgaagtatttgaaggtgtttgggtcggcattcagctaaactttaacagggactatgtggactgtttattctcctgccattcctagcattacttgagccactcgagtggcactaaagtggtacttggtaaataggagccagattcttagtcttttaacccttgaaccagccctgcctacagacttaagtggggggaaaaggatcaggaagagaggtcatatgagagaggatcctgcatctctccacttgggttcttcagttcacttggccctttgtgaaagtgtagatgatagagacagagcaggaaccatcttgggaatttcctttacgcttttcttttaacagccctctgggtagggagggggctggtggggcaggaaggcctttgtgggacccacaccaactaatctatgctctctcgtgttaggcttggagagggaaaggttgctctgtgagtcagtgatagaagtagtattgatcactaatcttctaactttccattctctagctgcctgcaacagtagcttgttttagggtgttgttcttacttttctcttacctcctcctcccatgaaactactttaccgaatgatggagctggaaaggacatttggaagtcatctagtctatttcccctgcctccaaatctaattctctctggatgagataatatgacagctacaattattctgaactctgttctagtgttgcatggcaacagcctgtcttaggtccctttgtatctttctgggagtttcccccactggaatttctagactcagggtccccagaggggagaatatctggctaccaacactaccagagttaggcctttcataaccatagctgctggaaatttggcattgttacagattgctaatagtctgtctctaatctttcaaagatagaattgaatttatcatgtgcctctttcctaactcagaatcttctttccctgccacctgctctattactttgcttgcaaaaaggaaaaaacagggtacagatgtggtctcctttgggatagtctgttggttcaagtgaagggggtggtcttttcatgactgactggctttgctgtccatccctccttccatttcatgcttgagagagctgaaaaacttttcaattccaggttctaatctgtggtatagaagttgtcactttggaggattagctcaggattccatgaatttggaaggtgggtgctgggaaatggaaagcatcactgaactgagaatttttcttctctttccatataagaagaacttctctcctgtcctcagtaaagtgagccaaatgaagtgggactttaggcaagtcctttcttcaggccctctgtctctccagcttgtcatgagggagctgtaccagtgatgggtaaactctaggaatccctccagtactgatgtttttgagaatcttgatggtataagagcattgagtctcttatatgtatgttcattccttcagacattctttcttcaacatttgggtaccttctatgtgccaggcagtattggaaatacaaaattgaacagcgcttattaaaatgtatcctcttgtcccattatacttcttgagtgctgtttcttcttaagtgctgagttcagaatggactgtttctcacatgggagttggtttgtttcattagtagatccaagaagaatactggcttgagtactcttggccatttcttcccgagtcatgggagagaaagggctgtgtctttccttactgtggaaagaaataaaccaagtgagagtatattatgaagactgtgggttgactgaaaagctttggacaaacactaaaagcctcatagattttcctgccattcttcccacatttttcagtgaccgcctgcctgatagtagaatagtcctttttatttctgctgaaaggaaggcccggaagctactagattatgtttcagattttcttctaacatggtgagtgtggtagttagatatattggtagatattgaggccttcctaagggctcctaaacaaacctcataaagtatctaccaccagtgagctgaggactggctattgtggggtacagctttttttttttttttgatacggagttttgctgttgttcaggctggagtgcaatggcacgatctcagctcactgcaacctccacctcccgggttcaagcgattctcctgcctcaggctcccgagtagctgggattacaggcatgcgccaccatgcccagctaattttgtatggggtacagcattttaaaggcatttgcatctagggcaacccagagcttccctagccttaagctttcctttagctggttgttctggatgggcagggtttctcacaggagtgttttgaaccatggaacaactgagctggccttaaatcttctgcctcagcctttatcttcttgatgggggcactaaagtccagaaaagggaaaggatttgagtgaactggtgatagtgccaggactaaaacctaacttgcttggctccagtgtaggggagggatggtgaatgcctaccttctaaatggcactcactgtgaggtgctcagtgtcttctccctctgtgctggtggtgacatgaccgtggagttatggccatgggaagagcaagttcctctgagtgtgtagagctgatctcatgggtttctttatttggaaatggctcaggctctgaccttgtctcaggaactctttgtagcacttcccaggaaggtaagtgttttgctttggcttgtgacgggtggtggaaggcatatgtgtaggctgaagggaggtagagagaggacactagtcacattttcctgcttgagactaggccttgctgtcctaagaaactttagagagtaatttcttcatcgtattcatagccagaggggttaggcagcttgttcgaggtcacatatagttggtaacagtattgaaaggagaacttggatttcctaattcccaagttagtggtctcccactggacttggctgtcttagaaggatgactccacccagagagcacagacttccagagaactggctctgtggtgattacattaacaagatgggtacaatggagttcccctaaaatggttttgctatagcaagtttttctgggatctccgatgactgtcttctcttcctgtctacccctcaccccagttccctgctttctctttgccctgtttaattttgagctctgacctttttgaattctgaattctgactcagcgctccagcttgatctgtcccttgagttaggagaacagtatggcactttttcaatttagtgacagtatttgctgctgtagcaaattgtttgaatgcagactagaatctcctggcctcaaagttcaccactcacctctaggtgcttataggccaagcctggggcaggaagctaaaaaaagacctttcaagcctccgtggaaaggaagcatagagtagtgttgaaaaacagactctggaactagactgcctggactcaaatctagctctgcgaccaactagttatatagccttggacaagttatttaacttctgcacctcattttccttaaccataaataataatagtacttacagagttgctgtgaggattacatgaggtaatttatgtaaagggcttagaactgtgcctagaatctaacaagtgatatacaaatgttatgattatttactgaattttactatatgcctaactttgtgctagatgggatggataagaaagaagacaggtagttgaattcttaccatttaatgagtggttactatgtactatttaccataagggatagaaataaatgaagggatgatacaactgctgccttcaaagatctcctatctcctatttaattg

SEQ ID NO: 28 - DNA, 129637 bp, Homo sapiens
tctggttctcttctgtcattgtagtttcacctaatatgtcaataagcaaataaaatgttttgtattttatttgtaggtacagtttatttaaataatgtctggttctaaagatcttacttgtctgcatgtaaatatttcttcagctttcttaggtaccaggaaaaaagttcatattataagtgaaatttcactctaccaatcaacatttacaaaggacttttcatctctgtgccaccgctttcagaaatgtcctccttgggcctggagttttttcttttttgagtgacttcataagtattttctgagagtacttgagggaatgttatgtttagaaactaaatacatgtattttaattactattatctaaaatacgtattcaagaatgattaacttaccatgactatatttgaaaatcagacaaaaggtcactcttagagattagggagagaaacatgccaacggttttctttttttcttttttgagggggagggtccgcaaatgtcctgaaccaacatcctaagatttttgtgtaagtgttaaaacacagaacaaatgtttcttatttcccactgccgctatcgtccctctacattgagattttagtttgcttgatgagagaagctctaacttatattttcctttgtggaccatctagcagagtattgcacaccttacagtgtccaaataaatttatgatttgaaattttgaaaagtaacaaatcagctataaatggaaaaaactgtgaataagtagaagacctaacaagacaaataagccatatatttagcagatagaggcacaaattgagaggatatttaatgacatttcctatgaacattttaaagttgtataagtgattataataagcaatcattagccatgttttatattgtttatccaagatattttaattttaacctgtagttaggtttaactacagagctggtatctgtttcctcctcgcagctatattcatgtattcatctaggtaaagattcagaatgctaagatagcatcattttgcttcattcatattcctcagtgatgatcataccatatttcctcagctgattaaaaaaaggcagattctttgttctgtcttgaaaggtgatgtggaatgaactcagcctgcctttgtttgtccatatcacatgccatattagtcttagtgaataatcaaatgtcaggaaaggctgtcttttctagctcttggtggtgctgacacacagagaaacacagtgttttatactgtacaagtttaagaggatactatatagaatacagattcataaaaataaggttatacaagtatgcaataaattaaacaatgctgtcatggatgtgataagatataggtaggcaacatcaaactgttaggcttactgctatagtttattctttaactgatgcaaaatgtaaaatactcaattttcatgtcattggaatctcttattatattttttcccctcaatttcatcatgtctttaggtatgttacagtttaaccctacacatgcttactatttatgttatatatattgcatataattatagatacaatgtttgatccaattacagttttgggcttgataacagaaaatcagtaatgcaaacagaactgtcttttggacaaattttcattaaaaaaatcccaagtctatagcaaagaaagactatctgaatttagcttttccttctttcttttctctctatatttactttctcattgctgagaaaaaagaaagataaaaactgagtgtgtttgacttgctctttccatacctgttacagtaaaatttttaaagcccaaaatatcagagatctgctaaggggtagcagggcttgatacttcatatgccaaagagaataggagagggcatggtgatgtaacttaaagtcaggaagaagacagatgctcctttaatagaatatgatctaagattgcacttccaaaatagtggagtaataatcctggaaaatcaacttctctgtagaagcaatgagaatgttggcaaaaatggtcaaaatcaatattttcagaaatttggaaattaggatgtgaacacttgatgagcagttattcaagaaaagtgactaaatcttggtaaaacagtgagctttgtggtattttaacttgctctattctcagcctcttttcacttgaagatagatcaattgaggttttctagtttgacaaaatgaaaaaagaacaatgagcctcagagacagaaggacaccatgaaatatgtcaacaaatgcataatgggattcccagatggaggggacaaagtgaaagagggtgaaagaatgtttgaggaaataacattcaaagcttcccacattggctgaaaataattaatctacacatttcatatggtttggctctgtgtccccacccaaatctcatctttagctcctgtaattcctatgtgttgtgagagggacctgatgggggatgattgaatcatagaggtaggtctttcccatgctgttctcatgatagtgaatggatctcacaagttctgataaggttaaaaacgggcgttttcctgcacacgctctctttttgcctgccattatccatgtaagatgtgacttgctcctccttgccttccgccatgattgtgaggctttgccagccatgtggaactgtgagttccccattaaacctctttcctttgtaaactgcccagtcttgggtatgtctttatcagcagtgtgaaaatggactaatataacatccaaaaagcttaacaaactccaagtaaaacaaactcaaagagatacatatctagacacatcctaatcaaactgttgagggataagcaagaagacagaatatagaaagaagacagaaccaactcatcacatacaaaaaatttcaatttggttaacagctaatttctcagcagaaaccagggaggccagaaggcagaggtttaatgtattcaaagtgctgaaattaaaagactatcaaccaagaatacaatatttgacaaaactatcctttcaaaatgaagaagaaattaaggcattctaagaataaataaaaatggagagagtttgttgctagcagacctgccccactaaaaatactgaagggagtctttcaactgaaatgaaaggacgttgtagagtaacttgaatccatatgaagaaataaagagcaccagtaaaataaataataaagatcagagtagaaataaataaatagaaaacagacaagcaatacaaaaattaatgaaaaagaagtttgtttctttatgccatcaagaaaattgacaacccttagctaggttgatcaagaaaaaaagaaataaaattcaaattactaaaatcagaaatgaaagagaggaaatcattttgaccttaaagaaatacaaaagattataagggaatacacaaatgaccatataacaaaaattaggtaacttagatacaatgaataaaattacaaaaagtcacaatccactgaattggctcaagaagaaattgaaaactagaaaagacatgtaataggtaaacagattggatatgtcattttaaaacttgccataaagaaaagcttgctggagctctctccagattgcttcagtggtgaattttaccaaatgttgaaaaaagagaatgagtactacttcacaaattcttccaaaatttgtgaaaaaatagctcctcaaaaaaattcacatctaaattcctggaacctgtaaatattacctcacatggcagtctttgaggtgttattaagtcaaccatcttgacatggagagatgatcctggattatttgcatggccttaaatgcaatcataagtgtcttcataaaagagcggggtaaacagacagaagagaaaaggtaatatgaccatggaggcagagatttgaatgatgcagtcacaagagaaaaaggaaaatgctggcagccaccataagctggaagatgcagcagaaggattctcctctagagtcgctagagcaagcatggccctgttaacaccttgatttagcccagtaacaccaattttgtatttttaccttttttttttttttactttttaggatgggtctatgttgcccagggcatgcaccaccattcctggcaaacattatattttgatggcaaaatgatgaatgattccccctacagttgggaacagcatgtctgctcttatcactttaattcagcgttggactctcagttatagacagggtaattggcaagaaaaataaatgaaaggcatccagattgagaaggaagaaataaaactctccctattcacagaaggcatgtatagataatcttaaaaaatccactaaaatactatcagaatttcgagccaaatggcggactggacacagccagcaaaaacatctgccactgagagactaggacattgggaagactggcattggcacactctaagcagatcttcgaagggaatgcattgggactggacagagggaggatgcagacactgggctgaaggaggaggaagctgggaaccctgcacagagctactgagcaccgggactcattctgggctctcagcgacttctggggaaggagtgagttgaatagtccaggaatggccaactcttgccacagacctctggaacttgactggcacttgagctggcatggacacttgagctggcaaagagagccgcttaaagagatggtaggaacaggactccaggctgcgtggagcccagaggttttggtgagggaatgtctgcagtggaatatggccagggacacccatcttctaaggcttgccatgcttctctaggacactttggccacagggtgactgtctgacctagagagagcaggacaagctctctggtgagataaatccagtcctatctgaatgcccaggccattctcagggccccagcctggccatgctcgcagaaagcccagcctcagctgcccaaccagggtgcttcctgggtgccttcattatagctcttttgctggaagactctgcctgatcatcagagagctccaacagagcaatctccatcaacatgcaccagcccacctgcaccctcctcccactgcagcctccgctgtgctgctttgccagcacatgcttgcccatggccacctccttactgctttgctggagcatgtacacaggctgacctcttcttccctcccccgctgacatgcatgtgcacatgcgttctgttgcaccactgctgctggcatgaatgcaacctgcttacattccactgacacatgggcactcatggatgtcagcaactccacggctccaccagcaactccacaccactgctgttggtgtaaatgagtgcacagacaccagtgtccctgtccactgcctttgcaatgacaccaccaatagtgtaaatgcacacacaggtgctagcagccctgctctcctacaccaacactatcactggctgaaatgtgctcatggatgctggcagtctgttccccaccaacactgccactgctgcctctgtgaacatgcgcacagaggccagcagcctgcacccactaatgccttgcctagactgccaccactgctattgcaagtgcaagtatggacaccagcaatcacttccacctgtgcccagtcactggtgcaagcacatgcaggaacaccacggtcctgcttctgctggttccccatccctggcaatgcacatgcaccctgccatgctgccatggctgtgggcacatgtgagtgagcatggatgccactgccaccaccctgatgaagtgctttggctggcaccacccttcatagtattgtggctagcagaccaggaacacctgagcccctccagtgtagcaggttcctagccatgagggtccacagaacaaagctggaggcctggtatcagcccacagagttagagtacacagaccaggagtgctgagctgtaccttggcctactaaaatcttccagaaatgaacgcagtcaactgaacccaccttataccacaatcaaacttccaagggcatcaaagaagataaaagcgaaaaacaatctatccaaaggacagcaacttcgaagattgaaggaacataatccaacacagatgagaaagaaccagtgcaagaactctaatgactccaaaagccagagtgccttcttgactccgaacaaccatgcaaatttcccagcaatggtttttaaccaggatgaaatggttggaatgacagaaatagagttcagaatatggacaggaacaaagagcatctacgttcaggagaaagttgaaacccaatccaaggaagctaaggaatacaataaaatgatacaggtgatgaaaaatgaaatggtcattttaagaaagaaccaaactgacataatcgagctgaaaagctcacttcaaaaatttcataatacaggcggggcacagtagctcacgcctgtaatcccagcactttgggaggccggggcaggcagatcacgaggtcaggagatcgagatcatcctggctaacacagtgaaaccccgtctctactaaaaatacaaaaaattagccaggcgtggtggcagcggacgcctgtaatcccagctactagggaggctgaggcaggagaatggtgtgaacttgggaggcggagcttgcagtgagccaagatcgtgccactgcactccagcctgggcgacagagcgagactctgtctcaaaataaataaataaaataaaaagagtgcggggtagtggcaagtgctcgtagtactagctactcaggaggctgaggtgggaggatcactggggcccagcagtttaaggctgcagtgatctatgatcctgctaccactctccagcctaggtgacagagggagatcctgtttcaaaaaaaaaaatagaagtactgatcaaaataaacattatggattttaaccaactacaaatcagatgaaataacactaggaatgttgtattgttttcttacatgaagccatccacttctggtaaatttagccttgggtgaatgtgctttagaagttgagattcattctttaaaatactagagagtttactaccatatttttgcttatttttatattttacctttcttaacgtctttggctgcctcatattaacttaatccagaacatttttgtgttagtttcttattgatgctgtaacatattaccagaaacttagtggcttaaagcaatacacatttattttcttaccattgcagaggccaaaagtctgagattagcttcactgggctaaagtctaagtgtggccctggctgggttttctggaggttctggagtggtggtagtgagggaggaatgcatttccttgcttttctagcttttggttgctgcctgcattccttgacttcacctcttcttcacatcattccaatctctggcttctgtcatcgaatttccttctcctcttgtgttgtcaaatctccctccaccttcctattataagtaaatttatggttacatttagggcccacctgcataatccaggctaatctctctattataagattctcaactgaatcatatctgtaaagttccttctgccatttaacgaatcttgaacaggttgcaggaattaggacctgaatatctttgtgggctattattcagtttatcacaatatataaaacatttcttttcaaaggcacttaaccttatttctgttttgtgccagtgcttttctgtccaaaatgcaaagtttatcctatcaccaactttggatctgaaattttatagaaaggacactcaggcaactgtcaccctttctgggatgttccctgtttatatggtgtaaagtgcttcaacttcccaggcataaagcgtcttggtgctatggatacatttaaaccagccagccaaccaaccaaccaaccaaccaaccaaacaacacaaatactcttaactcttaaaaagacatatcctaatttttcttcaaaagaagtattatctctttttcttcttaacactttgttctgtttttgttgatctcgtttctcaaatcccatataggtggtattttgtttgcttaagcagggtctacaactctgctatagtaagaggactggaaccaggactgggctctttgctccccacgtcctaaaatatgccctttttgctccacattcttagaccttgcttaaccccagtggtccctattttcccaaggaaggagagttcccatggtattttttgcttgccagtttctggttcttatggttctttcattggcgataatcgttcctctctgagttcttagcgataaagacaagcgggtagttggggcaccatgaatctttctatcaactgacccctgatttcactcagattatattagaagtctctttactacagcaggattttacttcagaagaaaaaagatgatacagagtaagaacatgcagtaattggaggtgaacagtggcaaatggccatataatccctcaatcttggggatgtgtatttgtccatttcatttaaacatggggaggattagtgttctgaaaatccaaattaaattatgcaaacactatctgtatatagaataaaaagactgaaaaactaactagaattaattggaattcctaaccaattttctgcacattctttctgctttgttatgattttccttttggaaatggactaatgtaacctactaatcttaggcagaattgcttactttctaggatagcaaagtaattaaagacttgtttttatgagagaattttatttttgttcctgtctggaatagagtaaacaaagatctaatttacgtcaacaaaacactttataaagctgagtaaatgacaatgtcaataaacacatgaaaggaagatttgcttccaattcattggaattcattgacctgacaaaatctcatatcaacatttcttccggaactaaagctttggataaagtaaaaatgtattagcacactctttttgcctctatctttttgcatcctcatttctctccatctttttcctgtgtaacgaagtgacattcaggcaacacaaagatgggcagcagttagaaaaggacaggccccctaatggattctcaatgtttggttataaagtcggattacttgctggcacctaacattagactacttgatgcaaaacctccgttccagcctgatgctccattccatcaagctaattatcccaagctagaagcacagaggggtcacttatgtgtgggccttccctgttaaagcaatttttttttatgggccaaggaggaaagtcttcaatttggactcgtacagaggatttcctttgtcctgtgaaacagtcagatgttcaggaatgatcctttatttacacaggaagtttctaacaatagatcctgattctgctattaggtttcctctttctcatttattctaagagaatttgaaattcaaaaagaaaagagaagaactgtgaaaaagcatgatgtcttgaatgtgctattgaagtgaagattaacctttataacagggcatctgctatgccacagctctatgtgtaaagtctgtttactaaagagggcattaatcaagacataggcatccatttataatctctttgcactgttgctaactccagagtgagctagtgagtaagatggctgaagcctgacagctaatttaaagccagggtcttcactgtccagagatttatcagagagtcaagcagcttgtatcttttatgacttgcaccttcttctttttcagaggtagtaaatgaaaaagatggaaaaaggaggtgccaatctattgcagctgtgtaaaatcacataaacaccatgccctgggctttcattataacaccaccttgttagctaattactgtcagcattaaattacagagtcaggaggacccactcaataccaattcattcatttcaggtcacagtttggcagaaaacatgtagcgaaaggccaaacctttatccactgaaccttttatttgtgactaaacaaaagtcttgacaagtaatataacttgcatcaagcagggctacagcaaaggccgattaatagttttttgtttatttaataaagatttgctttatcctctagtctacttgacaggacttatcattttgcataccaaaagacacaaaagcttgtagattatttttttctcaattcaagcattgtgtctaagtattaccaaccttacaatcaatgagtaacatgattaaaaaaataagctcaacattttacatttctcagatctgagcagttggttttccatactgtgctgtggaggtaaatttttggtggggttggttttataatacgttgattggagagatttactatcacaaccttttaaaattccattattgtacaatttagaacacaggtggtgagaccaaaatgggcttttcagaagtgtagaaagcttttaatctgcttaggtattttctgggatgaaaaggtatataaagctactaactttgcagaggggttgattttcttttttactatctagctgtcattcttcaaacagcttatttagggaaaaaaatcaaatgtatttcagcctcgtatatatggttggcagtctgtcatagcttcttaaagtgattttctgattatatagaagattgacatgagaaattcaaaatcaacatatcttaaactcatgccggtgagtttgaatgatgatattaatccataagaatcaatttcttctgatttgctgtgcttgggttttacaacataaggaaaatgcatttggtgaaaacacttcttgctttgagtgaagagttattcaaaccttaatcaagcaagagcctagactaggcactttctcacatatgaccttatttatttaattctcacaagtatggtgtgagttacagataattctgtattacagatgaggagagtcaagctaagcgaagttaaatatcttcctgaaggccacatgctcttaagagaattgaaacacaagtattctaacttgaaagtcactgacttttctgctagaacactgtcccttctgaacacaaattgtcaggagggtaagattatatctcttgttgagctcatcattgctgttctcaatggtcaattttaaaatgcagcgccccccaggaaggtttctggaagcatactcttgttctctgttaattggcaaaccaagagttcttcttcaattcatggatggctttggtagctttcacacttgtgaacataaacagttcactcaggtgttgctctgatttgcccactgtgttttctctcattttaagtcaaccggaagacaaataaatactcatgacaagttgttaacagagtggaaactgctaattagagggtttaacggaagtgggtgagtatgaaaatgtagtagtctgtgggagtcctctgattgtagacctctgagacttggcggagattggggcccggcagctacatttacaatacaaacgttgtacatctgcccctctgatatggtttggctgtgttcccacacaaatctcaacttgaattgtgtctcccagaattcccacgtattgtgggagggacccaggaagaggtaagtgaatcatgggggctggtctttcccgtgctattctcgtgatagtgaataagtctcacgagctctgatgtgtttatcaggggtttctgcttttgcttcttcctcatttttctcttgctgccaccacgtaagaagtgccttttgcctcccaccattattctgaggcctcctcagccatgtggaactgtaagtccaattaaatctttttttgttcccagttttgggtatgtctttatcagctgtgtgaaaatggactaatagaccctcctttattagggcctagtgaaaggtaacctttctactatgatggatttcataattgtaaaatggttgctagtaaggcatcacttttacaaatatgttttgtgtcttgtctatactattttcctaatgaaatcagggtgaggcaggctttttgagtgtctcggaagggcttggcactgaagggggcgatattaaataggacatagtccctgacttcaaggaaacgatagtgcagttgagcagcagaaatgggcagatgtttacaatgatatgtacaacaataaaaagtgtacagtatagagtagaggcacaagagggtgttaggaactctgggtatgagggctaaggaaggctttcagaaaaggtggccttaaagaataaaaagggatttgctaagcagagaaaactacaggttcaaaggcaggcaagaggatgtgaaacagcataactcaaacgccatgggtccagggttgaatcaggtcagtggaaggggtacacaggaaggcagatgttaggttgtgaagagacctgtggaccatggagctcggccattgtcttcaaggccactgagtgccactgaaggcctttagcaaaggattgccatgatcagatttgtggttaggaagcaatactcaacagtgtgggtacagattttagagtgacaaaactaaaagaatggacaccaattagtacttcatgtcatattatctttaattacaaatggattaaaaacactggcactctttttttttttttgagatggagtcttgctctgtcgcccaggctggagtgcagtggctcgatctcgtctcactgcaagctccacctcccaggttcatgccattctcctgcctcagcctcccgagtagctgagactacaagcgcccaccaccacgcctggctatttttttgtatttttagtagggggtttcactgtgttagccaggatggtctcgatctcctgacctcgtgatctgccttccttggcctcccaaagtgctgagattacaggcgtgagccactgcacccagccaaaacactggcactcttaaatgatttctaaatttggtgatggtgctgctgttatattttatttttttgatacagactcttgctctgtagtgcagcctggggtgcagtgatgcaatcatggctcactgcagcctcaaactcctgggctcaagctatcctcccgccttggcctcctgagtatctggactataggtgtgtgacaccacactcagatgatttttttttctttttcgatagagatggggtcttgctttgttgcttaggcctgctgtcatcgtttaatgtttataagtaactaaattgatcaaccttggttttaagctggatgccccagggaaagagatgctgagatggaaatctgtggagaatcgctctcaaaatcaatacctatagggcagtgaagaaagcaggactgggcagagagaggaggtgggctgtgctgcaatcaagatagaagaatcaagccagcccatggggcactaaggacttggatgactcttgcgaggggttgaatttttataactctgtggccagtcactggatgtggtctgcttccagggaggtggagagactgtcttaggctctgggcaattcctggagtgggattcagctaaaagacatcagctgcgatagtctcgcaactaggggaatgaatgctttattctatgagaactcagccgagtgatcagatgcaagagggcatccactatcactaaagacattaaaatccccctgagtacactcttgtagcgtaatcacgttcatgtacagactctcttaggcctttgcacttgctttttcctctgcctggttattctttacccggatcttttatgctgctgaattttttcttgatacttggttttcacttctaatatctccaccgagaaggcttttctgactaccctgtgtaatcagccaccactcctaacagtcactgtctaggacatcaccctgttttcttttctttatatagtggaataagataaatataaatctcattatctgtcctcccatccctaaaatgtgagctccagggacctttttctgtcttgttcactgctgcatcccctgtaggcagaacagggcagatcacatagtagatgaacaatcaatatttgatgagtaaataaataaaaatgaaatttaagaaaatggataccagaaaaattagaatttttcaaataacaaattttgagaaattattttgcttttgacactggtaaaaaatcaagtccaggctgggtgcagtggctcatgcctgtaatcactttgggaggctgaggcaggcgaatcatctgaggtcaggagttcaagaccagcctgaccaacatggtgaaacctcttctctactaaaaacaccaaaaaattagccaggtgtggtggtgcatgcctgtaatcccagctactcaggaggctgagacaggagaattgcttgaatccaggaggcggaggttggggtgagccgagatcacaccattgcactccagcctgggcaacaagagcaaaactccatctcaaaaaaaaaagaaaaaaaaaatcaagtccaggaaaagaatatgtgtctcaccactcgtatacagttttcagtcacccacagagaactactggagaatatctcttgatcatgtgagacggataggcctctggcaagagctgagctctaagatctcacattgagtataattttttttttttttttttttttttgcctctgggaaatttgagggcttttattattgtaaaaaaaaaactatcttagaggaacataaattatgtattaaagagacttttggaatttcaacatagaaatcacaagtggaatttgggtagaattgaccagctactcctctataatcatctaaaccatcttccttcaaatagaaacaaactgaaaaatgtagtaattttcatgtgtagaggcaaaaaggcacttagtacagcttgaagactcaaattattctggaaacaacactgcggtacttggctttaattggaactccatctcttagaaacagattttgagtcaagcctcatgacaactgctgacttcagaagggccgaagatagcaaggcatggaggcagagcccttcttatcccttcctttagccttcccctgcctgcttcatccctgttattgtaacttacatagtgatcccagtccaggaaacactcctgtgtttgtttaagaagaatggaaggaatctctggaagtcatttattccagttcgtttcactagccaggaatgaatggatattatttactatacattcacttttactcatatttaaatatttagattcttttactaaaatgttgagttctctgatacaagtaagagtccagagagaaaaacaggcaacattttggtagttattaaaagcactgagaatacttagggcagatctgcagtattttaagcaaaagaagagagtcaagaactgcagggtagcacaagagaccatgcctggtatgcagatttggctttacctaaggaagtcccatttaagaatttgagaagcaggccgggcacggtggttcacgcctgtaatcccagcactctcgggagttcgagaccagcctgaccaacatggagaaactatgtctctactaaaatacaaaaattagccgggcatggtggcacatgcctgtaatcccagctacttgggagactgaggcaggagaatcgcttgaacccaggaggtggaggttgcagtgagccgagatcatgccattgcactccagcctgggcaacaagagtgaaactccgtctcaaaagaaaaagaattagaggccaggcgcagtggctcacgcctataatcccagcactttgggaggccgagacgggtggatcacgaggtcaagagatcaggaccatcttggccaacatggtgacacccatctctactaaaaatacaaaaattagccaggagtggtggtgtgtgcctgtagtcccagctactcaggaggctgaggtggaagaatcacttaaacctgggaggcggaggttgcagtcagccaagattgcgccactgcacccagcctgggccatagagcaaaagaaaaaaaaacagaaaagaaaagaaaagaatttgagaaccttagccaggccactggctcatgcctgtaatcccagcgctgtgggaggctgacgcaggcagatcacttgaggtcgggagttcaggactagcctggctgacatgacaaaaccgcgtctctactaaaaatacaaaaattaaccgggtgtggtggcacatacctgtaatcccagctactcaggaggctgaggctggataattgcttgaacctgggaggcagaggttgcagtgagccgagactgcgccattgcactcctgcctgggtgacaagagcaaaactccatctcaaaaaaaaaaaaaaaaaaagagaactaaagaagctcaagtagagagtggggcctcagtacatggcgaatgctcagtcactataggtgttcaaatagagcatgtacagcccttgcaaagggtatcctagaaaaaattcaggaaacagaagcaagttgatctctaagggcccttgcaaccttaaatttctgtgggtacagagagtggctctccatgattttgtgtctctagatagttgtttgttgtgataaatgctttacttttaaaattgtaattgttattctctttaaattcaaactttcctttggaattccttatcttcctagacatttaaatatgaaacttataagttatttatagatcagtctctgtttctctttttctcatgcacgtctctccctcatccttgatctgttgattttttaaattaaaatagtcttttatttagtttttatttttatgaaacttttacatacacacagttaaaacaaaagtgtccctcacccttcatttcctcttctctacaggcaaccactgtaagttcctttcactgttccatttggtatatatcatcatacatctacatagcaggttcatatttctaggtattgattttttatatttcggcatgatttattgaattctcactaggaaaataaggattttattctctttcaccactttccttacctcctttctcatcctttctcccattgtgttataacttaggctaaagcattactcagtcttacagtattatgactgtttacaattgaggcacacagtttgcattttccttcatgatttaaaatttgtttggatttcataattatgctttttgtttgtgtgtgtagtttctttgcttcctacagacatacacatcattaattcaaacccaaactcttctacatttttccaagtctcttctcaattctttagttaggtgtgtcagataatttattgacgttatcttcttgaataaatgctctcctagaaccttttggcttgttctggcctgctgcagtctggactggttgcctctgtagctggtgtacagctgacatcctatcttgggattttcctttccctgttgattcttaggcctactttgtagaaccttttcctgtatcccatgtcttctttcttggttgactctgtaaaccaaaaataaaatttgaaggcccccccaaccatctgaatggacttcctccactaggccagggccctccaaatttaacctgaaagactggttcaagccatgacaagaaggtggggtggtggcgggggggtgggggggttggacacacctcattatgccctcctacctcttggaattcagcaaaagcccaccagcttttagcagcaacgcagaccttaaatctgataagaaacatttacaatctattctcgctgaagcctgctacctggaagcttcatgtgcatgataaaacttttatgcaaccaagacattcctttctattgatagtaaatcaaccaattgtcaatcagaacatttaaaaatctacctatagcctggaagtccttgcccctcttcaagttgtcccacctttctggaccaaaccaatgtatatcttaaatgtatttgattgatgtctcatgtcttcctaaaatgtagaaaagcaagcttcacccttaccattttgggaaaatgttctcagggtctcctgagggctgtgtcacaggccgtggtcactcatatttaactcagagtaaacctcttccgatattttactgagtttgactctttataacactttcatttttggtagagtcacaagattccactgaaagattctttgaggcaaattttttgagcctttcagaagagaatgtttttcttctaccctcatacttgattgataacttttgactgaaggtagaattctagaatagttttcccctagatttttaaatgccttattttctgctttttacggttaatgttaaaaaactaagtcattctggctcccaaaactttgtatgtaaactgtgtttttctctcctctaccgccttggaaacctgtaagattttctcttctctctgaatatcctgaaattgcacagtgacatctatgttgatgaaaaatgtcaaactctgtaaaatatttgaagagatttattctgacccaaatatgagtgaccatggcctgtgacacagccctcaggaggtcctgaggacatgtgcccaaggtggttggggtatagcttggttttatgtattttaggaaggcatgagacatcaatcaaatacatttaagaaacacattggttcgtttttgatgttcgtgaccttcggattgaagactggataaagaaaatgtggcacatatacaccatggaatactatgcagccataaaaaaggatgagttcttgtcctttgcagggacatggatgaagctggagaccatcctcctcagcaaactaacacaataacagaaaaccaaacactgcatgttctcactcataagtgggagttgaataatgagaacacatggacacagggtgggggcatcacacaatggggcctgttgcgggggtgggatcctgggggaggggtagcattaggagaaatacctaatgtagatgacaggttgataggtgcagcaaaccaccacggcatgtgtatacctatgtaacaaacctgcatgttctgtacatgtaccccagaacttaaagtacaattaaaaaaaaaaaagaaaaaagaaatacattggtttggtttagaaaggtgggacaactcaaagcagggcaggttgggggggcttccaggctataggtaaatttaaacatttcctggttgacaattggttgatgttgtctgaagacttgggatcaatgggaatgttcaggttaaagaaaaagaattgtggagactaagttttattgtgcagaggaaactcttaggtagccgactttagagagagcaggttgtaaattgtttgctatcggacttaacagggttcttagttgattatctcctggatctgggaaggaaggaaggaaaagaaaggaggaaggggattctctatagaatgtggatttttcccacaagagactttgcagggcaattttaaggtatggcaagggaatgtattttggggttaaatatttttttccttgtcttataatgttatgccagagtcagattgaaaagtataagtcacgatatataaggtcaaataaaacccatctgatgagaatttatggtttgtagagcatgactccctagaccctttaggtaggaatttgggtaagataaaaaatcggagcttagtcctcatctatttttattatttgtgctggccacgtgaattaagcctttaaagtctagaaaaacatgtcctctagctctgggctattttcttgaatcattcctttaatggtttcctcccctccattctctatattctgctggaaactctactatttggctggtgaatctcctgggatggctctctgatgttgctgttgttcctctcccggttttcagctctctttttggtctcctctctgggagacttctccactgttattttccaacgtgtctactgagtttttcatttctacccttggatttttaatgctttattttgtctcttctctttattttgttttaatagcattctgtttttgtttcatggatataatatccccttctatttctctaagtttatcaacattagttttattccccatgttctctcaagagttcattcccccaacttgcttttcttaatcagttgattaaattttggtttctatcattcagcttagttactttcctcatgtgtctggtgattctcctgtgtgagagtagggaattagacttgtatagaaaatctgcacaaagcctggcatggtggctcgtgcctgtaatcccagcactttgggaggccgaggcaggaggattgcctgaagccggggttttgaagaaccccatctcttccaaaaaatacaaaaattagctgcgtgtggtggcatgtgccttgactcccagttacttgggaggctgagttggaaggatcgcttgagcccaggaggtggaggctgcagtgagtacagattgcaccactgcactccagcttgggtgacagagtaagattctgtctcaaaagaaagaaaagaaaagaaagtcttactggtcttagtggatggttgttggttgtcatttatgggatgcaccacaggatgatttggctgggcctttgcatatcttccagtatcagtttttccttttgagctggtcaaattcacccaaaaagaatcttttcatctcctgtctagaaaatttatgtgtattgctagaattctgggatccaaattggagaagggagctggaaatcttagcactggacatgtaaaccctaatttcatactcccgccttcattttccataaatcacattcttttccttatctgtgctacatactcctcagtgtggagaccctgtattttatttttttagagaataaaactcttgtttgcaaggaaggaggggttttagtgaactatttctcaaacaacagacttccaaccagtctttttcttttgacacagaggacagattctcgctctgttgcctaggctggagtgcagtggtgcaacctcggctcactgcaacctcggctcactgcaacctctgcctcctgggttcaagcaattctcctgcctcagcctcccgggtagctgggactataggtgcatgctgctacgcctggctaatattttgtattttagtagagatggagtttcaccatgttgcccaggctggtctcaaactcctgagttcaggcaatctgcccgcctcggccccccaaagtgctgggattacaggtgtgagccaccgcacccagcttttctttttttagagacagggtctctctttcacacccaggctggagtgccatggcatgatcacagctctctgcagcctggaactccacggctcaagcaatccttccacgtcagccttccaagtagctggtactacaggcatgcaccaccatccctggctaaatttttaaatttttgtagagacgaggtctccctatgttacccaagctggtctcaaactctgggctcaaatgatccttccaccttagcctcccaaagtgctgggattgtgggtgtgaaccaacgtacctagtccactcctcttatttttaactctgtttctataagtacctggtgctgccaattcctcaggttttgggagattctgtgttataaattgggttgcttcaatccatcatctttatccatgaattccattcttagaaatctcttatctatcaaggacatgtcagtatctttattatttttcaaatgtatgacgttaatagcttttaaaaataactttgttctctgtggtaatattagtttatggttctaattggcttacactctttatgaacaagcatagaatactgcccaaatttcactttgcacgtgtcacttcttgctcataaaacggtaatgaatcactatgtaattaaatactattttttatcctgcattctaggatcttcgtgatgaatgtacatctttctgggctaatattccattactgtatacattcaattaaataagtatggattcttcatgattccctctcctgctttatgacttcttgtctctttgtcattgtttctcacagttcttagagcgtggaagttcctccctacccttttctgactattgcaatgttatttccccctcagtgctcatttccagggtgacctctttcgtgaaatctttatttcagtattccttcattcatatggtcatctttttgctcattcactgtatatttacggagcccctagcatgtgctaggcaatgtgctaggctacagggatacaaaataagcaacaaagacattgtccctgccctcatagagcttacagtgcagtgggaacaggatggaagcgggagacagatttaaataatgacacaataaatacctagctatgagttgtgatgagcattaagaagaaccgattgtgtctaaaaagtgaacaaagtcttccctgcctaagtgacgtttgggctacaatgtgaagatagggaggggatggagcattcttggtaaagggaagaacaagggaaaatctaggaagtgtgaaggactgaggaatgttcagtgatccgaaggaagaccaaagtgacaagagagcaaagcgatacggtggcagatgatgggactggagagttaggcagggtctagatcaagcaaggccttgtggtctaaattaaggaattttgcaccttaccataaggctaatgtaaagttcctgaagtggtttgagtgggaaaagctatgactagatttgtatttttaccacatcactccacctgcagtgtgcagagaacattgggtaggctcagaatggaagcagggaggctatttaggaggcagtgcaattcatgcctatgggagataatggcagcttgaactcaggctatggcaatggtgatggaaagaacgtgaaaaatatttagaaggtaaaattgacgggacttgatggactggatctggtaagggagagggaataatgagggaagattcctgaatttctggattgttcaaaggggtggatgttgattcactgaaatgagaacattgtctcctcttttaggatataaaagaataatgcaagccaaaatgtgctgttttgcgtatgtttttttctgactctccccactaaactacaagcatagtgaaggagagaatatgcttcatctctgtatttgcagatcctcctatccccaaagtgtccagtccagtgtttataccagtggaaggaagagataatgcttgattctgattttggaaactggaatgtgactgagagttggacttaaaaaaaaaaataggcggctgggcgcagtggctcatacctgtaatcccagcaccttgggaagacaaggtgggcatatcacgaggtcaggagatcgagaccatcttggctaacacagtgaaaccctctctctactaaaaatacaaaaaaatagccgggcctggtggcatgtgcctgtaatcacagctactcatgaggctgaggcagtggaatagcttgaacctgggaggtggaggttgcagtgagccaagattgcaccactgcactccagcctgggcgacagagtgagactccgtcgcaaaaaaaaaaaaaaaaaaaaaaaaaaaaaaaaaaaaattggtttaggaaatatttttacctccatcttctaatatttttttccaagttgtatgaaaaacaaatgagatggcaaatataaaaatatttgtgagagaaaaaggtctctcaaaagggatttatgtcattataatcattatacttatgttttctttggccctcactttaagttccatatatttctcttatttgtaaaaaggagaacaaggtaagacatattaacaaaggatctaatcagtgccagatataatgagatagatttgtttttgctatgcacaccactccatgggatgtctgctggaccacttccagctattatcctatatgtgtttgcagaaacttcttccttacttagtgtattacgtagtatttgtcctcattgaatcttaatcagtctttaagtaaaagcaattacttaataaatgttgaaattaactagttcttgaaagcatacaaaggttttcgttaggaaaacctttgtaaacatcattaaaacaaatgtcataggacatttggaagacaaaacgtctttctggttcatagatttcaaatactgtaagacccataaaacagtgcagcttatcacctagccagtgtaaagtattgtgaaatacccagtggtgctgtctttgatggttaaaaagggtttttatttatcttttggggtaaattaactatttggaaaatatcaataatgagggacagtcttttgcactttgatattttctattgccttatgttaccactgtactatcaagcagaaaaatattatatccctatctgagtgatatatctacattaaagttcaatttcacctctgaagtgaatatgaattgtatttaatgaaactctaagagcagttgtacagagtgaaaaggccaaataatttggaatcaaatttgtcaagtaacattttacaaaagtgacatattttcttttttcattcttcatcatgctcacaattcaaaactgagtccaaatgtcacatcacctgttttgattcgtctcttctctgcctgacagaattaggctttttcctctgggctgaaacagccccttttcctttcctctgaaataaaacttgcagcatgatattgtaaattttgggtttcctgaagggaaatgattttctattactcatctttgaaccccctatgcccatcagagttcttggcccacagcaagagctcaacatgtttgttgaatgaataatgtaaattcccccaaagcacatgaactcatttcatgctaaaaaatttcatgttcaaatgtgtattagctagtttctgtaacaaataaactccaaaatttcagaggcttgaccaaatggaattttattttttattcatataacagcagtgtggttgttcttggtcagcaggagggtagctttcaaggactcatactcctttcttttatctctgcctttctctagggcctcagtcagagtcttaaatttgtgttgatttacatctttgtaatatatagaaatccctggatatattcttatataatgcaatgcatactgccttaggcaagccacttacctctcattagttcatatacttaatatttgagagtctacgatatataagacaattctttaggctcttaggatataacagctaatgaaacaaagatctctgcccttgtggaacttacattttatcggaggtagacaatgaataatgagttaaataaataaaatcatacactatgttagatggtgataagtgctatggaaaaataaaaggtgtggcaaggcaaaggagattaggagtatgtagatggttagttgaaaacggggtagatttacagcatagtggaaatcaacagttctgttttggccactcactttacagaagggctgtgaaggaggcaggaggtttgaggaatctggagtttgtgggagaggagtaatcctgacatagaaacttgagagtcatcagtgtgtgaatgcgatttgcacccaagaagtgcatgggacctctgagggagtaaggttagattgaaaggaggtgagacctgaggactgagccctggggacatcccagcattcatagatttgtagagaaggcagagccagcctgagaccgaagagtgccaaaccaggggaaggtttgggtgtcggaacttgatgtagaaagtgtttcaaggagagtgtagacaagcacatcaaatgcggccaagaggatgaggaagatgaggactgagaactgtcactggctttggaagaaaggagataattgctgatcttggtaagaggcatttccatggagcggaggagtagaaagcctgattaaagtcgttggagagggaatgaggaagtgtgggtggtaaatacatagcacttttccaaggagtttttctgtgaaagggggcaaagaagtgaggtggtagcagggtatcacgcgtgtgtgtgtgtgtctacctatggacaaaggaggttgttttgctttcttttcctcttcttttaaaaaaaacaaacatgggtatgttattatgacatgtgtgccaccaaagggaatgacccagtagagaggaggcattgttgaggtatgagagataggagaatttaagaagtgaagccttgagatggccacagaggatgcgattcatagctcaagtggagggtctttcttgagggaagtgacacagagggcagcatggctaatagagagcttgggctctggatgaggcagcatcccctcttttatcctattggacaattctctagtttcaaatacattcttgatatggatgcttacctggatttgaaggatcttataaggctgaaattcacaacatgttctcaatttggtggtggaagagatagtgagaagctgtaacttatgcaatggtcgcctggctgactcttcctatcattttactctcagtttatcacttccttgagataccaccctcatctaaattatgttctgctgtttgctaatacagaacacgtacttctcccgttatggcacctaccacattttattttagttttttgataagttttcttgttctttcgcttaactaaaagctccatgaggaaagcaaccatatttctctttctctctattgtaactccaataactgcacagcccagcgtcaaagaagaattgaatacagatatgcctaccaggcagtgggaatgtaatacatatatttgttgaaagaataaataaatgagattgtgtatgagagagtgttcagatttaaactaactaccttttagatttttttagcaagatctcaggaaatccttttctaattcaatgagaggtagggatttatgtggagaagagtctttaatgatatccacccagacatccatttttttcccttgcattgtcacaaaacatctgaattagattatggctgaaaaaatataattgcgttacattcatgtgatttagtgacacaaattatttgttaataaagtttcttacacatatgtaatagataccaatttttttcctgacattcagggaataattttatctttcttgagaaggattttatgagaaatggtattagctcccacatgtgcaaaccagtgaaaaatccaatattaatcatttttaaagttgtccaacgttgttttgtacagtcatgctgtaggcttgtgtcatccttataaaatggtcctgcagcctctcagttcttgagtggggcaaatccctggtctcatccagggttgcaattatggctgttattcttatggtcacatgatgctgtggctcagatgctgggtccatttgtggtcccatttatgggcccaacattgctattccacatctccagatccaggtccttgctcatgttctgcagaaactccacatgagagcatcttgggtaggtccccagactgggctcctgatgtcctgccctgtaccctttaagtgcctgacacctttaagaccctgcccctgagctgctgcagaatctgcaaaccttgtccttattcacaattctgcattatctagtggagcaaagcctaattctccccttccaatgtccccaatacagaaaaattcatcctgcttcttctttcaaaactagggcttcaggaagcactagataacccagagcacctagcctcagacccaccgcaaatgaacctgtgtttttgggagtgaaaaggacctgacttcaggaacacagaggcttgattccttcctttcagatggatctacagcaactgggaacaaaaaaagcagaaattaatttcccagttggcatcctgctatataatattttcaataagtcacgtcgtaaacactcaatacacgtttgctgaatgcactggtttctaacactatacaagaaacccctttaatatacagataacatttttaattcgcactttgcataaatggttgggctagaagccttaaaaatttgtggtctggaaagtaaacttaaacattacctttaacttcactgtttttaatattcttaatttgtctgaaacattttccacacaaaactgacctatttctatgtggctgactgaagatagtaagctcatgtaggatttagctcttgatatcttattttctctagcttacaaacagaaatatttattttagttgcctgaaacatatactcacggtcagatctgggggtatgtaaccattgtgtttataggcaaagaatgatcaagtatctgcatctctctgttcctctccgggatttactgtcaaaagccatgcttgcccggtcacagtatcgcctggtcagtctagcttctgtggaagtctgttattttccttgatttcttgggttagaatgagtgaccagaaacacattctgtctcccaggatacaagcctattgaggttgctggaaaatgagcacaatttggatcagctcattaactgcaatggttttcagagcatcacacagagcatgtaaccctatgtggtcaaagacattgcccattagccagcatctggacaatcacctttccatgtggtttctctgaaagatttcacactctctataactgaagcaaggaaaatagaacacctttaatgagcaattacaattaacacactgactcactgaaaagtcaaaattgtggtatgttaggtattagtatatatatttgtaatcatgtttgattttgattgtcttacagctagcacttttttaagaagactttttgagtattttctgaaagaaatgatagttctgattcaatataggttcaaagaagactacagagatatatgtggccctgcccatgacattctaggtggcctcaggcaagccattttacaggtaatgaggggctgggctaaatcagtgcttccccatgatgactgaaaaattaaaaatccccttgggagcttttaaaagtaccaattttcaggtactgccccagattgattaaatcagacattgtggggtgggagctggcagttgtattatttaatagcttctccaaatgattttactgtgcagccaggattgagaccattagactggatgatctatacatgttttaccagctttcacagtctatgaattatttcaatgtgttttccctggaaggaagtttctattatactgcagtctttttattcaaatttttggtggcatttcccttatttttcaatgtaaacattgtttagataatttgaagaaataaacatcacaattttgtatttgaggtttctaacaacatagagctggagaggagggcagttttggtgttagctaggctgtgagtctatatgcaagtgaggggtggtctccaatgcctgtcagttacttgaccagtgtgtctgtgatccaagggcctggctgactccctcaagggtagtcctgcctttagcactaaggttaggacccagaatcatctgagcactgctgaatagaagtcctttaacttgacatgtaagaatcattgcacagaactccaagtgtgaaggatgctaggtggtgttcatgtgcagctgggttgagaaacattgaccacactgatacaatctaattccttataaaatgtaaaacataattggcaccttgtaatttaattaccatatgcatagcataagactagctgtgtagtttaggctaaatatgttctgtgtgccagaattttgatctgtaacatggagctaataatagtaccttttaattggattataatgaagcttggttgagatgattgaggaaatgagcttaatttagtgcctggaacatggtaatcactcaaaaatgttacctattattactaaaactatggctatcactattgttatattattattttttcctgcttttacctttatattgatattaaaaaaaattatgggtgtgggtgtgggggaaggggcaagccttcttttctatgattaacagcaggagctgatgggaaccaaaagttccagggaattaaaaaatatatatatacacacacacacacacacacacacacacacatttatatatattgcactatgcacgtgagtcccagagaagcaggaagcagcagcaagaagcaactagcacacagcaacacccgggcatgtgcaccacacactcaagcaaagccattcctccggctagggcagcagcaatcctcaccttcccatcagctcacaatagagaaaaaagaaacctccttttttttttttttttttgagactgagtttcgctcttgttgcccaggctggagtgcaatggcatgatcttggctcactgcaacctctgcctcccaggttcaagcgactctcgtccctcagcctcccgggtagctgggattacaggtacccaccaccatgcctggctaatttttgtatttttagtagagacagggtttcaccacggtggccaggctggtctcgaactcctgacctcaggtgatgcacctgccttggcctcccaaagtgctgggattacaggcatgaggcaccgtgaccggccattttttttttttttttttttttagagatggggtctggctctgttgcccacgctggagtgcagtggtgtgatcttggctcactgcaacctctgcctcctgggttcaagcgagtctcctgcctaagcctcctgagtagctgggactgtaggcacccgccatcacgctgggctaatttttgtatttttagtagagacgaatttttgccatgttgcccaggctggtctcgaacttctgacctcaagtgatccacccaccttggcctcccagagtgctgggattacaggtgtgagccaccctgccaggccgaaacttttttttttttttttttttttaaaggccacctagtaatttctgccctcatgaccaggaaaaagaaaagaaagaaaaaaaacccaagctggtactgccttgaagggcggaagtggccattttctcctctctgccagagcaggacatgttgtttatttatttatttacttatttctttccacacgctctgaaggacaccgtgttaaaaggacacagtgttaaatgttatttttaacactgaggctggaaggccacatcactgtccctcacaaatacttcaaacagttgtcttcaagatcttacggttctttgcctgactttttttttttttttttttttttgataccgcgaagaacagttgggatgaaagggatccatccattgcttcctttaagatggcctctaggcagtgggttttctgtaagtctggcacaaattctggagccaatctctggcaaggcagagtgctaggcgaggtctagggacccagggtctgcgcttgaagcctcccgctcactggaaattattgacttccagagatacatacattttttttaatttaaaggggaggtgcacagcacaccttcctccactgggagaaagggggcccaattcccactcccccaaacacacacaagtacacactgactaaggcacagctagggcgggggcgggcagaaggccccttgggaggacgtggcgccacagctgcaatgggtgtgggggtgtggagctcatcaccgctggaggtgcttgggggcaggagaagaaaagcctcagggctccccaggaaataggagaagatggtcgggaaataggcagataagaaaaccaacaggaaacctagaaaagaattgagaggaaagaaacaaaagagagagtggaaaaagagaaacgggtgaaaacaggttgtgggcaacagaacaaaacaagaaggaaacagcagaggaaagggaagaacatacatcagagaactgggaaagtgcgatgaattgggaaggaaagaaaaggggaggaggggagatagggaagaggaaaacccaggaaatgaatactcaataaagaaaactcagcgggggcaggatgaagaggttggagaggcaaacggggccctttgggagtcttagaccttgacaaaaaccaggtgggcagagtacaccaggtcgcccacataggccagcaagttgacggccgtcaggttggtcacagccagtcggcggtcccagatacacacaaggtaggggtttctgtcgctgcagctcacatctctcgtctgccagggctggacaccatacttctcgttgaactggtagaggggccagaggacaagggcagtggcatagaggaggacggacagcaaggccagccccaacaggaaactggggaagcggatgggcagcatgttggtgcagtgccccaggctcagcaggatagtgagggccgccaggacgaagcagagggcgtacaccgccacccaccactccagggccggccggttgtggtacacgtaggggctattgatgaacacgaagatgaggcaggccacgaaggtctccagcaccttcagcagccccagctcggaggccatgtagtcagtgatctcgccgggccgggcccgggtccaggttacttcggtggcgtaagccacacaggcgatgccagagaagacgatggcggcgatggcgtggtcgcgggaacggccgtgggacaggaactgcaagtaggtggtggggtagatgatggaggccgagaggcacaagagggccgcatagcaggcaaaggtgatggggaagttgcgccaaaacaaggggaagcgggcctgggagccgcccagctccacgaggaggatgaccagggtcatggcaaagcagaaacactaggtgaacatggaccagttacccataggccccttccaggcgcccacgctggccaccagtgacaaggccacgcaggtggacaccagctgcagcaggcggaggaggcccaggggctggatcagggccctagaggaccctacgacggtgggggaccgcatggtggtcgtgacggttgggtgggtaacagtcaccggcatggcagcagtcctggctgaggaactcacggagaaaaggtctggctgtggaaacggattaagtcacacgcctggaaaaggctgggaacagcgagagacaatgtcagtgtccactgggtctgggcttctccctcccaggacccgccaccccgtggaacaggaacatagcaccgagcagggaagagacctggccttgacccggagaagtcccgcccctctccttccaccagttccactacctgtgtgggctgcggcccaggaaacccagcggaagtgcacaccccgggcaggcgtgggcacgtgtgtgatggtaaccccgctctggcaggggccagggggcaggcggtggtggtggcagggcctggggcagcactgaggggccagcggcccagcaaggcccgactctctctccttataaaggcttcaagtcagcctaaccatttttaattttttaatttttttgagatagggtctcactctgttgcccaggctggagtgcaatggcatgatcagggcttactgcagccttgacctcccgggcttaggtgatcctcccacttcagcctcccaggtagctgggagtactgacaccaggcaccacctgcctggctaattttttgtgtttttagtggaagcggggttttgccatgttgcccaggctggtcttgaactcctgggctcaagtgatccacctgcctcagctttccaaagtgctggggtcagaggcgttggaaccaaagcaacttcatcttgaataggagctgggtaaaataaggctgaaacctactgggctgcattccaagaggttaggcattctaagtcataggatgagacaggaggtcagcacaagatataggtcataaagaccttgctgataaaacagtttgcagtaaagaagccggctgaaacccaccaaaaccaagatggtgatgagagtgtcttggtcatcctcactgccaaactcccaccggcaccatgacagtttacaaacgccatggaaacctcagtaagttaccctgtatggtctaaaaaggggagacatgaagaatccaccccttgtttctcatataatcaggaaataaccataaaaatgggcaaccagcagccctctgggctgctctgtggagtagccattcttttattcctttactttcctaatcaacttgctttctttggagtagccattcttttaactcctttaatttcctaatcaacttgctttcactttactgtatggactgtccttgaattatttcttgatcaagatctaagaactctctcttgaggtccagatcggcacccctttctggtaacaatgggattacaggcaagagtcaccatgcctggctgttgttgttattattgatctatggccaagacttgctccaggaaaatctgcagtcatacattcattctgttgcttgtcattctttgaggtccacacccaaagcctagtctctaggggccacaggctctggggaagtggggggctgagaagccatgcactcaccttcaccctttctttgcatctgctttgtgcagctctactctctcaggccatctgcccttggatgaataagtgccctggctctcttatagaccccagtttcaaagttcttcatattcatgtatttgttcattcattcataaattcattcatttatgtacttcctcattcaaagcgatacttagaaattaaatatactgaaaagtttcctgaggcagaaataattgtattcaagcatataaacacaaccacagtttcattctctgctgttttgagagtgaaagcgtgtttttaaaagaagaaaagacctcagagaaaactgcatgttgattgtgagaggctgtggaagcagtaaagaagccagctaaaacccaccaaaaccaagatggtgatgagagtgtcctggtcgtcctcactgctacactcccacccgtgccatgatagtttacaaatgctatggaaaccctcacagtccaaaccatgtgtgggagcagttgcctcattggggtactaggagataccagcagcacccggactccagagccaagtctctgcccagcacatggcagacacttgctcgtgctacttctcttcactgtatgtttacattaaacgagcatctgtgttcatcacattattgggcaggtagccatgttcagtatacattatttgtttgaaggtgtgaccagcttacatggggtgagaatttcagttgagtcattgggtttgaagtcccaagtagaaaatgttatttccatagagcaaaaggatgaggaatgtttgtaaacttgtatttgttgcttttgtactactgaggctgttgctcattgatgttcagaaaatctaagtcggactttcaatatggtcactgaactgggtgctgcaggaagtgacaggctgctgctagtgttacccacataatgcaaagttgctgcaaaagctcctccagtcctttttatgtaaattctagtgactaaagagaacatctgaaggccctggtttacaaaagatgcccttattcaccaatgttctttttaaaagacatttgtatgagaatacattactgacaattataacatgttcaatttggtcagtttgcttttttttttaaatgtatctgatattcacctgcattgctgattttaagaagtgctttcatatatgttgccttgattttgatgtcatgtttctatagatctctgagacacatcttctgtgtgcattatattgtcaagcattaggagtttagttcttatctctaccttgagggaccagaatggacctgtgatgcaggaaggatgcctgcacactggcagacttattgtagtcaaggattttgtattggaaaaccttaaaaaataattttcctggctttaagatataatagatatttactgtaaaatgtttgcaactagaagaagttataaaaaagaaaataaaattacaatctgactgtgtatgtaaacacacataattattacctcccttaacacctcttccctggatcaatttaacaaaattatactctctttgcttactcagcattatatttgaaaatttaaccatatcattatatatatatatgcatctgctttgtgcagcttttatatatataataatatataataagtatatatattatatatatataattttaataagtatatatattatatatatatataatatatatatattatatatatatatatatatatatataatatatatatatacttagaggcagggtcttgggtcttgccctgtttctcaggctggagtgcagcagcacaatcatagctcattgcagccgtgaactcctgggctcaagcagtctttctgcctcagcctcccaagtagctgaaactacaggggtatgccaccacgccaagctaattaaataatgtttttgttttgtttgttttgttttatttgtttttagagacaagctcttattatgttgctcaggctggtgttgaacacctggcctcaaatgcgcctcctgcctcagccacccatagtgctgtgcctggctcatcatacttttaaaaatagttatttttagtggttgcataacattctgttctttggatagatagtttaccatctgtcacttatgtttggtcatttcaattgttcctaagtttttttgcaattattcacaatgttataaatagaaaataagtgctggtatgatttatagatggtactaatagtattctaaaatgttggtattaatctggattatggcaaaatcctaatctggataatattccaacatgctaatcctaatctggattgtggactcctcccaagtctatctttcctgcctgtctttggttctggctcccacatcacttctctcatctgcctttccttaacttcaggacatactgggttccagtatgtccttaactttccttaacttcaggacatactgggttccagcccaggctctgcccctcacagttagtagaaggttagaagtttatgcattatgactaacttttgtgttatgattaatatgtagcttggtttgaagtttgttcctaagattacacagcaatcagtttttcagtgaatgtagtcatattcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtcatattcttaattcagtattctacttctttgtttagtgagctactctttaagacccaaaaaggaccagataatacggtagaaaaaagtacaaaacctttcaagtgtattctcctatattcatggttactttctggaataaatactgagaatagtccacctcattccatgaagtagttcttatgatttaaaagaatcataaaataaaagaagaaaaaaagacaaatcaaaatggaatcatgaaaaataaatcctgactcagataagagtttaaacctaagggaaagctttagaaccacagaaatgtggcccagatggccccaacggttatgaatgttgaacttgaattaggccctgaactgctagatcaaaatgagaacgatgttctgtcccataattcgcaataatctcaaactgaaaacgtaccctgcattatgggttaaagcaatttgtgaagcacagaaatagttttaccttattcaacctatcctttaaatttcgctaaaggcatcctggaatattttatgattgttcatgattaaaggcatcctagaatattttatgactatcttcccactgaggcatactccatgaaaaactgaaaagtaaaacacagaaatggtgacctccgttgtacattcaaaatatctatggtttgttcatctgggtgtgatttgagactccaaacctctctttaaatatatgtattcatttttgactagatgatatattcacatcacatggttcaaaacacacaaggcgcaaaaggacatacagtaaacatcttcctctcatctctgtcccacagccacccagttcctccgccagaggaaacccatgtcacccaatctttttttttttttccccctggctggagtgcagtggctggatctctgcttgctgtaagctccgcctcccgggttcacgccattctcctgcctcagccttcggagtagctgggactacaggcgctggccaccatgcccggctaattttttgtatttttagtagacacggggtttcaccgtgttagccgggatgatcttgatctcctgacctcgtgatccaccctccttggcctcccaaagtgctgggattacaggcgtgagccaccgcgcccggccacacccagtctttttgtagggtcttggggattaggtgaaaccatcaaatgagatcaagaaaaaataagtacagtttatcagatgatttcaacacttggcttgaggaaagaggaatgccaataaccgcactcccaaagtgttgacctagtttagcttttgtgatttctgcggtcatggctgcttcctgggcatgttacctgtaaagttgcactgagctccctgtgcctggcttagtgctctgctctcaccatcttgaaattcctaatgcattttcattatgggccgggttctgctaattatgtagctagtcctgttagtgatacttttgagattaaaaacaataggataatttatgactcgagtagtccatgactgacatgagacagttgcttgctgtgaaaaaaattcagattctcacctgtctctgaggttcacagggttgaaacatttgctaaaacagtgagaaacctcctgattgaataaaatttctaaaagaatgggaaaataccaaactgaatagtaatgagctgcttttgaatattaaattccagatagatttattatgtttacacaattgtatgtttaatatttactatattcttaaagactataggtttgtttttggcaattgacattttaaccatattggagtggggtcaaggctccggtagaaatctgtcaataaatatgtagtaccctgtggttgtgttttgaacatgagcccttactaagtcttcataataagggatatgaggccagaaggtgacattccagcctagtgcagacctcatgggagtagggttgccagataaaatataggacactcagctaaatttaaataaacaacaaataatttctttagtataagtatgtgctaaatgttgcataattatgtatgtgctaaataaaactaaatatactaaatataacacttgagacatttatactaaatattatataaataaatatactaaatgtaacatttgcaacataatatactaaaaaatcattagttgtttgtctgaaattcaaatttaacggcatttcctttatcattacctactaaatctggtcattccatttgtggaacaagataaccaagagaattgtagaagaagttgcagactcgacttgaacttagcgtcccactgcttagggtcaaatgctgggttatagtggggagatgtgaaagttaggtaagagcccactgcacacttgttacacaggttgaatatcccttatctgaaatgcttgggagtagattgttttagattttggatagtttcagatacttgcatatatattaatataatgtgatatcttggggacaggacccaagtctaaacataatgtttgtttatgttttatatgtatcatatatacatatcttgaaggtaattttatataatattttaaataattttgttcatgaaacaaagtgtgtgtgcatcgatccatcagaatgcaacccttttggacaatatgtggttgtttggcctcaccataattcctgactctgaatttatatgctactgataagcaatcattttctcacacttattcacatataagtacttaaccataaaaagtatgatatatcattaatacagtgaaaaaatgtgttcagggtaggtaagcagcccagtaacatcactagaataccagtaatctgctattaaaaatcagcaataacaagtgacaggctttcagtctccacctatgatgctatgttttgattaaatggttactatgtactggttttttttctttgtaagaggaaacatcagaagcacttgaaagaccaggaagtgagtcctctagggatgagaaggcattctgctggatgtctttttaaaaatattcctccaaagtcatctgcctcattaacaacatttttgtcttgaaagtctcctttgattttacgaactgacattatttcttgttgtgttatgaacaaacactgctctagtccttcaataagcccatcacacattttcaccatgttgtctataggcaccttttctgcagtgttaatgtaatcttcatcatcactgttatgatcacttgattcaaaactatttcaggccaggcgtggtgactcatgcctgtaatctcagcactttggaaggctgaggtggacagatcacctgaggtcaggagttcaagaccagcctggccaacatggcaaaacccggactctactaaaaatacaaaaagtagctgggcgtggtggtggccgcctgtaattccagctactcaggaggcagaggcaggagaatcacttgaacccaggaggtggaggttgcagcgagccgagatcacaccactgtactctagcctgggtgagagtgagactctgtcaccaaaaaaaaccaagagaaaaccccaaaactaattcagttattttaccatcagcgaatgaacatgtggggcttcattattgatgttaaaaacttctttgattggccaggcgcagtggctcacacctgtaatcccagcactttgggaggctgggaggatcatgagatcaggagatcgagaccatcttggccaacatggtgaaaccccgtctctactaaaatacaaaaaattagtcgagcgtggtggtgcgtgcctgtaatcccagctacttgggaggctggggcagaggaattgcttgaacccgggaggtggaggttgcagtgagccaaggtcacgccattgcactccagcctgggcaacaagagtgaaactccatctcaaaaaaacaaaaacaaaacaggaaaacaaaaaaaagcttctttgatctccatgtcctccagctcactgacacactgtgagggtctattttttgcatatgtaaggaggatagacattattttatctcacttgacatataggatccttcaaaatcaccaccttgttcatcattatcactgaacatagctgcaggccagaggttgtgccaggtatgcacaactgtgtcttcagttagaactatgttccaacagttggcaatagcatacatggcatccttcatgctaaactccttttgaaaaccttccacattcatgcctctgttcactgctgctagcatgctgttcaagaaagtgtttttatatttactctttattgatttaaggataccctggtcacatgactgaatgagtgaagtaacatttggggaaaagtacatggcatacacagtgttttttgatgagaatttcagctggaggatgaacagagcagttgtcaaggaataacagtctcgtagttgtcatttactccagcttccctgtagtgagcaccagcaaaatgtttgtaaaaccaatcagaaaagatgtccctggcgatccatgcttttttgctagtgtaaaaatgggctggtgagaaattcactcttcaaaaacaatgagaatgcaagcttttgcctaacagcaagtttgcacttatgtgtgcctgctgcattagtacatcccagcacagttattctattgttggcatccttaattcctctattgactatctcctcaagtgtagtcaagtgtctttctggggcaataatgccaaaatggtgatgtttcatcaacactatagacttgttttggtgtcagattttcatcagcaacaaccttggcaaactcatcaattaatttttctgctgctttgtaatcagcagatgcttaatcaccacaaactgaaaaaaattttgccatgctttttcttaaatttcagcaaccagctcattgaatattcacagttccttccattttcacttcatcatgacagatctttgtttcatgatcaacataccattaagtggcatgtgttcactgcaacactgatggattcaagacacgattgagaacttcatttatctgtagctttttttttttttttttttttggagacagattcttgctctgtcacccaggctggagtgcagtgacgcgatctcggctcactgcaacctccacctctgactcccgggttcaagtgattctcctgcctcagcctcccgagatgggattacagacgcctgccaccacgcctgggtaatttttgtatttttagtagagacagtgttttgccatattggtcaggctggtcttgaacccctgacctcaggtgatctgcctgcctcggcctcccaaagtgctgggattacagacgtgagccaccatgaccagccgaggtatttgctttattggggtggtctggaatggaaccctcataaacttagaaatatgcctgtactatgtgctggtaactgtgttaatgtgctttgcttgattaatttaattttattatcacaacaatattatgagagaaaaactaatattaacctatcttaaaagatgataaaaagggtccctactgcaaaattgtaatataataccatagaaattcacctttttaaaagtatataattcagtgatttttggtatattcacaaggttatgcaaccattcccatgatatatttttattttttaaattttaataatatattttatttaacaaaatatacccaaaacattgtaatttcagtatgcaatcaatagaaaaattattgagatattttttattcttttgtcatactaaatatggtatatatttcacacttaaaagacatctcaaatgctcaatagccacatatatctactggctactctactagcatagcattagagagatatagagactactattgactttttcaaaacagtttatttttaactaattatagattcacaagatgacaagaaaagtggagtaaggccttgtatacccttcattctgcttccagtaatgccgatatcttattataataattatagtacaataaaaaaaccaggaaatcgattctcgtctgttgttgcctttttaaaaatcttttcagtgtattaaaaaaattttttttcaatagggttttgggaagcaggtggtgtttggttacataaataagttctttagtggtaatttctgagattttgatgtatccataacccaagcagtgtacactgtacctaatgtgtagtcttttatccatcacccgccttccaccctttccctctagtccccaaagtccattgtatggacttatttcttaaaataagaaattgcatcctcatagctaagctcctgattgtgagagagaacacgtgatgtttggttttccattcctgagttacttcacttaggatataattctctctctctctctctctcgtgctctctctctctctctatatatatatatcacattttctttatccacttgttgattggtaggcatttgggctagttccatatttttgcaattatgaattgtgctgctataaacgtgtgtgtgcaagtatcttttttgtataatggcttcttttcctttgggttgatacctaatggtgggattgctggatcaaatggaagatcatttttagttctttaaggaatgtctacactgttttccacagtggttgtactagtttacattcgcacccacagtgcaaaagtgttccctttttaccacatccatgccaacatctattaatttttgattttttgaatatggccgttcttgcaggagtgaggtggtatcaccttgcagttctgatttgcatttccctgataatcagtgatgttgagcatttttccatatgcttgttgtccatttgtgtgtcttcttttgagaattgtctattcatgtccttagcccactttttgatggtattgtttgatttttttcttgctgatttgtttgagttctttgtggattctggatattagtcctttttcaaatgtatacattgtgaagatttttctcccactctgggttgtctgttgattctgctgtttcttttgcagtgcagaagctttttagtttaattaagtcccatctatttacctttgtttctgttgcattttcttttgggttctatgtcatgaagtcttgcctaagccaatgtctagaggggtttttccaatgttatcttctagatttgttatggtttcaggtcttaggtttaagtctttgatccatcttgagttgatttttgtataaggtgaaagatgaggatccagtttcattcttctacatgaggcttgtcaattatcccagcaccatttgttgaatagggtgtcctttccccactttatgtttttgtttgatttgctgaatatcagttggcggtaagtatttggctttatttctgggttctctattctgttccattggtctgtgtgcctatttttataccagtaccatgctgtttcagtgactatggccttatagtatagtttgaagtcaggtaatgtgatgcctccacgtttaatctttttgcttagtcttgctttggctatgtaggctcttttttggttccatatgaattttaggattgttttttctagttctgtgaagaatgatggtggtattttgatgggaattgcattgaatttgtagattgcttttgacagtatggtcattgtcacaatattgattctacccatccataagcatgggatgtgtttccatttgtgttgtgtataatttctttctgcagtgtagagatctttcacctccttggtgaggtatattcctaattttgttgttgttgttgttgttgttgttttacagctgttgtaaaagtggttgagttcttgatttgactctcagcttagtcaccattggtatatagcagagctattgatttgtgtgcattaattttgtatcctgaaactttactgaattcatttaccagttctaggagcgtttcggatgagtctttagggttttataggcatatgatcatatcatcagcaaacagcaacagtttgacttcctatttaccaatttggatgcctatcattcctttctcttgtctgattgttctggctagaacttccagtactatgttgaatagaagtggtgaaactgagcatctttgtcttgttccagttctcatggggaatgctttatattttcccccattcagtataatgttggctgtaaatatgtcctagatgtctattaccttaaggttgtcccttctatgccgattttggtgagggctttaatcataaacggatgctggattttttcaaatgttttttctgcagctactgagagaatcatgtgatttttgtttttaattctgtttatgtggtgtatcacatttattgacttacttatgttaaaccatccctgcatctgtggaagcccacttgatcatggtggattatctttttgatatgctggtggatttggttagctagtattttattgaggatttttgtatctatgttcatcagggatattggtctgtagttttctttttttgttatatccatccctggttttggtattagggtgatgctggcttcatagaatgatttagtaaggattccctttttctctatcctgtggaatagtgtaagtaggattggtaccattccttcttcgaatgtctgatggaattcagctctgaatccatctggcccaggattttttgttgttgttggcagttttaaaattactatttcaatcttgctgcttattattgatctgttcagagtttctatatcttcctggtttaatctaggggggttgtatatttgcaatttatccatctcctctaggttttctagtttatgtgcataaaggtgttcatggtagccttggataatcttgtatttctgtggtgtcagtagtaatatctcctgtttcatttctaattgagcttatttgaatcttttcttttctgggttaatctcactaatcaattttgtttatcttttcaaagaaccagctttttgcttcatttatcttgtgtattttttgtttgtttcaattgcatttagttctgctctgatctttgttattttctttcttctgctgggtttgggtttggattattcttgtttctgcagtcccatgaggtgtgaccttagatcgtctatttgtgctctttcacactttttaatgtaggcatttaatgctgtgaactttcctcttagcaccacttttgctgtatcccagaggttttgatagttttgtcactattattgttcaattgttcagttcaaagaagaatttttaaatttccatcttttttttttttttttttttttgagatggagtcttgctctgtcacccaggctggaatgcagtggcgcaatctcggctcaccgcaagctctgcctcccaggttcacgccattctcctgcctcagcctcccgagtagctgggactacaggtgcccgccaccatgcccagctaattttttgtatttttagcagagacagggcttcactgtgttagccaggatggtctcgatctcctgacctggtgatccgcctgccttggcctcccaaagtgctgggattataggcgtgagccaccgagcctggcctaaatttccatcttgatttcattgttgacccagtgattattcaggagcaggttatttaatttccatgtatttgcgtggtttttagagttccttttggaattatttccaattttattccactgtggtctgagagaatacttgaaataatttcaattttcttaaatttactgagacttgttttgtggtatatcatatagtctatcttggagaatgcttcatgtgctgatgaatagaatatatattctgcagttgttgggtagaatgttctgtaaatatctgttaagtccatttattctagggcatagtttaagtccattgttttttttgttgacttcctgtcttgatgacctgactagtgctgtcagtggaggattaagtcctccactattattgtgttgccatctatctaatttcttaggtctattagcaattgttttataaatttgggaactccagtgttaggtgcatatgtatttaggattgtgatattttcctgttggactagtccttttatcattgtataatgttcctctttgtctttttttaactgctgttgctttaaagtttattttgtctgatataagaatagctactcctgctcacttttggtattaatttgcatggaatatctttttccacccctttaccttaagtatatgtgagtccctatgtgttacataagtctcctgaagacagcagaaacttggttgatgaattcttatccattctaccattctgtatcttttaggtggagcatttattccatttgcattcaatgttagtattgagatgtgaggtactattctatttattgccttaatacctttttaaaaaaattttgttattgtcgtataggtcctgtgagatttatgctttaaggaggttctattttggtgtatttcaagatttgcttcaatatttagagctccttttttttttttttgagacagaatctcactctgttgcccaggctggagtgcagtggcgcaatcttggctcactgcaagctccgcctcccgggttcacaccattctcctgcttcagcctccggagtagctgggactacaggtgcccgccaccatgcctggctaattttttgtatttttagtagagacggggtttcactgtggtcttgatctcctgaccttatgatccgcccacctcggccttccacactgctgggattacaggcgtgagccactgcgcccagccaagatttagagctccttttagctgttctggtagtggtggcctggtaatggcgaattttctcagcatttgtttgtctggaaaagactgtatctttcattcatttatgaagcttagtttttctggatacaaaaattgtttgtttaaggaggctaaaaataggaccccaatcccttctagcttgtaggttttctgctgagaaatatgctgttactttgataggttttcccttataggttacttgatgcttttgcctcacagctgttaagattctttccttttcatcttgaccttagataacctgacgactatgtgcgttggtgattatctttttgccatgaatttcccaggtgttctttgagcttcttgtatttggatttctagatctctaggaaggccagggaggttttcttcaattattccctcaaatatgttttccagattttagatttctcttcttccttgggaacaccaattattcgtaggttggatgcttaatatagtcccaaacttcttggagcctttgttcattttttctaatccttttttatttctctttgatgggttgggttaattcaaaagccttgtctttgagctctgaagtcctttcttctgcttattcgattctattgctgagactttctgagcattttacttttctctgtgtccttgatttccagaaattgtgattgttttttgttatctatttcactgaagattttcccttcatatcctgtatcatgtttttgatttctttaagttggatttcacctttcttggtgccttcttgatacgcttaacaattgaccttctgaattctttttctggcaattcagagatttcttcttggtttgcatccattgctggtgagccagtgtgatctcatgggggtgttaaagaactttgttttgtcatattacaagaattgtttttctggttccttctcatttggatagactatgtcagagggtaagatcctgggactcaagggctgctgttcagattcttttgtccaacaaggtgctttcttaatgtagtattcttccccttttcctaggaatggggcttcctgagagccaaactgtagtgattgtttttgctcttctgagtctatccattcagcagagctatcaggctctgggctggtactggggagtgttgagcaaagattcctgtgatctgatttgtcctcaggccttttggccgtggataacagcatctgctcctgtggaggtagcaagggagtgaagtggactctgtgagggtccttggttgtactcttgtttagtgcactggttttgtgttggttagcatccagccaggaggtggcactttcaagagcgcatcagctgtggtcctatagagaggaagcaaacttgcctgagggtctcctggttaagtattcaggtttcgcaggcagtgggcagggccatagagctgccaagagattatatcctttgtcttcagcaaccagggcaggtagaaaaagaccactaggtgaagtagagttgttcaaggccttgggagcccaccccttgtatcggtgtgccctggatatggagcacagagtcaggagattattttggagctttaagatttggtcactgccttgctgggttttttacttgtgaggggtctgtagcccctttcttttggctgatttgtccctgttgaaacagaaataactacccaatgcctgtaccctcattggatcttggacataactaacacgttttttattttacaggcttataggtggaaggaacttgtcatgtctcaaatgagtctttggacttttcagtaaatgctggaatgagttaagactttggggattagtgggaaggcatgaatgtattttgcaatgtgaaaaggacatgggatttgggatgagccgaggtggagtgatatagtttggatgttgtccaagcctaaatctcatattgaaaggtaatcctgtgttggagttggggcctggtggaaggaaggtgattagatgaatgggggtggtggatttccctcttggtactgttctcacagtagtgagtgagttcatgagatttggttgtttaaaactgtggtgcagtggctgggcacagtggctcatgcctgtaattccagcactttgggaggctgaggcgggtggatcacaaggtcaggatatcgagaccatcctggctaatgcgggaaaccctgtctctactaaaaatacaaaaaattagccggctgtggtggcacatgcctatagtcccagctactcgggaggctgaggcaggagaatagcatgaacttgggaggcggagcttgcagtgagcccagatggcgccactgcactccagcctgggcaacagagcgagactccgtctcaaacaaacaaacaaacaaacctgtggcacggtggctcaagcctgtaatcccagaactttgggaggccgaagtgggcagatcacctgaggtcaggagttcgaccaacctggccaacatggtgaaaccccgtctctactaaaaaaaatacaaaaattagccaggcatgatggtgggcacctgtagccccagctacttgggaggctgaggcaggagaattgcttgaaccgggtacatggagtttgcagtgagtcaaggtcatgccactgcactccagcctgggcaatagaacgagaccctgtctcaaaaacaaaaaacaaaacatctgtgtagcacttccttcctcttcttttccacccgctccagcaatgtggagatgccttctccggctttgccttccaccatgaacaaaatgtccctgaggcctccccaggagcagatgctgctgtgcttcctgtacagctggaagaactgtgaaccaattaaacctcttatcttataaattacatgatcttaggtatttctttatagctatgtgagaatggcctaatatgtagcacaaaaaaggatgatgatagggagatccctctgctttccctgttctctgtctcatttccaaatcctgtacttctcagtgcctgggttactgaaaaaatagcaagttacatataaaagaaattgtagcttcttttgaagctttacaaagtttaatacttcctatcagtcttcctgtttcttgtgttaccaaagaatagaaaataaaagcaagaaaataaacacatacacaaaaaacataaagcaagagggaaatggtttgagggctactgttgttttactgcttgtgttgatttcactctttttacactacccaactgtgtaaaggcccacaactcatgcatgcaataggcagcagagagaacagcaaataaaccagaaagagcatcccatttcactccttagtagcaactcactagaattcctcccactgtaaatgagaatcccaaaatgcagggaagaaatagtacattttttcttcttacagatccagttagtcaatatttaaccattcagctcggaatcatacatgcctcattccagtagtagcttcttttatacagtgttttgttagagggagtgtggaaaggggagaatgtttgagtcaagctgttaaaacaaagcacatgtgccagctagtcagaaggaggcactttcccctgggcaagatttcaagcaggggcaatagaaggtaaaatcttaagttcactttcctgttaaaaaccgagattattattttgatcctgctgttcagtgttctctttctctctcttcttttaccaattgaaaaattcccagtctgaggtctcagaaataatgccacacgtctacagccaactgatctttgacaaacctgacaaaaacaagcaatggggaaaggattccctatttaataaatggtgttgtgaaaactggctagccatatgcagaaatctgaaactggaccccttctttacactttattaaaaaaattaacacaagaggccgggcgcggtggctcacgcctgtaatcccagcactttgggaggccgaggcgggaggatcacgaggtcaggagatcgagaccatcctggctaacacggtgaaaccccgtctctactaaaaatacaaaaaattagccgggcgtggtggcgggcacctgtagtcccagctactcgggaggctgaggcaggagaatggcatgaacccgggaggcggaggttgcagtgagccgagacagtaccactgcattccagcctgggcgacagagcagactccatctcaaaaaaaaaaaaaaaaaaaagaaaaaaaattaacacaagatggattacagacttaaacgtaagacctgaaaccataaaaaccctagaagaaaacctaggcaataccattcaggacataggcatgggcaaagacttcataactaaaacacccaaagcaatggcaacaaaagcaaaattgacaaatgggatctaattaaactaaagagcttctgcacagcaaaagaaactatcatcagtgttaacaggcaacctacagaatgggagaaaatttttgcatcctatccatctgacaaagggctaatgtccagaatctacaaagaagttaaacaaatttaaaagaaaaaaacaaccccatcaaaaagtgggcgaaggttatgatcagacacttctcaaaagaagacatttatgcggccaaacaaacatgaagaaaaagctcatcatcactggtcattagagaaatgcaaatcaaaaccacagtgagataccacctcatgccagttagaatggcagtcattaaaaagtcagggccgggtgcggtgtctcatacctataatcccaggactttgggaggccgaggcaggtggatcatgaggtctggagttcaagaccagcctgaacaagatggtgaaaccctgtttctactaaaaatacaaaaatgagctgggcatggtggtgggcgccagtaatcccatctacttgggaggctgaggcagggaattgcttgaacccagtaggtggaggttgcagtgagctgagatcaccccacagcactccagcctgggtgacagagtgagattctgtctcaaaaaaaaaaaaaaagtcagaacaacagatgctggagaggatgtggagaaataggaatgcttttacactgttggtgggagtgtaaattagttcaaccgttgtggaagacagtgtgacgattactcaaggatctataaccagaaccaggtcaaggatttgacctggcaatcccattactgggtatatacccaaaggattataaatcgttctactataaagacacatgcacacgtatgtttattgcagcactgttcacaatagcaaagacttggaaccaacccagtgcccatcaatgatagactggataaagaaaatgtggcacatatacaccatggaattctatgcagccataaaaaggatgagttcatgtcctttgcagggacatggatgaagctggaaaccatcattctcagcaaactaacacaggaacagaaaaccatacactgcatgttctcactcgtaagtgggagttgaacagtgagaacacacggatacagggaagggaacatcagacaccggggcctgtcggtggggttgggggctaggggagggatagaattaggagaactacctgatgtagatgacgggttgatggtgcagcaaaccactgtggcacttgtatacctatgtaacaaacctgcatgttctggccgggcacagtggctcacgcctgtaatttcagcactttgggaggctgagttgggtggatcatctgaggtcaggagtttgagaccagactgaccaaaatggtgaaacctggtctttactaaaaatacaaaaaattagccagacttggtggcaggtgcctgtaatcccagctacttgggagcctgaggcaggagaatcccttgaactgaggtggtggacgttgcagtgagctgaggtcgcgccattgcaggccagcctgggcaacaagagtgaaactccatctcaaaaaaaacaaaaacaaaaccaaccaaacaaacaaaaatccctgcaccttctgcacatgtatcctatcccagaacttaaagtatatttaaaaaaaaaaaaaaaaaaagaacctttctgtctccctgtagcagaggcacatagcccaaccacacattaaggctcctacacagtgagactgctcagaaggcccacggatgctctgatgttgcttcctccctcatagcaatgggtaccaggaatgctttgctctaattctggggggttacacaattggagcaaaccactcaacttcccattgtctgaatttaacttgtgaaatgaacaagaagcaacttatccacaggagtttaagggaactgattaaggtttgtaaagaccttattggatgaaagacaataaaattatgatcataaataatttgactacagatttctacattatcctcccaatgcatgggacccaaagtacttcatgtatgagtctatttaagctgcacagattcctgatgagacagaaaaaagaatgatctctaaactcacattctgcaatgggaaactgaggcctcagataaactgagtttgcattcttgttgcttaactcccagtggaatgcatttgttatgaattcatattgcactttaggtaaaatcagggagaaagcttgatttatgatctagatttgtctcccgagagcactgtttgtattttgattacttagtaatttacataagaggaaaagagtgctgatgtacttgctctacaatgtcatagcatatgaataatatggagaaaacagacattgaaagaaaaaagatgacacagaataattcaacaaaacacttcagatatgactgatacatttctgtccaattgagacagtaacacacatgcacaaagcctctttggggagagtcagtgaagacaaaaaggtacagattatatctttatatataatgaaaattactctccaaatggcagtttaacttatcttgatggaatattaccagtattttacaaaatgcctataaattactcagctggctttcatcatactgacctattttaaatatttcagaagttatactctgcttctaattggacttgatgcaactggttagaaaagaatacatagctcactttggggaaatataataactcttctgggcaatttgggtgtcatttagtacatcggatggggtaattttctaaatgctatcctagaattaatgcatgtttgaaagagaataatttgcctctttcttagtgataggttcaggctcattctttacaataaaattcattggttaatctaattatagcaacagtcacttgaattttcatgtttgatcagtcctggtcctgaacacagaggagtaagtcctcctctgtggggacttcaggatcccaatagctctggtcagtgccatttacaaggtttggatttaagattctgtttaatcccactgctttcctgaacaagtcatggaattttagagtgaatacagctgttgttgtatcttttgaggaggtttatttgagtcccctctaccttttcttctcttctactctatgggatctggtgactagaatgttttaaagcctcaatatatatgacatccctgtctaagtttgaatgaacagaggttgcttgaaaaacgtgtgttgcatacattctttgattgcctatctgtgagtcaagggagaggacattgacttgagaaatgggattatgatccagaattttggctatcttggtatatgttgtatgggtcctcgaagaggatgcgtattcagttgtcagtaaaatgttctacaaatgccatttagatcctgtcggctgattgtgttgttgagttcttctgtatctttgatggtttttatatcgttgttctatctacttttttctttttttgacacggagtgtcactgtgttgcccaggctggagtgcagtggcatgatctcgtctcactgcgagctccgcctcctgggttcacgccattctcctgcctcagcctcctgagtagctgggactacaggcgcccgccaccaagcctggctaattttttgtatttttttaagtagagacggggtttcaccgtgttagccaggatggtctcgatctcctaacctcgtgatccgcctgcctcggcctcccaaagtgctgggattacaggcatgagccatcgtgcctggtccctgttctatccacttttgagagatggttgttgtattctctaactataaatgtagatttgtctgtttctgcttttacttctgtcaactttaactcaattattttgcacctctgtggtttggttgcttacacatttaagattgctatgtcttcttggagtattgatctatttatcattacataataatgtctctctctgtgtctgataattttctttgttccaaggtctacatttcctgatattaatatagccacttcttttttcttttgattaaatttcacatactatgtctttttctgtacttttattttcaacctgcctgtatcattgtatttgatatgagtttttttgtagacagcatatagttgggtcttatttttaatctactctgccaatctgtgtcttttagttggtgtatttagataatttacattaagtataatattcatatgttggggtttaagtctgaaattttattttttgtttcatttctcttttttttgtttttgttttctttttctgcattcttgtgggttacttgaactttttgaaaaaattatattctggtttatctttagtgtttttgagtgtatttctttatattactttttaagtagttctacaggtgttaatttgcattgacataatttatcttggattactactgtcagcattttaccagtttgagtgattcatggaaaccttagctctctttatgtttctatactctcttccacttataattgaaatgttttctctatatacattgagaatcacatcagtgttataatttttgctttattcattaaacataatttagaaaacccaaaaggagaaaaaaaatctgttgttttaacccatatttttgcttaccatgttttcttctttcctgatgtttcaaggttccttttttattgttttctttctgtttaaaaacttttaaatattctgttaagacaggcctgcttccaacaaattctcttagtttttctaatctgagaattctttgatttttccttcaccccgatggatatttttgctggatataagattaggaattgacatttttttttttcagcatttgaaaaatgttgtgtatttccttttggtctctgtgatgagatttctgctgtcatttgaagtgttttacccctctaaataaagtgttatttctctctcactgttttcaaaacttctctttgtttttagttttcagaagcttgactacgatgtatgtctttggatgtatcctgtttgcatttaatacagtttcttaaatacgtaggtttatattctttgccaaatttgggaaattttcatccattatttctttgaatactttttagtccattctctttctcctgtgatacaaatgttagattttttttttttttttttttttttttttagtttaagagttcctggagtctctgttcctttattttgttttcctatattatctctattgttcagatttgataatttctattgtctatcttcaagttcactgattctttcctctatcctcttgattctgctgttgagcagtagaacagttattatctgaaagttttattttctgtattgctgggctgtctctttcctgatcttttggctagagaaaggtagcaggcttttcttggggtgatttttttttttttttttgtctgtggggagctgacatatttgtctgtgcccattggcatttctgggttgctagcttctcagtacccaatctgggtatgtatgagcaagaagaaaactgagggaactcaccactgagtaacattcctcaggtatgaggtctctatcttgtctacctgcttttctccatctttcaggtcttctcatgtttgttttatgacatccaggatctttagctgtacttaggggaaggactaggggaaaatatgtttgcgctgtctttccttggatcatagacttttcaaactgggaagaacttattagtcaacttgggctaccataacaaaataccataggttgggtagcttaaataacagaaatttattttctcacaactttggagtccaagatcaggatgacaacatgctcatgttctgttgaggcctctcttcttggcttgcagatggctgttttttagctctgtcttcacatagtgaagagagaatgagaacaagctctctgggatctcttcttataaaggcaccaatctcatcatgaggttccttctctcatggcctcatctagtcctaattacctgctaaagccctcatttccaaataccatcatatttgtgcttaggaattcagtataaaaatttgggggaaaaacaaacattcaattcataacagaacttcaaagatattacagatggacatctgaggcccacggacattcattgagctctttcaactacccacttaatacttggcaaaaagtattaatagaataaaggcagggtgtcctaatttttagcctgttgttattcgtgttgtactatattacatcatgactaactactgaaaaattatttttgaaacatgagagagaactacatcatgataattctacctccatcccccccaaaaagagcctatccaaaaacctgagacttattcctaacacaatgttctttgttataagactagtttttcttttctttttttttttttgagacggagtcttcctctgtcgcccaggctagagtgcagtggcgccatcttggctcactgcaacctctgctgccggtttcaagtgattctcctccctcagcctcctgagtagctgggattacaggtgcctgccactgtgcccagctaatttttttgtagtttttggggtttcaccatcttggccgggctggtcttgaactcctgacctcgtgatccacctgcctcggcctcccaaagtgctgggattacaggtgtgagccaccgtgcccagcctataagactagtttttcaaatatgaatctgttaatatagaatgatagaattttttttagttcgtgtgtgattttcctctcaacttgttaatattttgaaatgaccaggggcatactgtttcacaattaaagagaaaattgaggcattacataaaaaccataagaaaagagtttcaagtcttttaactgtgtctttttttttttttttagtctagctctgttgcccaggctggagtgcaatggtgtgatctcggctcacagcaacctccacctcctgagttcaagtgattctcctgcttcagcctcctgagtagctaggattacaggcatgcaccaccacactcagctaatttttctattttcagtagtgacggggtttctctatgttggtcaggctagtctcgaactcctgacctcaggtgatctacccgcctcggcctcccaaagtgctgggattacaggcgtgagccacggcgcctggcccgtaaatgtgtcttcgagtgcaaataatagctagtttagtggctttaggaactgctgtgtttcctaaaacatgaagctttttggtaaagctgtgagtgagatgaagaaggtgtaaagatattaccttctgtgttaaaattgattattgaaaaaggctatacactggattacatttttaattttggtgcaattggtctcttaaggacccagatctcaagggcaaagagaaattcccaagatccaagagtgtggataactatgatgttgggtgcaatgatgttaaactagtattaagtcagaaatggtgaatagtctgagattttaccctacttgtaagctaataagttagtttgccatacataggagatatatctatgtatctctatctctatcgctatctctgtctctctctatctctatatctcataaggcacttgagccagagacacaaatggtttattattcatagcatagtagtcagagtagcatcttgcatcagttccccacattttaatttcccacagggagatgtgaatgagggccagattctgcctgtgcatgccttgggttttcattatagaagacaaaccctgaacttaggagactctagcttttattagggttgctggtgatctgcccattcttccctctggagagctattcctcataaccctggaactaaggaactatcctctgggaaggaagcaaacctttactattctggaatgcctttggagaaggagatgttctctgttttagggttgctattcaattatccttgaacaaaacttgtcagtgccccttgctcagaaagtctggacgatgtagaaagtgaggaatccagggagaattgtctcccaataaatgccagtggatatttaactgtgctagtatttttatttggattgggattgttggtgtaaatgctctggttacaaagttgtgcaggttttgagtgatctgttccaactttattttttcccataaagtctctaatttttgaagcataattttgcagaaaataaagtttatcagaaaaacgtacttacattatagcagcaatgtctattacctccaaatctggaaagaaaccaaataagcagatttatcttttccctcctctgactcgaggtattagaatgaggatgaaatacaaggaagggaatggcccaggggttcacatgcattggagagacactgtaagacctgaggatgcccattcatgcagaggcagatttacagtaaagataaaaaacttaagcttcagagactctgacttgcccaggccctttctaatgctgtgagaggggccttagcacagtgttttcacatcatcgtgtgtttttgtaaaatttgcgaaaggaaactattttaacttcaatcagttaagagagctgctttttccattatagctttcccttgtgctggcaatagagcggccaacagcagtttttgggaactagctaagggaatgttgagctgcggatatagttagagtggatttagtaggatatattgaagtggctcacaatttcatccatgaatattgaaattgttattagccctcctggtgtagaaattgcctccaggaacactactttctgctgtgtaagctcaactggagtcattttaagcaactgcagagccagaggctgtataatgatacgaaagtgtcctgttgtacctggcagtggaaatttgtgggtgctagaggagaaacaaggtttgaaaagtttggaaccagaagttagaacatggaaaaagattcaaatatgatagtttacatatgaaagaaaaatgacagagaaccccaaatttgataattcccaaagcttatatgaccacaccaagaaaacattgtgatgattaaagaaatttggctgggtgcggtggctcacgcctgtaatcccagcacttcgggaggccgaggcaggcagatcacaaggtcaggagttcaagaccaacctggccaagatggtgaaaccctgttgtgctaaaaatacaaaaattagctgggtgtggtggtgtgcgcaggtagtcccagctacttgggaggctgaggcagaagaattgcttgaacctgggaggtggaaattgcagtgacccaagatcgcaccactgcactccaacccgggtgacagagtgatctcaaaaaaaagaaattctcagcaataaaactaataacaatgtaagcatattttggtaaatatgccagtagacactaaattatctctagtctccccactaaaaatgattttacaaaaattgtcatgttaaggagtaaatgaaagattgtgtccataaatatagaaaaaaagtattatagaaatgtgtaggcagttagctaactattcttccggaatagttttgtgggttttgctagtcttttaatactcataatgttttggtttcttttttcattctgaataaaaatgtatgtagaatttggaccataacttgtgttctttttcttacagaaaacccatcaaattgtataaattgtaggtctcataaaatccagatctattccttttttttttttttctttttgagacaaagtctcactttgttgcccaggctggagtgcaatggcacgatctcggctcactgcaaactctgcctcctgggttcaagcaattctcctgcctcagcctcccgagagctgggattacaggtgcgtgccacgatgcctggctaatttttttttttttttttatttttagtagagacggggtttcaccacgttggccaggctggtctcaaactcctgaacctcaagtgatccacctgcctcggcctcccaaagtgctgggattacagatgtgagccaccaccttcactacctttcccacatggatggagcaaatactctcagaagaagaatggagcccatgtgttcttccagagcccgtacatagcatcagctgacctccttcttttcttatactcactccatcctgctgtaactcagtctatgactgaacatgagatgtccaactctctaattgtagctgagaagagaaaacaaacaggtattaggcacagttataaaagggaggtaaccccactatatcagagaaaaattattgggatagagcagctcagattgagcatagtatcatgagaagaaatggcaacacaaagatggaaacatactctagctgcaataaacacaagtatgaacaaaaataaaaagtaacagtaatccagtctgggaggcaccatgacaatgacccagaacaaaagaaaattcctcacaagagctctgcgttatttagcaacttcataaaggtgacaatcacatggtgtctcagggaagagatgacagatagtaatgaggatgctgcagagtaaataagacaaattaaggatcagaccaacacatgacagaaccaacatggtgatttgaaaatcagggaacagatagcataggtgaaaataaacatgctaatatacagaaaaggctttagataatgaatgcaggtgaaaaatatgatattgaagtaattgaatataaagtaacagacatggtgaatagacaaagacaatccaatgtaaagataactgatgaccctgaaatacataatccaacagatggaattgaaaaagcattcagagatttatataatagaagaaaattccctgaaacaaagaaagaagtgaataagtatactggaaaaggctactgcatcttaggtgaaagtaaaaagcagttgacatcaagccatatgctgattaggtgtaatttgagggataaagagagacttcttggccaggcacggtggctcacgcctgtaatcccagcactttgggaggccaaggcgggtggatcacgaggtcagtagatcgagaccatcctggctaacacggtgaaaccccgtctctactaaaaatacaaaaaaaatttagccgggcgtggtggcgggcgcctgtggtcccagctactcaggaggctgaggcaggagaatggcgtgaacccgggaggcagagcttgcagtgagccgagatggcaccactgcatccagcctgggggacagagctagactccatctcaaaaaataaaaataaaaataaaaataaaagacttctttaggcctggaggcagaaaaaagagcttcacatacaaagaaaaacgtaacatgttgccctcaaggtttttcagtgtaacactaagtaacacattggaaacaaaatgatttcatattataattttcaggtgagttgttgttcaagtataaaggaaacatgcattctcaatattgtaccaaatacttcaggcaatgaagcactcatgaacccttttccaaaaacaacaaaacaaaatttaatgaaattagagaaatagaacaaaatcaaccccccctctggtaggaagaatactatccatcccttcccctctgtaaagatatccacattctaatcctcagaaccagtgaatatattaccttatatggcaggggagactttgcagacacaattaaggatcttgagatggggagactactatggattatcctggtgatcccagtgtagttacaagggtccttatcagcaaaagtaggagacaggagggtcagaatcagagagatacttgaagatactacactgctggctttgaggatggaggaaggggccatgagcaaaggaatgcaggcagcctgtaggggtgatgctgggcaggtgagccccaaagtggaacttagcctacaaggcttcttggccttgctcgggaaagaattgaagggcaagccagaaatagaagaaaacaactttagttaagaggcagtgttacagctctatcactgctcctgcagagcagggctgccccataggcagagagtagcagctcagggagttctgcagccatatttatacccacttttaattgcatgtggattaaggagtggtttgtgcagaactttctagggaaggggtagtaacttttgggccactgggtcattgctatggaaaggggcagtaactttgagtgctgccatggcaacactaaattgacatggcacacttgtggatgtgtacgattggaaagcctctgccccgaccctgttttagctagtcctcaatctggtctggtgtcggagtccacctcctatctcagaagctggaaaaggcaaggaaatggattctcttccagagccccctgaaggaatgtagccctgccaacaacttgattttagcccagtaaaatctattttgcaattacgacatacagaaccataagataataaatttgtgttgttttaaggactaagtttggggtaatttgttatagtagcaataggaaactaatatgccaccaagccaaccaaccaaagaaaaacaaaagaagaaatcgccaagaattcaggaatagggacaccctggtaaaaggcattgtcagggaacattgaatgcttttaaatattgaactcagacaaattaactctaggaattatcatttcagtgtacacaataatgatatagtctgttgatatattagttgagatattagtcaaggtgcagttaggattctataaaaagaaacctaaaaataaattggcacgaatgaagtagaaatatatttcattcctatatcacagtctgcatagacaatccaggactggtttggatatcaagggcactggggacccggacgtctatgactttgctgtcctgccatcatcagcatatggctttcatcttatgtacccacatggatgctttagctgtcactgttgtgtctgtgtcttagcctggagaaaggtgggaaggggacagaggcaagggtacggttcttctctttgaaggcacaatccagaaattgcatccattccttctccaacatttccttgcccagatttggtcagatggctacaccgaactacaaaggaggcagggaaatgtaatctttatcaggggagtcttatgctcagccaaaacttgtattataactgaaaaaaggagaaaacagagattgacgaagaccaagcagtttctgccatacttgataatgtaaaaataatgatacaacctgagtcaaagggtggggagggtgggggaagctgatgtgatctgcttccttcctcacgtttttctagcaggtacccagtgcactggaagcatcttaagttgaaatgtaattaaaataatttcaacttacagcttttcatgatcaccttttgacctaagagtgattttttttttttttttgggttttggcaagtaattttttttttctttttttttttttttaattgatcattcttgggtgtttctcgcagagggggatttggcagggtcataggacaatagtggagggaaggtcagcagataaacaagtgaacaaaggtctctggttttcctaggaagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagtggacacagcacatgtttcagagagcaccgggttgggggcaaggtcacagatcaacagcatcccaaggcagaagaatttttcttagtacagaacaaaatggagtcgcctatgtctacttccttccacacagacacagcaacaatctgatttctctatcttttccccacatttcccccttttctatttgacaaaaccgccatcgtcatcgtggcccgttctcaatgagctgttgggtacacctcccagacggggtggcggccgggcagaggggctcctcacttcccagacggggcggctcccaggcggaggggctcttcacttcccagacggggcggctgcgggcggaggggctcctcacttctcagacggggcggccgggcggagacgctcctcacctcccagatgggttcgcggcggggcagaggcgctcctcacatcccagatggggcggcggggcagaggcgctccccacatctcagacgatgggtggccgggcagagacgctcctcacttcctagacggggtggtggccgggaagaggcgctcctcacttcccagactgggcagccgggcagaggggctcctcacatcccagacgattggtggccaggcagagacgctccacacttcccagacagggtggcggccgggcagaggctgcaatctcgggactttgggaggccaaggcaggcggctgggaggtggaggttgtagcgagccgagatcacgccactgcactccagcctgggcagcactgagcactgagtgaacgagactccgtctgcaataccggcaccccgggaggccaaggctggcagaccactcgcggctaggagctggagaccagcccggccaacacagcgaaaccccgtctccaccaaaagaacacgaaaaccagtcaggtgtggcggagcgcgcctgcaatcaatcgcaggcactcggcaggctgaggcaggagaatcaggcagggaggttgcagtgagcggagatggcagcagtacagtccagcttcggcttggcatcggagggagaccctggggagagggagagggggagggggagggggagggagaggtaagagtgatcttttaggaaatacttacagtggagaaatattcctttaatattcaggaatcacttcaattttgcttcagtttttttgtagttaaataaaattaaagaatttttaaagttaaaatagcatttatgtaatgatttaattttaatgaaagttgatctacctttctgaatatatgaatagacagtcaactagaataatattcacataatgttgattctggctatttttgggaagtaagattttagataacttttttctttgttagacttttctatgtcagtttaatttttataatgagcacacatcatttttaacaaaatgataaaggctttgttcttaacaaagctacagtcattactaatgtgaggaggcagagatttttaaaaaatattataaatattatggaatatctttaattaatgcaatagcttgaatttctaaaacaaatctctttagcaactctttttaatgtattaattatgtttgctattttacatatctcctttctgttttcctgtcatgattagcagtattcaagagtgaatatttttagatagcaaaattaaggaggtgttttcactccaagttcttgcgtaggccaggatctccaagaagcagaggaggtggtgacagctttgaagagaaaaagatgcagattgctttccagattatggaaagaaagagacaaacctgtgggttatctgtctgggattgataaaagaatgtaccagacgtatcaaaatgctatcccctcagagccgcacacagcctagaacctgtactgccctaaaatggtgttttctagcatacaacatatcttcctggccatagcttattggattaggagtgggcacttttatctagggtagccagtatttcatctggttggtgaccacctatatggcttggcttaatgatatgatgcataaacctctggggcatgctcctgtccctgattgggctccagggaagctgactctgcgagggagatcagtgtataggaagtttatcaggagtgctgttgagatcaacatctatgcaagaagagaggagggaaagggaggggaagagagtagcaggaagggataggagcaggagtgggcagagggagaaattgaatggtgatgtagtctcaattcagggctgagcagataccacagcaggtcctacagctgagatgacccttcagaggtgtcctgagttgggacaacaggactgggcctttatcctctttctcagtcagttccagctgccctggagggggacatgaccttggatgaggcagctctcttcagctgaagcaacctctctgtagggggctgacagctgggggctatctgcaagcagcactcccaggggctagggcagaaatctcttcatttctgaaagggatctgggtggcacagctcagtgcccgctgcagctcttttcatcttttggctgtagtttgaatctctgttttgggatttaaagtaggtaacaaagtgtgcattatcattgtccttgggagagagtaaaagtcactgtgaagaaggggccatcgaggccattatgaggcacacagagttaatgtcatgaaacagaaactgtgagtacacaaggaagctgcttgaagcaggaagctggtgtgacgcacaagagagcagaggtgtgtcaccaagcactccaatgacatagctggaattagggtgtatgagatcttgtggctgagcccttagagacacttcgagctccagtgtgtctttttattttatatagatgacattttctttgtggttctacatatattctttctttagatggtagcttaaatatctgaaattctgtggtgacttacgtgtacataatcccatgcgtgaatacaaggaactcagagaagatcaagatacacagaccatactgttttttgggccatttatctatgtctctgttgttgtaataacatggccccaggcaatgcaggatgataaaaagtttaggtctgtattcaatggccttttatcacattgatccaactccatttctatgttcttgctctgtggcactcattcctaaattgtgcatatgtttacgttgtatgctggaacaaaaaattcctacaacagatatttagttaataaatatcctgagagtatttagttaaataaatgagatggagcactatttgttattgaccttcataatactatgaagaatataagcattattctgtatctattacatgccaaatactaagcaaaggcctttacatacgttatttcaatgaacacgtgaacaccattatggtagagaagttttttttttttttttttaaatcccctttttacaaatgaggaaagtgaagcttaggcaatttaagcgtctcactaaaggttacaaggttagtaattggtagaaccagcacttcaactaggcagcttaactcaagactgtgtgcttaactattcactcctccgcatcgtagatctaaaggattgtaatccttatgtcagcagtgctgggcttttgatggggtcatgggtggtggtctggcaagctctgttctcctcatccaggggctgttctgtctgaaattcaacgctttgaagtttcctcttcatgctcttctctcagctgtcctcttttaaggggcagaaattttacaggacaccagacggctgaattaattctcaccaagatgttattgtatttttgaaacaatttaatcctataaaaccaccctcagatattggatgtctgggagtctagggcacactgaagagaggtgacaaagttgaagggcactggagacagattcaccttggaggcattttccctaccattgactctatttaaagaaaagcttgtgcatagtccatctttttgagaacacagaagataaatccaggtgaattttaaaagttggatgcattccaaataaggtttattttacttattttgtaaatcaacgttttataattggtaaaatatgctcacatacaattttgggagaatggtggtggttctgagctgtacttcaactccttcctgtcagtgttcttttgttgctgaaacaagacccttcaggtggtggcagcagtgtagtttgttactttaaatgctaaggcctgtgctaggcagttgcctagcaacccttgtctcttttgtattcctttgtaaggagggttttttttttgtattgtacaatgcaaaattttgtatttgtatttattgacgatttaaaatgagattcttatgtgtgtgttagaatacaacaaattctatatgagcccatcaaaccccctgagtaataattatgagacagccaagccttatttggtgaaactacaaacactaacaggcccacaattatttcagaatcctgctggaaagcataaaggtcccaaagagtgagcggcatctaatggaactgcgtgtttcttatgaaatgttgctttttaaatacatagactattagtgttttcatgggctacatgtacttttattgaagatattatccaaagttgcttagtactccaagctacagcaataaaaaagatacaaaacaatataaaacgtgtagaatatctttcattattttttcccagaacttatgaacacagtgacttgctatttgttatgttgttaactccgaatgaggaaacccttaggtttttatgtgatttaaattctaattttcattttttaaattggctttccttggttctcaagggttccacaggttgatatctagaaggcttgagaactgatcttccgtaagtattcatgtcggaagccatgatctttttaaagcctgggaaaactagattctgatctgcggagataatcttatggcaaatatttagctgccccaaacatagaagctaagtttttgtaaacagtgaaacctaaatatagagttgaaacagagtttaaggtcttcaccagaacaaaagattcccaattaagtaaagtcaggatcaaatagaagaatatttttagaagttaatgtgatcctctcagtaacatggagctagtattaaacagtgctcagaaacgttcacattctcttatgtttgacaggttgttggtatatgatacgactggttatagaaacagccatgttaagcacattctctaactggtctacccaaatgttctggggcggaagcaagaaacaatggatcattcatttgccagtggctcatttggaacaacctctcatctgcaatatgagaattttatttactatacattctaaaaataagataggacttgaataaagcagtggagggaagacctctttgtcagtactgccccagagcttgcccagtaggggctattttgctaggggtcagccacgtggagattcaagaaggtcccaggtgacaagaaaaaggaagctaaattaaccgatgttcagaaaagacctaaggttgatgtttattccattatgctctaacccagtgaccaacacctccatgattttggcaaactgagtttgtgtgtatgtgtgcacgtgtagtgacctcttgcttttcattcatttcctgtttgcagtttttataacttttaaatgttttttctcccttcatcctactgtagataatcatcctgaataagttttgcagataggaaaatgtgtgtgtgtgtatgggcatgactgaggaaagacaagaacatgaggttagtaggtgattcgtagcagtgtctatccattcatccttttgagttgacttatggacgtagcatgtctttgaaaaattatattcataggcggtatgggtgaggaaagattctgaatttgagaattatctgatttttattccttcatactttaggagggagagacatggaatgaggcagctctcttcttggagtcagttacgcttaaatatctaaatcttttggatagggagaactacttgacttactagatgcaatgccctattataagagccatggataaataagtgtgacattggaatcaagttccctttcttctgttcttgaacagaaaaaaaaaaaataagagacacttgaagtcttcccagtcaaacatgcgtcaacattagttcctgaatttcatgagctcgttggctgttgcttgactcacaggtggacctcagcccacttttaaagctttctactttttatgtatttcttagagttctcagaagaagtcttctgtgttctcacagatcagaccttttgctcctttctgctcctgggctagtccatgtcacgccgttgcttccaagatgacttgcttggttataatttttcatctttcccttgcggtactatatctattgcgccatgtgaggagacgttgctgctttgctctgggactctgtttatctaggctgatggtctcctggggccagtgtgctgcttggaaatcccttcctctggtgtagattccctaggatggtctagtcgcaaattctcttggtcctcgtactgctgcaacattgtatcagtctgctcagaacagaagggttgcagtagacaactggttttgctcatccaattctcattttcttcatctcattttttttttttttcctgtggggagctatgcctccctcttccatgtggtctagtgggattgtcaatagcagtgtcttacatacatggcctgtgggtgtcctcatgccccaaactaggactagctgacttctctaggaaatctgtaccttgacgggagggacacattattagaaggaagttgttattccaatggaattgccttaaaaagatagtctatgtgtttttgacagtgatcccttgggctatgctgatttctgtccttcctgggtttacatggattatggctgaaatatccagagtcagtttggattgcttaaaaccaaggaactgttgctgatgctgaagaggaatggttacttccctgatcacttagggttagttgtaacagattgctcagtttttaaagagttagaagatttaatgagatgctctttttggttataatgataacttctgtctttccagaggatctgctggtttccgaggtgactggggtggaatgggttcaggggatacccctccaagcccaggccctgttactaaggctctcttgtaacgtgattctccactgagggcacaaggtccagtggggcaaataattgcctggagatacaagtaatttgagaaagtgtattgaatattatatagttacgtgagttacaagttggaaaaatttgacatatacaaccatgtggtaagcatataccatgcttccaccacaacttctctcttattcaactccattttacaaattcaaaacattataggatctgaagatataaatgtattctatatgttaactgttcttgaagcactcaccattcagcagcagaaagaaccagcttaaacaactcactttaataaaagtgcatgattagaggcaagtgcaaaatgtcctgggagctcagggaatattaattcttcctgtgtttggttcgtgaaggaagacttcttggaggaggtgacttctggattggaatttgaagatcaataggaatctactgggctaaagctctccttgccctgctcagagtctgacaccctatgccaaacagtgtggactcctatcactagtgtgaagggtagttgggcattctgcttggtgtcacctaatgacttttacactgaatagtccaagaagggaatgaagggatgtgatccaaaagtagggaaggggatggaagggaaatgaagggagggaaaagcaggagaagggtggggattagagaggaaaatgaagggagtgaagaggagtggaggagaggagaagaaggaaatgagaagagggaaattgtgttttagcttttcagttctttcatttttagctggtgcttattattccattgcacgaaaagcccacagtttatccattcttctaatgaggaaaagttagcttatttctgtattgctcttaaacatgtggatcagcttttaatgtacatgcagttatgagaacactggaagataactagcattaaactttagttaactgtggtctcctttgcatattttccatgtgtgaatctaccacattttttctcttgcttgggaacagccttgaattttaaaacaaattcattaggttatttaatcttatagatctatatttgaacattctttggatatctcctcatgttagactggatgcattagataaacctggatttaaaaaaaaatgatattggatgtatactttaacaattaaaataaaaacttctacactctaagtttagattttgcttgcagttctaattcttattggaacttgtgtacttcatttaaaactacatgagactcctgggaaaagtatttttaaggcatggctcagagaggtggatgaaggctgagagtgaaatagctaaaattaaacattcctggggaggtttttaaatgtcgtatagaaatttcttcacttttaatggacatatttttcaaaaataggatattttgaaggatgctaaacttttatgtaaaagtatatgtttcattaaaaggatattatcttattttgaaattaagctaggtcttccccagtttcagcaaagcctttagggctctgtgtatttctttgttcactcttttccttactcatctctctctccttcattcactcagcaaatatttgttgatcacctactatgtacaaagcactgttctagttgctggggttatagcactaaacaaaagaaacaaaaatcgttgctctcaggaacttatgtgctactgggagagagagagaataagcaagaaaacagctgtatatgtttaagtaagatgtatacattagattgtgataagtgtaatggagtaaagcaaggaaggggaataggcagtgttggggtgtgatgggacaaccttagataaggtagtgacatctgcaatgagatggtaacgtgggaaggaaattctgggccaaggtagcaagcgcaaaggaatgtgagatgcaaatgtccctgacaggtttaaggaagagcaaggaggtgagtgtggctcacagaggaatggaaggaagggtaggaggagacaagtcacagtgttaatggggatggaagtgcagggcatatagggccttgtagatcacaatagtgacattgcagtttgcattgagtgagacagaaagggaaagccatcatcctgacttcttgtacttgatctttctcacttctaatgatctatggttcgaatgcatgtatacctccaaaattcatatgttggaacttaaacctcaaggtaatggtactaagtgagacctttgagaggtgattaggccataaaagatgacgcatttcgtaaaatgtcttttagtatctcacaggaagactatgtgatttatctccttcatgcttactgtgatgaatctattaatacgtattgactattttgtcattcttggaatgaagctattttgttgtagcatgtaattctttcactatactctctaaccttcttagtttatattttaattggtttttctaatatttataaatgaaatttgcatgtttttttggtgcattccttttcaggttttgatatatgatatgccggcttttaaaaattaagtgttgtttcttcctttctccattttctttgataatatattgtttttataaaaatgattactatttcttataagtaattcaagtttgaaagaaaaacaaggctgggtgtggtggctcatgcctgtaatcccagcactctgggaggccgaggtgggcggatcacgaggtcaggagatagagaccatcctgcctaacatggtgaaaccctgtctctactaaaaatacaaaaaattagccaggcatggtggtgggagcctgtagtccccactactcgggaggctgaggcaggagaatagcgtgaacctggaaggcagagcttgcagtgagcccatattgcgccactgcactccagcctgggtgacagagtgagactctgtctcaaaaaaaaaaagaaagaaaaacaaaagagaaacattctaaattctatcattcattcaaaaataactgtcattaacattagatggacctaccagatattttttgatgtgtatgtattgtttttctgtatgtgtgtgtattgtttttctgtgtgtgtataaaaaactgttcctggaacatagtaagtgctcaagtaatgatatttgttgattgaacaagtagaacattagatggaatgaattttgcaaacatggagtcaaactaaattctatttttatttttaaattgtattaatatatattttaaataaaaagtaacaaaattaattttacaaaaacgaaaataaataactgaaataactgaaactgtaggcaatttagaaatttaggtgaagttttgtttttgtaaagtattaatttctaaaagagccctatattgttcaagaaaaacaatggcatgatgaaaggaaggtttgatttattacatttacttttacttactttttactcaatttatagatgaaattgattgataacatttaaatatgctttttatctcattttctattagctttatgttattttacattatatttattttgcttaatttctattctttactcattttccagtttgctttagctgtattaccataatttaatactttcaatacttaccagtcgtccttttaaccagccttctttattcatctcagttgccttgcttgcactgttcaggagaatttgcaagaaagtcttgtgggtgctgaactccctgagttctttcatgttgagaacattataattattcaacctcttcctggataggttcttgattttcacattccctcagaactttgcatatattgttaatatcttctggtagtgaatatttctgtggagaggtctaaggccatcctgtttttaagttttatttcattttattttattattaggccatccgtttttaagttttatctcattttattattattttctaatgataccttagagtttctgtaagagaggaggaccccctgtatccacattttcacccacccctctcttccccaaagcctttcccactctgtctgatcacaaacgggaaacaataaggccatctctcagcttctggtcttattagggtagacagataccctgtcatgatactgtcgtcttgcagtcactcagtccacttctctgtgaattgaggctattcgtgtgacttaaaattgaatttcagaaaaacagtgaatccttttttagtataagtgtgtccaaatgcaactggacatcctgtgattttattagcgaaatctggcaaccttaggtactacttgttttctggccttaggtggggtgtgagtgggtgaagagaacttgcctggggccttgcaatattccttctctcccctggcttactattctctcagacgatctcatttcattaattttctcatctgttttcaaccctgctgagtccttgttccttgctggggatgattacgtctgggtggaagtaataaatacaccttccctgtctgcgtttcacctggcctgtggagatggtagctgcattcctccctcctcactgggagcctagagaaagttggccagggcttcttcccctcagaattagtttgttcaagtctttccagggaatgtcgtcttctcggtcactcagttcgcttgtctgtgaactggggctattagtgtaacttctcaacctatcttgcatctgaactccctcgcacctcttgtgatgtggactaaaggtcccactgcaccatgccacaccataccagcgttttgcctcttttcctctggaaatttatggcagaaatttgggttcttacttgtttgtgtgtgtgtttattcaaacacatacacacaaattcttgtttggaatttcatgtttttgtcctagttttttttttctaattttttgagggttttgacatttttagaaagaaaatatatgcactttaaaattatcttagttttccttgtatcagttatcacttatctttctcattcttaaatttgtgtatttgtgttttatctctttttacagatctttggtagcatagtggtatatttagtttatttatccccctaccccacccccacctcccacaggactagctcttgtatttatcaatcacttcttttttgttttccaattcattaattactatttttttaattaaaactttttcctcaagttgcagtatcatttaccaacgtaacatgcacgctgcttaagtgcggagcctaatgaatttttaccttcacgtttacccttatgatcaccaccctggtcaagttatagagctgttcattacttccagaaagtccctttgtgcctttttcctattaataccatttaaccccaccctaaaagataatccctctgctgatttctatggccataaattagaatggactgttcttaagcttctaataagtgcaattacattacattataatgtgtgtgtgggtggcggggggtgggggtgtctggcttcttttgctcaacatttttttttttttttttttgagacagagtctcactcagttactgaggttggagtgcagtggcgcgatcttgtatcattgcaacctccacctcccgggttcaagcaattctcgtgcctcagcctcctgagtagctggacctacagggacatgctaccatgcccggctaattttttgtattttagtagagacatggtttcaccacgttgcccaggctggtctcaaactcctgagctcagtcaatccacccaccttggcctcccaaagtgctgggataacggggatgagccactgcacccggcccaacatgtattttttaattcattcatattattgagtgtatccattcatttaaaatggatttaaattctgtttttatgtacactttttaatttttccaactcaaatgtcccagttgttttattcatatttgtttggtaacatataagtgtttcaggccatagattttctttgcctgcagtgttagttttccccttaggttttagtaaacgttgccttcatgctcatggtttctaatttctctgctgttgcactttgattcacactttgacccacaagttataaagaagaatctgtctcaaaaatttgcaagaatctgcgtttttaatttctacctctgttttggatttctaattttattgcactgattataatcagaaaatttgttttgtgctatttttgttaaaaattatattaagatttcctctactatgtattatatactcattcaaaaatgttccacagtacctttagagagcactttttgtctttttaaaaaagttcatggaatatttacaaagactgattacaggatagaccacaaaagctgaacattacgattctcaaagttaataatgtatttttttcccctcaatctgtagacattattccattgtcttctggcatttaatattgctgaaatgtatgagtttagcttgattttttcttcttttgtagattttgtttcttctgtttaattacttacagactttttctttgacattcaatagcttgactgtatttctgtttcaatggtttgctaataattttacttgtatagtgtgagccctttcaatctgtgcattcctatcttcttttacttcagaaaaatggttttctattatcactctatatgtttttccttttcactgacaccacttttttctctaggactgcaattcagatgttagatgtccattatctttatttcatgcctatcatctttatctctaatcacttttatacattttacttttccttttgcattctgtttctcctctacccagtccttcatatcactgactatttttgctaattttgacttcttgctgccatcattgtggttttcacaatgtaatgtttttattaatcttatttttttccttttcattttcttctattgttttatctcttagttgatctcattgagaggtgacaacatcctagcagccctcgcttgctctcagtgcctccttggcctcagtgtccactctggccgtgcttgaggagcccttcagcctgctgctgcactgtgggagcccctctctgggctggccaaggccgaagctggctccctctgcttgcagggaggtgtggagggagaggcatgggcgggaaccggggcctcctggtgcttgcaggccactgcgagttctgggtgggcatgggctctgcaggacctgcacttggagtggccggccggcaccactcggccccgggcagtgaggggcttagcacccaggtcagcagctcagcacccagatgctccagctcccccagcattgctggcccgcccacgccccgctcgaattctcgctgggcctcagccgcctccccgcggggcagggctcgggacctgcagcttgccatgccagagtccccccacccccatgggctcccacgcagtccgagtctccccgacgggtgccaccccctgctccatggcacccagtcccatcgaccacccaagggctgaggagtgcaggcgcgctgcgtgggactggtgggcagctctgcccacagccccagcagaggatccactaggctaagccagctgggctcctgagttgggtggggacttggagaacttttatgtctagctggaggattgtaaatgcaccaatcagcactctgtgtctagctcggggttcgtggatgcaccagtcagcactctgtatctagctaatctggtggggacttggagaacttttatgtctagctggaggattgtaaatgcatgaatcagcactttgtgtctagctcgaggtttgtaaatgcaccaatcagctctctgtgtctagctcaaggtttgtaaacgcaccaatcagtgctctgtgtctagctaatctagtggggacttggagaacttttatgtctagctagaggattgtaaatgcaccaatcagcactctgtgtctagctcagggactgtaaatgcacccatcagcaccctgtcaaaatggaccaatcagctctctgtaaaatggaccaatcagtaggatgtgggtggggtcagataagagaataaaagcaggctgcctgagccaacagtggcaacccgcaggtccccttcctcactgtggaaaccttgttcttttactctttgcaataaatcttgttgctgctcactctttgggtcagtgccgcctttaagagctgtaacactcaccgggaaggtctgcagcttcactcctgaagccagcaagaccacgaacccaccagaaggaagaaactctggacacatctgaacatgtgaaagaacaaactccggacacaccatctttgagaactgtaacactcactgtgagggtccgcggcttcatacttgaagtcagtgagaccaagaacccaccaattccagatgcatcatgaatctgaatcttctttgatgtcaatttttgtaaagtctttgtcttctctgatttttccaatactttgagaagttctaatctataaatgagttctgtattatgaggcactgttcttggaataactgttcttccaatattccaatagtctttattcctatttgtttagtggagtctttttttttcccttacaccacctcctcctttttttttctttgttttggttttggtatgaactctgcataagtgccatgtttgaaacttcatcttatttattctgtcggtctgaatgcaggcacttctcttctgtctggcctgttatttactcaagaagtggatagtggaattgtctttcccttgaatgtattcttctccagataaatttgcaaactttaaaattgtgctaatggacgctaaggtggaaagttaaactctgtttagtccttcatgtgtttgagggacagacggacaaaataaggaatcttattttaggtgtagtgtcttcacattctttgtaattacatatgatggatcctctgttctgcggcccatcacccctcagcttctgtccatttcccactttaggtctgtggttcactctggcaggagtctgggtgagtgggaaccctgggactcagtttcaagaccttttgtttgctgattagagttcatttaatttagccaagcaaatgtataggcttccatttattgtctgtcctcatcgcaaggatttttagtgaatagatagtaagatagaaaaaaagaagcatgatttcatttccctgtcttgcagccactcctctcagcatgtacagttgttcaataaatatttgttgagttgatcgttgtagctcctcctactgactgttcacaactcctgctcccattttcacatccatagaattttggtgtgggcactttagggctcttgctttttgtaagggaaatttacattcttcctatggggtgtggagtcagatgttggtttccacgcatctttaacttgtcctgaattttggcatgaacagatattcattatggtgtcttttatgccattttcaccattctctagtttcaccatgggtgatggttctctggctctgtttttggtggtggttattcatttcagtgagtttctggcaaaggaactaagtaaatgtgcattcattttgtcaccttttagcaaaaattctcaagttgttattctaagacaaaatataaataatgagacaaccgttcctatgggtcatatttatgaaactgtttgagatagctgtcacctccatttccaagactccctgttgctagtactagggtgtgctgtttggatttctgacactccagacttcatgaggtcctcaactcatgactaatccacagggttttgactcacgttcttttgacttatgggacccatgtttctgtggatacatgactgtactctcagcctttttagccaagtttctgaacctcttgaatttagctaatttccaagttgttactgatcttgcttttaatttctcaccctccagtttccagctttgtattcccaagtccgccatcactcatggtctaggtttagagcttgtttgtaataagaaattcagcactctgcatttactactttaagttcctttgaagttaacccaatcttgttttcctacatttgaaggaaaatgacttctgtgaatggaggttgttaaaaacatatgaaactgagctacagagatcctgtggcatttcaatttaattggttttattgcaccaaaatgtccagaatggtgaaagaacaacgtagacccaactctctgtaaccctcactatcccatttgtacaacatcttgcttggaacaaagcaaggagcggagcacactggagttacgtctaatgcagtcttgtttgtatttagagcaaagctgtgggtatatagggtgaaatagagggttgtggctcagtgcctggattttcttcaaggatttgccaatgccttaatcagtgattataagtcacccattaacttggctattcagtgcttctgattctctgttatggaactggaaactttatctatcatgatttttgtagtctaatagatgttgtgatgattgatgagacaatgtaagctcaccagatgtcctcagctatgaagaaagcctggggttctacatacttggctaggatttgtaattgttcactttagtcttggatcaggatttcagtagcctgctggtaatcagtccaaaaggcagtttcaattttttgcagattgagacaatggtagggaagtaaacattttaaggtttaagttatggtttcctttcaaggtagcatattttggccagactaggttactttaaataacaaaagattccttacccttttttttcattgttttacaatgctcattgtagaatttttttcaattaaaatttttacatcactaagcaatgagatttttaatttggaatttcaaatgaagtctgaaattatagtcataattttttttgttttgttttgagatagagtctcactctgtcacccaggctggagtgcagttgtgtgatctcggctcactgcaacctctgcctcttgggttccagggattctcctacctcagcctcccgagcagctgggattataggcatgcaccaccatgcccagctaatttttgtatttttagtacagacaggggtttcgccatgttggccaggctggtcttgaactcctgacctcaggtgatctgcctgccttggcctcccaaagtgctgggattacaggcctgagccaccaagcttggctggtcattagaaattgaagcaactttatgtttttctctttgtgtatgttttgttgttaaattgtgctttttatttttattttaggaattaccgtcctgtgctaggtattccctggaatgctcaggatcacccttggctgctccttattgtcactcagaccttagcgagcccctccttgatgatccatgaaaaatagctactggtcactccctttcactttctcttttcaattctgtgcatagtgttcatggtcatcgagtatttcccctcccttcccttccctttttctttattcccttttccactccaccacaccttctctctagttttagatactggccttgtttagatatctgttcacagctactcataagattatgtgaactccaaagtattaatagtagggaccttgtctgtctgagtcacctctgtttccagcatctagattaagactcaaagaaggtacatgatcaaacattaaatgaattaataaggtattaagtttggttcaaagctgcctccctttgtattttaaatttggcttaatggtttctgcatacatagtgggctgtaacctgacttgatgtgtcaacagactgtaacctcctcttttgtaacaagtagccgagtttcagccaattacaggtagccaactgttcacaccaggttcaaataaggcaagcacccagctataactaatctggctgtttctgtaccttgcttccgttttccataggtcaccttctttttctgtcccttaatgttattggaccatgtggtagccctgtagttgctctgaacttctggttctggtggctgcctgattcgcgaattgttttttgctttattaaactctataaatttaatttgtctaaagtttttcttttaacggaacacatgaattagaagtttcctaatagcctattgaacacgatgttgaagtaattacaattagtgaacattccataaaacatcatttaatgtttgaatgaatgtccaaatgacggaactgctacatcctcagggaagatgtgcttctttgtacactcccttgtgtaagtgtttaacacatcccttctgattgagtatgtttgctttttccaaactcatggctcttcctttgatcccatttttatgtctatcctgagctcaaccgctggccttctttttttgttttatctgggcaaatatgattacttcaaaattgatgtgattatatagcaggaaggactaaccccacacaatgtttagttactaaagtatttgttgagttttggattgcattatattcttttagcactttacatattcaggaaataagttcatgctcactgtgttctagatactggaatatatagatgagaatgcaaagttcttattttgagctaatatattgttggagaagataaaaacacataatctgatgaattcaaaaaggtatcacaggacaggtaacattgtttcttgaaagttgcatagaaattttccaggaaggtaagaacaagaagaaaattctcaacaagtgccgagtagcctcttaggcatgaagttctactcaactccaagttgcttctacactgatgcttaccctttaccaagtaggtctaagcagtgaggaggctgcttagcattgtctggcaaatgctacacatttaataaatgttcagtgaatagataaataacttcgccctttgggtaacaaaaatccatcaaaagtttccttgtgggcatacatgagtaatgtttttcttttttttttgagatggagtctcgctctgttgccaggctggagtgcagtggtgtgatctcggctcactgcaacttctgcctcctgggttcaagcgattctcctgcctcagcctcctgagtagctgggactacaggcacacgccaccatgcccagctaatttttgtatttttagtagagacggggtttcacgttgttggccaggatggtctccatctcttgaccttatgatcagctgaaagtgttgtttgttttaaaggaggctcacactgacagaagggtggaaaaatctacaggtggggagagcctggggcctgtggggacagatggggacaaacaggaaggagcccattgttcctgctgtcctcagagcccctgagcgacagcatgtatagcacatatgcaaagtgtgtgtgtgtgtgtgtgtgtgtgtgtgtgtgtgtgtgtgtgtgtgttgggggatatgttcaggaaaaaacaaagtagagatgtttaaaggaagaggcaagggctattctattcatggacaattgggcactgtggctattctttctaagttgctcagaagtgttctgaagcaaaggttctatgaatttgaatcattgggttgttactgttactctctgaagttccaacttccgaaatgaaatcttttgctgtttttccctaggacctgatatttgtcaaccttggctcctgctttagggtaatttggcttatttttaattttttttcttaaaaaaaaaagcattgccaatccttcttccataaggatttgtctgtgatggaaaagtctctccaccagcatttctcctacattgacagtgattgaactcagggtagaatccatttgtcaaagcaggctggagaagggagtcctactctgtgggctgccactaacgtgcctctcaggctaagattctgtggtggccactaggatacggcgttgtggtccttcctgaatctcagtcaggcaaaaactaacccagagatgtaccacctgtattactattaatatttttcattaaatacaaactttaaatttactttaaaaagttaggcctgttccaaacaatcacattcatggaatcacagactttgtgtgctggttgttccctctccctgccccagcaccccaatgcacataagatgaatttataactcataaaatatgtttattcttgtatcaaatacaattagcttgtgtctcttcaatggtacaggacctccacactgggaaaccctaacatagtgtatttaagcttgctgggacacacatgtcttagtccttttatgttgctataaagaaatacctcaggctggataatttataaagaaaacaggttgatttggctcatgttctgcaggctgtgcaagaagcatggtgccagcatccgctctggcatgggactcagtaaacttctactcttgacagatgcagatcacatgtcaagaaaggaggcaagagagagaggagggaggggccaggttctttttagcaatgggttttcccaggaactaaaagagcaagagctcatttgtgactgggcgaacaacaccaaaccattcatgaaggatccactcacatgacccaacacagaccttaatgcccagcagtgctggctaaaatccagaagtgcataaagaatatagtggaggggcctgtacctccatccgttgactgccggctcagtcagctggcccactgaggagaagaaagaagctcttagcaaatgaagagtgaagaacacacatttttcttcccagagagttgacagtaagcccagaaaaaggaagttaagccctagctttggtgtggcaaaagaagaaatgataccagaggcttagagatcttctgtgtcctttttgcccagacaacgcgaagcccaggaggtggagccacagccccacatgaagtgcaagaatcaaaggggccaaggaaggaatcacggtagatgagagaattgtgttttctctggaaccttggcccccagtctgatcttggctgcttggggagtgaccagatctcctgatggcttgggcttgcttgctcacatcggctgcaaggcagggatatataggtttatagctcatatataggtttatagctcacacataggtttatagctcatgaagcatcaggattctcattgaccaagacattgctctgttacatttattcagtaatggagaaactaaaggaaaaaagatgactgcttttcacagcaactacagggggaattcaggatgacagaaatgtagttgcagtggcacttcgattaataaaacccatgggaaacatgcccttttacaaggaaatcatcatgcttgagaaaatacgaaacaaaaacgactgtaaatcacaaagttgcctgtacgtgcttttacttgacttaaaaaacccaacaaataaaaagtccaagcaatcaaccaaaaacctgtttcccagcttgtgttgtctcctcacattgtgaggtgaacaaaaaattctttgagcaaaatttcttttgagccaccaatcacagctttctgttacttgctaacattctgcccagtcaaccccagcactcactccctcctggatccagtggtcattccctccccagccttcaatgtttaagaccttctttcatttttcttcctcaccaaaactgagaaaaatccacaaccccaaactatttatcactgattgctaactgatggtatcttagcatactgtgagtatggcccttggacagtgtttcagatatcagtgggcaggtgctttgtcaccaaaaggaaaagattatgcatcaaataagattgtaaagttctgggttgagcaacttgaatgggtttcattactgcaggacttttcagaaactttagtgtgtgtatgtaaattaggaatcataagaagggtatagagtgttcaatgttttccaaactttgaccatggtaacaattttttttgagtatcttgaggaactaatgtttgtcttacacactctgagaaatgctgtttcaggtaaaactcgtctacgtgtatctaagcaacctgttaacattgtacatctgtagtgggttgaatagtggcccccaaaagatatgtccaaatcctaacccctagtacttgtgaatatgacctcaattcaaaatagggttttacagatgtagtgagattaagaatttcaagatgagatcactctggcttcaggatgggccctaaattcaatgactgttcatataagagatgagaaaggaggagacacagagacatacagaaagaaggccatgtgaagaaggaggcagattagagttatgctaccagaagccaaggaacaccaggagccaccagaagctggaagaggccgaaagagattcactctgagagcttttggaggggacatggccctactaacactctgattttggacttccggtcttcagaattgtgaaagaatacatttctcttgttttaagctccctggtttgtggcaacattgtcagctctaggaaactgaatgcaacactatctctaattgtggagtgtgctgactcaggctttggcctttcattactgtaaaaagactaggcatctgtgagcagagggcagatatttttgaggtcagagcctgattctacttttgatcactgaaaataaaatctgtttaatctgaggtgattggctgaggagtgtagtacattagaagaaatagccatgattctctccaaagacagttctcttcctttttggtccttttctggtgttttcctgttttggtgaatggtgactgcatctgttctgtctctttcactttccacacttgatcaaccacaaatcctgaaaatgttaacttccaaatatgattcccatccatcctctcatctgccacttacttgttgcttctgagtccaggcttcatcacctcttgcttgggctactgggatcccctgaccagtctccctgtatttactcttgctcctctccaaaacattttacatgcaggcggagcatgttacatttctcccacctccccagctaccacttaaaatactaccatgattttttacttcttttagataaaggagaacatccttaatacaggctacaaagcttgccatgttatggtctccaccgactccacaaacttgtttcttcacagcctgcttccctctgctgtcttatttgtagtcatagtaaatttctttcagttcctcaaagacgctttgctcaacttgctatacagcctttgctcatactatttcctttgtctgaaacatctttcactcctgtcctgtgacatagctaattttcactcttttttcagattccagctcagtcatcagttgctcaaagaagtcttccctggatttgatgatgattaattctccctataatatggctctttcctgaacagttatcacagttgcacctttacatttatttgtgtgattattgcctactaaactacatgtacatgagaggagggaccatgtctgtttttgccaattggcacagagtaaaggttcagtaagtagttgctgaatgaatgaatgaacaactaaatgactgaatgactgaatgaacaaaatcaatgaagtaatgaagagaatgaacaaaggttgtttcaactgaagatgttgaaagtttagtccttacaggatttgagaattataaaatcttacttcctccagaacctgaaagcatcagtcacggttttaagttacaagcaaaagaaaccaactcttattaattaaagcagaaaggggatttgctgaaatatggtggtgactcacagaatctctgataagtctggaaatccaggcttggaggttctgtagccagcacagtgctcacattatgcatcagaacacagcctgtgaagatagtgttattaggttggtgcaaaagtaattgcagttttggccattgaaggcaacggtcaattgaaagcaatggccaaaactgcaattacttttgcagcaacctaatactaccataccaatgttgaacaacgggtgctactgatagactcatacctgctgccgcctctggaagccaagtgcagcttccatgcctgctgttactctcaccagaatagcttctttgcaatccctgcttcttcaagccaccttcccaaagtctgagggggaatctgggaagtgagtgtctggcattttcagtttcactcgtgagcggtgaggtcagtcttataaagttggggtatctccagccatcgtaacagtgtgcagatgttggagaacacaaagaataatggttgttcgctgtaacccacttggctgtacaatgttaacgtatcgtctttcccccttattaacattaaacaataaaaaatgtacctgtctagtaatgttagcacccctcatccaggtggtatgtggtcaaggcacaacagttactatatctagccccagaaccagcatctctggttccattaggtcattcttcaatattctggactaaattctaaagcttacttctatgacagcaccatatataaaagagtaggagaaaggaagagaaaataagagaaaagagtctcataaataaatatcagggctgcaagcctacaaaactgtattccttatttctagaactaaccccaaggccatagttgatactttttctttgtcttcagccacctcagctggtcagcatcctttatcagcattttccgtctctatccctgagggttctaaaacctatctgtgtgggttgctgttgtcttctagtaaattttaccactaaatatggaactataataaagtccctcagggaaactgtccccatactgaaacaataacactgcttgcccttgacaatcaggattactcatcctactcagcaccctaatactccttttttgcctttcctcctgacgagccccagatgagatgtcgcagcttccaattcaatgttgctattgttgggttcctgaggaacactccctctgaatcatctgagctcatgtggacgagatgggaagcagacattttgagatgacttgttaagagtaatagaggtgttcctgccttctacctcttggtttgaatatatccatatattttgactagcggagaagacaaccacccacacatatcggtttctggttcagagtatatttgtatcttgttggagagcacctcaatctcacaaactggtatctaaactgagtcttcaataggccatcccactgttttgtgaggtcagctgcttctgggtggggtggcgtacgtagtaaaactggaggatttcccgaatccagatgttccaggttgcagtgagctatgatcacaccactgcactccagcctgaacaacagaatgagaccttgactcaattcctcagtgtccctgagaaatctcatgggcattggccaactgtcatgtttatttcactgcaaagtgagttcctcaattagaagcaatagtatgtatgtatgtattttatagttcttttttttttttttttgagacagagtctcgctctgtcacccaggctggagtgcagtggcgtgatctcggctcactgtaagctccgcctcccgggttcacgccattctcctgcctcagcctcctgagtagctgggactacaggcgcccgccactatgcccggctaatttttttgtattttcagtagagacggggtttcaccatgttagccaggatggtcttaatctcctgacctcgtgatccgcccgccttggcctcccaaagtgctgggattacaggcgtgagccaccgcgcccagcctatgtatgtattacataacgatggtgactatagcattcggtaagtccagggataaagaagctaccagagacattgtgatcaagggtagtaaatctgaatccaaaataagtgagggcaaagtaatcacaaataccttctccctccatgatagaatgaatataaggaaatcaaagcgccaggtatctggctgttcccctgtgatatggtaccatagacaggacttagtgttggtctctgctactagcaagtaggacccatagatatacaacagtgtcagccttggtgagaggaagtctatgctgctgcataacctccattcctatcttcacagtcatcctgttcatgaacctaattagcaagcatgggttggcaggggaaagagactaacaaataactgtttatagaaaccttccttcccagtgagagcttttgggtcatcattcatatggaacaaaaaatatcacttcatggtgggtccattgtgataaatccatgtacatacagctctttctcaaatatctttttccaaaatcctccaaggaacttgatcctttcaagttttcattctctttctctcttttttagagacaaggtttcatgttcttgcccaagctggggtgcagtggtgtgataataactcactgtagccttgaactcctgggtttaggcaatctttctgcctcagtttcccaagtagctgggactacaggcccacaccaccatgcctggctaattttagtttttataaaattaaaaaaaaattactttagagatggggtcttactatgctgcccaggttagtcttgaactcccgacctcaagtgatccttctgcattgacctcccaaagtactgggattacaggcttgagtcacagtgcccagaccctttcaagttcttgacaatctagtggaactattaatcactgcccatgaattgatataaattcttattttaggttttctctgcttctcagcaagtggcccagaggaagaactgcttaaagttctacttgctgcagcagtctacgtctggtgccagcaggttagataaaagtatctgtaagtcaggcttaaaatgtcctgttggtcaactggccatagcaaacttctcgccaaactttaagtctgtagatggagaggtcataacatagcctgtaagagtaagacttctgcagtggatacaccatgagtgtgaaccactgacttatgccttcaggacatcctgaagcctgatttcataaatactatgtccacttgaaaatggagtgctcctaggcacacctgtatttatggattgttgaaatcaaataacacctagtttccacgtctcctgatttcctatgataagtcatccagtctctcccagggctaaatagcaagtcaagagctgtttcttgaaatgagaattagttatttaacaaagagtgcatgattttactatgaaatacttgaggtcacttttcccattgggggtaactgtaaggtccttacaatgatctattcttctgcagacagttcaagcaccgttggatcctctaggtcagaattccagtgaggcctttggctctactcactgcagtctttgggagcctccagtaaatgtcacagaatcagagtacaggtcctttattcttccctccttttttcccctttgcttttctactttccttccttcttgcactcatttattgagttccctttactccagtctatcctgcctgactacagaaagaccctgcctctcacttcttgaatgtaatggaatccctgcccttttctccctataccccaagactctcagctataacttttataattctggcacttttgacattataataattagcagttaattcattttttagtaatgtaactcttcctttttctggagtcctggaacacatcactaactctcctacatcacttgacctttgtcagaaactttctaagtagaagaaatgtgttgaagccacacgtcctcttcgttagtagaagtgtcacatattaagctgaattgccgtgggatctgggttgctgctgaaactgggtgttgggacacataataactgcagggaaccaggatttcagccttattcttatttgagagatgtttcctctgagagcaggatatatgtttcttcctatcataaactctgcctcagaagagctctatggtcgtttggtctattacgccaacaggctgttatcaccggaggaaggacacagtctagcatctcatcccaggtggtgctaaaggcctagagacatggacttgctgttgctccctgggcagctttagattcatggcttcactcttcatgggtttgccaggttattgcactttattcctctttcttaaaaatcccttctttttcttaatttctgttcagacaaaatgcaatcccccattacacatcatttgcacatacttatggactaatattatgagcctcccatttcttatgagccactcagttactctttcttgtttctcggagaattagcgttcctcttactactccttgtcacacattcccttcacttcagacatgactttgtggccttctgaagccccaaatctggtgcgtcatcctcagagaaatctcagtaaattcacattatttctttgctcagaggaataacagaattttgtatatgtacccaaacagtggcatttgttttcctccctggcctagctcgtaatataaacttctttctaatctgctcttcttgtttgccccttggtgctttttatcattattagtttcctatttcttccagtcccttgggcatggtgaatatctcagttgaatgagttagcatttttacattgaattttatacagctgtgtcttacctgtgtttccaagcttattttatattaaatatgcttgcgttattttacctttgcttactggtatttgcaacatctctcaggttagaaacatccagaaaatctcattaagttactgatcactctatctcccaggtcttcattaagatataaagatttaacacttcagcactccacccatcatttcagtttcacagaagtctttgaggcaaaatgagaaaggaccctgtggacgcatctgtcagttttattaatactttaccttgtgtgtcatctggatctgctaattcatgcatgcttcttagactttcctatgtcttccttcacttttacttttccgtaagaaattatctttataagatgattcctatttattaattgtccatatttagagtctttcagtattaaagatggacacccccctccatctccataaattgtcaaattgttgtagaggctagggcaacattcatagagttattatgttttaatatgttaattttttttattcagggctgggcacaggggctcacacctgtaatcccagcactttgggaggccgaggcaggcagatcacgaggtcaagagatcgagaccatcctggccaacatggtgaaaccctgtcactactaaaaatacaagaagtagctgggcgtggtggtgtgcacctgtagtcccagctactagggaggctgaggcaggagaatcgcttgaacccaggaggcagaggttgcagtgagccaagatcacactactgcattccagcctgggtaacaaagcaagactcggtttcaaaaaaaaaattattttattcaacaggcagcacccccacataagaaggttttgtagattttgagggtgagatgcaaaaaggctaagtaactttattcttggcccagatgggtttgatgcaggtccaggcaatacctgctgcaccactgactctggagggccaatctgtcagccaggcagcaacactgttctgtggcccattggctctttaccagtggttttggtttacttggtgaaaacccagagaaaatatccagtgagtcagcacatcgctgaggatgaagcaaccatagagtactgctggaagggtttcaggaatctcatggggaaggtgacacttaaaaggctgctctaaggctgggtgtggtggctcacgtaatcccagcactttgagaggccaaggtgggtggatcacttgaggccgagagtttgagaccagcctggccaacatagcaaaaccccatctctactaaaagtacaaaaattagccaggtgtggtggtgagcacctgtaatcccagctactcgagaggttgaggcaggagaattgcatgaatccagaaggtggaggttgcagtgagccaagattgtgccactgcactccagcctgggaaacagagcaagactatgtgtccaaaaacaaacaaacaaacaaacaaaaagtctgggtgtggtggcttacgcctgtaatcccagcactttgggaggcccaggcaggtggatcacaaggtcaggagatcgagaccatcctggctaacatggtgaaaccctgtctccactaaaaatacaaaaaattagcggagtgtggtggtggacgcctgtagtcccagctactcgggaggctgaggcaggagaatagcatgaatccaggaggcggagcttgcagtgagccaagatcgtgccactgcactccagcctgggggacagagcgagactccatctcaaaaaacaaacaaacaaacaaaagtctggtctaaaaagcacctgtgtggccacctcctccatttgtgacttcccttccagacctcctgccattctcctacagggtgccacagactttctgattgtgcctccctctccacgtttgctatgggacactttgtgtctgtttagagcattaccaccttggaagcatggtattcttttaaagatcatgaatctcttttcccacctctgtctctggtgtggcacaaatttagaaagacacaactatttcattctcaggagaaagctaacacagaacagtctaaagaaagacacagagaacagtcaaggtaaatatgtacaagattgctttagtaaacgggaggaagggttttgtccaaatgggctcagtgctatccgtgtggctacagctgctttgtgagattatctcagtcacatgctcttgcatcaggacctcttccatggcaacccctgaacgcactctctcagtcgtgcccgcccttctgctatagacccttcccttctcatccacacttggtgctgtggatcctgccttgccttgggtctggaacttgtttccttgggtctcagcattgaatcaatccttccaacttccatgcctcactgcaactgcttgaaaactaacccagcctaggtcagactccggattatcctgctaagtcagaagaggcgtcagatgaattgacggttgatcccttggaacaaggaggcaccaaaggctgagtgctggaaacactgtattctgtaatagccgtcttcaagtttgtctagattaaattacagtcgctcaactaatcaacatacactttgagcactcagtatcgtgaagttctgttctgagcatttaaagtgatacaggtgtcccaagtagagttgctggatttagcaaataaaagcacaggtgacccagtttaagtgaattttagagaaacaataactttttagtgcgtgttctaaatactgcatggaaacttttttttagattgtatagaaactgtgtgggtgccagatggacaactcagctgacaacctctaccctgaatgaacttgaaattgaaatattgcacaggacaaacttatgctaaaaaagtgttgtttatctgaaattcaaatttaactggacaactagttgaattttatttggcaaccctagaccctaaggaacgtgccttaactcaagtagtcaacagcctcattgggaggatggagtcacctgtgcagcctgtattggtactaggcagctcctcacaagggccaggaaaatgccatagaacaatgagctcagaaatagaaaactttggccaggagctgtggctcatgcctgtaatcccagcactttgggaggctgaggcaggtggatcacgagatcgggacttcaagaccagcctggccaatacggtgaaaccccatctttactaaaaatacaaaaaaaaaatagccaggcatggtggcggtcacctgcaatcccagttactcgggaggctgaggcagtagaatcacttgaaccctgggggtggaggttgcagtgagctgagatcgtgccatcgcactccagcctgggcaacaagagtgaaactccatctcaaaataaaaaaacaaaaattagaaaacttcagctacattcaaagaatcaataggcagagttaaagtgtgcatgggagtggtggcttacacctgtaattccagcattttgggaggctgagacaggaagatcacttgaggctaggagtttgagaccagcctggacaacacagcaaggccccatctctctaacaagaaaaaaaagtgtgcatggggaagggattgaatttcaggtggctggccaggcatggtggcttatgcctgtaatcccagaactttgggaggctaagacgggatgatcacctgaggtcaggaattcgagaccagcctgaccaacatggtgaaaccctgcctccactaaaaatacaaaattagccaggcatggtggagcacacctgtaaacccaactattcaggaggctgaggcaggagaatcgcttaaacccaggaggtggaggttgcagtgagcggagattatgccactgcactccagcctaggtgacagagtgagactctatctcaaaaaaaaaaaaataaaaataaaaaataaaaaaaataaaagaatttcaaatggctgaaggtataaaagctcaagtcattgtcaggggataagtagtctcagctagaagagtaaattgagaatgaatggaagggaaaaccagttttgaactcggttgtccgtgtttttgtttttgtttttttttttctggttagtgtggagccattaaaatttttcaccatgggggccgggtgtggtggctgacgcctgtaatcccagcactttgggaagccaaggcgggcagatcacaaggtcaggagattgagatcatcctggctaatatggtgaaacctcgtctctacaaaaacttagctgggcgtggtggccgatgcctgtagtcccagctacttgggaggctgaggcaggagaatggcatgaagctgggaggcagagcttgcagtgagctgagatcacgctactgcactccagcctgggtgacagagcgagactccgtctcaaaaaaaaaaaaaaaattaccatggggaagaaacactgtgtcatgtttttagatcataatttccatgggaagaacctgaggagagagagagagaggttaagtaatttgcctaacaccagacttgtcttattgtagacaggagaaaggccatgtggatacagtcaactttaaacaactaagagttatacagatgttccttgcttatgatgggagtctgtcctgaattacccaccgttaagttgaaaagatcttaatttgaaaatgcatttaatacacgtaacttactgaacttcacagcctagcctaacctgctttaagtgtgttcagaccacttacattagcctacagctgggcaaaatcatttaatacaaagcctattttataacaaagtgttgaatatctcatgtaatatgttgaataatatattgaaagtatatcgcttttactccatcaagttgaaaatttgcaagtcgaggactgtctatctaaaaacatgactttaggactgattttttctttgtccatctttactggattgtgtagaaactgtgtaagtggcagagatgcacaactaacagcctctaccttgggtgaactgttctcttggcctctcgagatatttgtagtttaggaagcataaaatttaatatctactaaggatatttctctcaatacaggttcacctgctttaccctggcccaaacactggggttatcagggagggccatcgccacctttattgctgcaaggatctggcttagtttaatctactaaactgttgtaatggccagcacagacccaccctttgcccatttgtctctctttttcaagagacatgtagtgcaataagcatgtgagcttttatctaagagctgccaacgttagaactgtttctaatctgtgaagttcatagtgattatgctatttctgcctaagtgtgagggcaacatttcaaggaagccccattctgtgtggatagtcttagtgctttgatgctacccttatgtgtaggcaaaccctaaaatcacacgtcaaattaacatcaggaaaacatgagcgaatcttcagccttgtaattttctgggtgactgaaattgcttctatgttaagtgtttataattttgtttttcatctgcaggcttatattttctactttctgcattaactaataaattcctgttttctggaatgtactaggccagaatatcacctatgagtggagctgtagtagagacttaggaattagaagggatgttcaactaaatgacttttaggttccctttcatttatgataatttgttattctacttccttggtgactcagaataaaattacatactgattttcctacttgaaaactgtagttgataggaaaaaaaaggagcacaaatattgattgctcatccatcctaccttttgtttaggtttatttgagtgatacattactgaaatttgtcttttgataatgatgatttaattctttagcaactatttatacaatattggccagtgaaaaatttcagatggttctccatgttttagactatcagagcaatgcattggtctgaaacataacaccctagaagacaaaagaatgaaaagaatgaggtgcacaatacaagagtcattccgattaagatatggtagagaaatcattttttttttttttttgagacaaagtctcactctgtagccactgcacccagctagttttttgtatttttagtagagacagggtttcaccatgttggccaggctggtcttgaactcccgacctcaggtaatccaccggcctcggcctcccagagtgctaggattacaggcgtgagccaccgtgcctggctgagaagccattcttaaatagtggatgacagtcctcataactcagaatcagataggaagctttcccaaaatatggactgctagactttactttgtacatttggggtatgacattggaatcctctcttaactcagaagaagctgggctctggccttctacctacctaaaaaaagctgagcactccctctcccaccagtgtatgtgcagatgggttgggattattctgggaagcaatcatttctcagagtcccagacatgatgtggggcaatccctgcccacagcccttcaattcatttcagtttatctagtatccctcctttggctgtgccaaatcctgtgcattttacacccaggttctcctgactttctctctcttctccccatgcatcagtaaaatcgatcaatcctatcactaccacaaaacacagacctttctgcctgtggcacctgccttcctgaacccccctcctacactaaccttaagataggatcctgaggccgtgcggtggctcacgcctgtaatcctagtgagaggtgaagccagctgggcttctgggtctggtggggacttggagaacttttctgtctagctaaaggattgtaaatgcaccaatgaacgctctgtgtctagctaaaggtttgtaaacacaccaatcagcactctgtaaaaacacaccaatcagcgcgctgcgtctagctaaaggtttgtaaacgcactaatcagcactctgtaaaaatggaccaatcagcactctgtaaaatggaccaatcagcactctgtaaaatggaccaatcagtgctctgtaaaatggaccaatcagcaggatgtgggtggggccaaataagggaataaaacctggccacccgaatccgcagcggtcactggctctggtccctttcttaactgtgggaggttatttgttttgctcttcgcagtgaatcttgctgctgatcgtgtttgggtcttcactacctttaaaagttggaacactcactgtgaaggtttgtggctttactcctgaagccagcaagaccacgaacccactagaaggaggaaactccaggcacgtctgaacatctgaaggagcaaactctggacacaccatctttgaggaaactgtaacattcactgcgtgggtccacagcttcattcttggagtcagcgagaccgagaacacaccagaaggaaccacttctggacacaccagcactttgggaggctgaggcaggtggatcacctcaggtcaggagttcaagacaagcttgctcaatatactgaaaccccgtcttaactagaaatacaaaaaattagctgggcatggtggcaggcgcctgtagtcccagctactcaggaggctgaggcaggagaatcgcttgaagccaggaggcggaggttgccgtgagcggagatcgtgccatttcactccagcctaggcaacaacagcaaaactccatcttaaaaaaaaaaaaggaccctgcagggaaagatcagtctaccaatgcaggatgccaaattgacaggagattctataaataggtgtatttcaatacctttataaatctgaggaatagtgtaccatttcattttatacattgaccaatagatttttttttgcattgttggcagattgaacttagtaaatatttttgcttttagcatggaccttaaatcacaaaccacaaaatacacagttctgtcgtgcgcactgtttccaaagggagagaaaattacctgcccagtctaaggtagtttaacttctgaaagcgtaggaaggtttatgttgacttgtttgtttttcttttggtgcaagtttcactccatccttagtaattgcttttggaaaagacactttaacagaaaagtaaactgttatacctggaagattgattatacgttttcttccatttctctgtccttattaattttctgtgacatttgtgaaagtcaatatattgttcattttttatgacgacatgaagaaaatgctcagccgtgagaacctttaaaaaacaaatgaggccgggcaaggtggctcatgcctgtaatactagcactttgggaggccgaggtgggtgcatcacgaggtcaggagatggagtccatcctggctaacacagtgaaaccccgtctctactaaaaatacaaaaaactagctaggcgtggtgggggtgcctgtagtcgcacccactcgcgaggctgaggcaggagaatggtgtgaacccaggaggcggagcttgcagtgagctgagatcgcgccactgcactccagcctgggtgacagagcgagactcctttttacaaacagggactccctgtcccgagtcaattgaacatgtttagcccgaatattttctaatatgtatatgggtattttaaagtctttttctttcattgtgaatgttacatatggttatttttgaaaatgtagaaattgaaaaaagatttaggaagaaaataaaaaccattagtaatttctccatccagatataaccattattaatttttttttttgcaatcactgataaattatatgctggtatgtgcatagtatatatgttctctttgttggacacagtgatagcattttcacacaattctacatttattttaatttaccaatatatcatgtagtcaccctatatcagcatatgtagagctactttgttctttttagaggctgtgcagtgttctgttgtattgtccctgaaggtgtttagtgttctattgatgcctatttaagttgttttaaatgtttcgttatttaaaatggggcactgaatatccccgaatgatacaattttatccacatgagtgtatttgtaagagaaagttctagaagcagaatgcagggtcagagaatgtgcatttgtaagtttgatagattgctctccagagaggttgtagcaatgaatacttccatcagcaaagtttcaaactgtctgctttcccacacactcatgctatcaaacactttggaccttgtcattccaataggtgatacttgttatatcatttaatttgcatttctcattatgaaagagtttgaacatctcttcctgtgtttaaaaactattttaatttcattttctttgtattcactcttcaatctcttagccatttttctatattttctgtcatatttttaacatttacttttaggcaccttttaaagagtaaagaacatagccctttgactctaatgtgcttgcaaattgttttttcctttccattttgtaatgagtgtttttaatattaatgatgttctcccccagcctcacctggcgtgccatgcaggtattcttaaagtttttgtgtcatcaaatttatcagcattttcttgtgtggagtttagattttgttttctgtggaaataccttcttccttccaaaattatacagaaaaacttttatttgtcttctatttttcattctttgttttattttactttggctaaaattggaagcattggttaaaatattttttttttctcaaatggcgacttagtttgactatagtatacatatacattaaaaaatccatcttgcttgttttgagtatcatatttatcatctcaaatttctgtatatatttgtgtctatctttggagtgtcctgacccatttattcatctattcatgtgccaatacttcctgtttctgttattgtaacttttaaatatgctttgtcatctggtaggactagtgatccctcgttactcttctttttcagaattgtctcctttaaaaaaatcttgttggtattcttatgtagtcccagattttgagacattggtttatttccaagttcgtttatttccaagttttaactattataagcaatggttttaagatttactatcaagataattttggggtttttttgcaaataatctttcattgcattctgctttatttctttataaaagaatcttagatgtggaattattgggtaaaaataattaattttctaaaagcctcttgatgcatactgtcacactaactttccagaatctagaatacatactaacaatatgtattagttgtctttggttgtcttatgctgtgtacaaaaattacccccaaattgagcttaaaataataagcatttattaatgggtcaggtatctggccgtggcttaactcaattcctctggttcagggtctctcataggactgcaatcaaggtgtctgccagtggtgaattatctcaaggctccactgaggcaggatttgcttttgagctcattcaggtcactgttggcacacctcaggtcctcgctggttcttggccggagaattatctcaaggctccactgaggcagaatttgcttctgagctcattcaggtcactgttggcatacctcaggtcctcgctggttcttggccggagatacctggtccttgccacattggtttctccataggccagctcagaacatggcagctgcttctctcagagggagcaggggagacagtaggagagaggaagcaacatgaaagtcatgggttttttattttttatttttatttttgtaggtagctttggaaatgacatctcccacttttgctctattttgtttggtagtagcaagttactaagtccagctcactcatgagggtgaggattacacaaggcatgaattcaaggaggcaggaatcactagggacaatctgagaggccacctaccacggagctctagtttcattgcatcgtcaccagcctggagtgtttgtatgttgttaaaacctttcagtttgatatgtaaaagtcattgtattttgctgtaatttcattttctatttcttttattactaaggaagaaaagacaatttattatttattgattgtttgttttttatttttgttttttttgtttttgagatggagtcttgctctgtcgcccaggctggagtggagtggctcactgcaagctccacctcccgggttcacgccattctcctgcctcagcctcgcaagtagctgagactacaggtggccgccaccatgcccagctaattttttttttgtatttttagtagagacggggtttcaccatgttagccaggatggtctcgatctgctgacctcgtgatccgcccgccttggcctcccaaagtgctgggattacaggtatgagccaccacgcctggttgattatttgtaattttattctttaaattgactattttccccctttttcctccttaaggatcttagtttccccatctccatagatttgtaatgctaacttaatttggaattgtgacccttctatggaagaaagagtgccctgttaacttcagggagctgagggaaatacgtatctcattttgttctgtggttcaatgctagtacttttttcttaacaaaaagattggggtattaactgcagataccattgggtggtactactgaaactctcaaacaaaataatgaaaactttgacatttatttccctggttgccactgtatttgtaataacatattgacatttaacgttttaacacatgttacagaagatctaccaatttgcaggctaatcattatcatctaactttttcaatgcaaaattggttaaaactaattaaagtgccatgctaagaatttgcagaactataaaagccttatctattaaaaggttccaagaaggccaactctcagataataaaaaacttgaattttgcttagaagatcaagagttgaattgcaataagtaacatcacgtgcaattgcaggaagcttattatttcctaagacaataaagaaatattgcaaagagaacatcagacttgcatcaatcaatatgtgaccctgggcaaatcatttaagcctgtcgatttcttcatctacaaaaaggagacctatggctttgttacatatttcgaaatgccatgatcattaatgaagtaatatcttgaagacataccatttatgggaatatttctttttatgactcttgataaattttctgctttggaattcagccccttctgttgctagacagctttaattgtaggacagttattccttactttaagctaaagtctgtcatttgctaacttatctccattcattgctgttttatacgttgaaaccactctaagtttaattcttctactacattattagtacttaaatactttaaataaactccttagttcccctagaagatttgtaaagaatctgcccctaagcagtattcagtctaaaataaaatttgcctttttatttaggaaaacctactagaaaacctgttttgtttaggaaaacctgtttgagaacctaggggaattgtcattttcttacgtcagatcataatcactaaaacccttcaataaaattcagctacaagtagtgctttagaataaaatgacaattacacacatatatttggtcattattctgtgtttgcttaaacatagagcaaaatacggggccgacaaaacacagaagcattctgatagctgagctcatgcgcatttgtaagatgaattagactcacaggaaaggcctgttctggcagaaagatgactctaagtggggtggagggcaacagggagctggaggaggatctgctttacatttaaggttggaccgtgggttggatgagaatgtagagaaattttctttctagtgctattccatagtaaatgcttaatatatttatttgatcttttagtaggatgatactttgctttagtcttttgtctggggttggtgaacatacagaacctactattttgttactggtcatcttaaatcttcatgaaattcaatttgtttcatcaattcatatttttgaagtatgtgttatgggctatacattgtactgggcactgggattgttaaagtgaaataggcaaggtctccttgctgaggaagtttgtgttatagatgagtgaaaaataagaaaacaaggaagatgttttctccaacggtccagagagccaggccttcccatggaggtggatcacaaggcagaaaagggggtccctcgaggcttcgcaaagggaggctgaggctgactcttgaaggctgagtgagggatgggaagggcatccgtggcacaggacagagtacatgcaaaggcactgaggaaagaaaccacaaggcctatttagacaaccactagtggttggaagcagcttgaattaggaagcgcaagaggagcagtggtaggagataaatctagagaaggagcaaaaggccaaatcatatcaaccacatgcaaagccctttaaaagaaattgtattatgtactctccttgcttcctgttttcccttagactaattttctcatcttctactacaaaacttattctactgactgtcatttcctgatttattttcctccaggcactacttctaagcacttctccctgtatgcacacaaccctgtccttatcacccaacagcaggcctttcattttggcttggactcctggttatgggttcagtgaggccaggctatttaactatactgctgcttgtcagggggtttatgaaatccttaatcaggggtttatgtaaatcagtgtaagttaacttctaaaacctttataaaactgtttttatttttttaagactaaatcacaggtcaaaagtttaatcagtcaacacaactctaaactagctttaaaaaagaatatattcatcttactgaaaaatccaaatgtagatcattacctgtcattgctagctctggggctcaaaaaatgtgagcagaactttggctgtgactccctccttgtgttttggttcttctttatcatgtgctggctctattctcagctggctctgtctatgtggtggcctctggcagctccagattggtggtaccaatagagtcaggattctcagtgtagagagtgctcctcctcctcaacatttctacctgatgcttcggatttgagtcttattggcctggctgtgccatgtgtccattccaaataaaggatgaaacgcagataagcaaccacatgcctatatcgggagtgggatgggagctttgagggagccaaagttcaaaccacgtgtacaaaagtatggaaggaatggtttctcctcatcactaggatgtccttaccagaagaaggagaaaggagtgcttgtcagcaaaagcaaaatgtaactaacatgaagattttacagttgatcattcattcaatgatatttattgagtgtctgggatttcaaggtatcacgataaataaatgtggttatttactgtcttcaggatggtcagtcttcaagtaaaaaatgataggttaaggtatcatattaatcaacaagcaacacttatctttgaatccacattgtttaatctcatcttcagggttacaggaaattgtgaagactttgataaaatcattatgcattacagagactggaaatttcagacctgaaaaaatgtataaattaaatcatttttattgcattagaatgattgtattaaaaatgttttgaatactgtgccagggactatgaaaaaaagactgtgacatatttattagaggagagtcaatgggtgaaaaccaactgtttttgtattacttgagtagaaggttggaaaagccgagacttcagaagattttaaaaggataaaagaaatgaatttgacaatcttgggtgcagaaattatccataaaattatgcttaaccataaaaaggatggttaaggatgattgtaatcttcaggaagagagatgattgtaagtgaaaaataacacagacaagatacaagataagtaggccaggtgcagtggctcacccctgtaatcccagcactttgggaggctgaggcgggcagatcacgaggtcaggagatcaagaccatcgtggctaacatggtgaaaccccgtctctactaaaaaaatacaaaaaattagccaggcatggtggtgggcgcctgtagtcccagctactcaggaggctgaggcaagaaaatgacatgaacccgggaggcagagcttgcagtgagccaagattgtgccactgcactccagcctgggcgacagagcgagactccgtctcaaaaaaaaaaaaaaaaaaaagatacaagataagaaagaatacaagtcttccagatgataacaccttttaaaaagtcagcattccattgggattcttattggaatgtcaagacactcaccttaaatatactatagttctgaaggtgtcatgcacatctttgtaaccaacaatcctaaacaatgtggcatcttacatttacccagccctgtgtctccaggtccagtcaaacctccgggacgagtgccaaatctaagtgtctcactcaaggtcatgcattttactgtcttcttcttctttttttttttgtttgtgagacagagtctcactccgttgcccaggatggaatgcagtggcatgatctcggctcactgcaacctctgactcctgggttcaagcaattcttgcgcctccgcctccagagtagccaggtacaggtatgcgccaccacaactggctaatttttgtatttttagtagagatggggtttcatgatgttggccaggtttgtctcaaactcctgacttaagatgatctgcctgcctcagcctcccaaagtgctagggctacaggcgtgagccaccgcgcctggccaagtcttattcttttaatagtttaaataaaattctaacctgatctgataaaagcatatgtgacagcttggatttaaaccttccttttttgggaaggtgggtagtgggatttgaggctctgctagggagaaattaagaagaaaaatgcagaaatgtgctctggaatagtacaaatattctggttaagaatctcaatatgagaaacataacctactctctctgacttgaattgtttattagaaacaatccttttttcctcactgtttttttattaagttgacagaacagtatttaaaaaatatgtgaatagcctaacaaacagtgaatacagtgtacttaagttattagaaatttagaaggctttttacttatctttactaattctgtacctttcgcttccttcttacataaattattcagttttcaatgtttttgaaccttatatgaaaggaaccaaactgagcttttaattttcttcaatatgcttttaagttttgcttaacattatgttattgagatttatccttgctcttgcacataactgtattcccttcatttttatttgtgtagtattccattgtatgactacatcaccatttatggattcattctactgttgatggtgtgtgtgtgtgtttatagttattgaatccatgttttttggattgagtggaattgaagggtcatagatatgcatctcggtagataaatgccaaattattttgtgaggtgattttaactactgctagcagcagtgtagaagaatcccagttgcggctgggcgcagtggctcaccgccataatcccagcactttgggaggccaaggtgggccgatcacaagatcaggagttcgagaccagcctggccaatatgctgaaaccccgtctctactaaaagtacaaaaaaatttagccgggcatggtggcgcacacctgtaatcccagctactcaggaagctgaggcaggagagttgcttgaacctgggaggtggaggttgtgtgagttgagatcgtgccaaaaaagaatccctgttgctgcatgtcgtttcaactcttgataaccagatataaattatttttagcctcgtaaatttacaatggtaattgatagtgctttattttgtattaattgctcactaatgaagttgagtatctttttagttattaccctttcaagtttctgttcaaatctttgggccattttccattgggtttttttctcttttatttttagtatttctttatatattgaattaatcttcacgttttcataacttgcctgttgacgttcttctataagagtcttttgatgaatgaaagatcatgattataatgttcttaaagttatccatatttcctttattgtttgaacttcttgcattaagaaatcctttttgattccaatggtcacatataaagaatgtgacctattctttttatataggttttatagttttgctttattttacatttcccccaaacattttcacatcagtttctttggaactgactttgcattatgtgagagttgcatccctcctcctcaatgtgagtaacaagtattgtagaatcattttttttttaaaagcaccctttccacacggactggtagtgccatatttgccatacatctatattacatctatatgagtgagtatcttttttggagtgctctttattctgtaccttttgtctgttttctgttctgccagaagcatactgtatttactgctatagattcaaaatactttttgttgtctgctatggcatttctcattttattttcttcttcaacatatctattctgttttgggccatttgaaagtaagttgcagatactgtgacattttacccaagaatatcccagggtatgtaattatcacagtaatgaaattttatattgctataacactattatttactatatattctattttaaaatttcaacagttgttccaataatgtcttttatagcaacattatttccctgtttccagatccagtctagggtcacacattacatttagttgccacatctcattagtttcctttaatctggaacactttctcagtttttttgtcttttttttttttgagacggagtctcactctgttgcccaggctggagtgcagtggtgccatcctggctcactgcaacctctgcctcccgggttcaagtgattctcctgccccagcctcctgagtaactgggactacaggtactcgccaccacacccggctaattttttgtatttttagtagagatggggtttcactatgttggccaggatggtctcgatctcttgatctcgtgatccacccacctcggcctcccaaagtgctgggattacaggtgtgagccaccgcacctgaccttgtcttttataatagtgacatctctgaaagtacagcgcagttgttgctgtgaaatgcccttcaatgtggatacagttgcttttttttttgagatggaatctcactttgtcaccaggctggagtgcagtggtacagtaggcttactgcaacctctgcctcctgagttcaagcgattctcctgcctcagcctcccgagtagctgggactagaggcacgcgccaccacacccagctaatttttgtatttttagtagagacggggtttcaccatgttggccaggatggtctcgatctcctgaccttgcgatccacccgcctcagcctcccaaagtgctgggattacaggtgtgagccactgcgcctggcccagttgcatttttaatggaaatgttaggtaagttacatcattcccttctcagtgcataatatcaaaatgtcagtttctgttattattgaggcttttttttaccttgttacttttgtttacctggttaagatggtgtcatacataaagttttccattttttcctatacaattaataagtaatcattggaaagaaatgtttagactgtgtaaatgtcttgtaatttatcaaaattttatgtaataattttaacatccattgatgattcttgccaaaatcaactatttttcctatggtttctaatcaattctattttaactattatgtcattccttctacatttaacattgccaaaagtagatacaagttctaatttgctctttaacaaattttcttgatcatttagaaataacttttccttttcacttgtctccaggttttttatttcatactatataataaatttagctagtattttatatgtctttgttaattccaacatctgatctacttgggtctaattttctatttgttatttccttatatgttttattgtttttgactatggactcaattttttgggtactttatctgaggcaattctttgcctttctctgggcacttctggaaactccaaacaaatactactttacataaaattctttggtgagggtttataggccattaaggaagtgtgaatttgggttacaaaattctgtgaaggctggcttgtaggtaaggacttttaagggcaaattttttccttaccactcagcactgaaattcagcaggcactgtttttttgttgtgcttggcgtgaggaggtatgtgggtttatttgaaattcaccctttccctgaggctgtagctgttggatagtcagcttcatgtggtgggatcttctatgggattccttgcctttgaagggccctggctttatcttctgcccccagtcccccagaggccatgacaaatgaagctcaagttcaccagtgttgacatgcctcaggacaaaatctggctctagtgagtgactcatgtctctgaattcctgtttccacttaagttttggcctctggatatttcttaccatttttgttttccatttgatatatcttaaaataagcttttagtaatttaactagcctcctagttgtttttagagaaagagttctctgggtttttaaccgtcacactgttggaaatggagtcctccgtggtctctgtctttacattgagatccaggaaccactttgcctttaataaactcacgcaagggtgaacatattcacacataccagtggggtagatttgcatgtgtctgcttattcttctcgtagaataatgcgtaaggcccactagtttaatacttaatgaggttatttcaggcagttgtagtaaaaaaatacggagttccccttcctgtgtccatgtgtccggggcctgttgtcgggtggggggaggggggagggatagcattaggagatatatctaatgttaaatgacgagttaataggtgcagcataccagcatggcacatgtatacatatgtaactaacctgcacgttgtgcacatgtaccctaaaacttaaagtataataaaaaaaaatacggagtttcataggtggtttatttgatcacagataattttccaactttttggctgagttgatcaaacagtaaatacaatgtttggcagggaattaaatgggatcttatggtctaaacaaatttaaaggattattttatcttttcttctaaatatttgtttgaaataactctcatataataaataggcattccataaatattgaatgaatgagcaatgaatgaatgaacaaatgaacgactgttgttcaactgctcaaacccagtttagtgtacacaggatagcctgcgattggccatcattgaatgagtaaggtttatacctggcctcttccatgcttactagcttgcatagacctggtcatgggggaggggtggagaaggacgttttcagtgaaacattgtaaatgcttgcctcgcttcagcctgtaaattgaatttccagcataaatcctatcctaggcatcaacagtgcagtattatttggaaaggtacaattgatgaaaatataagagctgactatttatcaagctatctcgttctttttccaccaagaggtaaacagcctgtagcatttgctgtcattgaaatacatcgaattttcaaggactgcttcctaaattctggttattttatttggaaacattttgcctgaaattttggcagctgctgctctgagcagggtggactatgaggctagtcagagactggaacagaattataaggaccttaaactctcagagggaagcctcaacttgctctggattgtggcccaaagcaagacagaaagtttcctgggcaggatagatgattagaaaaaagtcctctgactgggcacagtggctcacgcctgtatatccagcattttgggaggccaaggcgggcaaatcacaaggttaggagatagagaccatcctggctaacatggtgaaaccccgtctctaataaaaatacaaaaattagctgggcatgcacctgtagtcccagctactcaaggagaatctcttggacccgggaggcagaggttgcagtgaccaagatcgtaccactgcactccagcctgggtgacagagcaagactccatcaaaaaaaaaaaaaaaagaaagaaagaaaaaagtcctctgattggtacccatgaggtaggtaccagtcataggaaaagcacaggactgagttttcaacacacaagcatggcttaagtctggctggatatagcacctgaatatgaattgaaaaataccttaggctataaatcaggtccatctaaggcacttcttaaagacgttgtaccttccacctcatctcccactcccctttgaacagaacagaacaatttgtagttctttatgttttgattctttgtacatctttaatggtaactaaagccttattaattcattaattcaaatatgtttgtacagtggccttttctaagggattcctcccatgtgatttgctagaaaggaacatagagagctgcaagaccaggtttcctacattctagaaaacaagtttcacagattatgaaaatctttattgttattcattccttcatttcagttataaataaaaatattattaccacctccctcccatacattacagccagtggctaggtgaagttatctatttgcaggctgcctgcactttatataatctctggaaagtcattccaactaaatagttcatattgagtttggtcaaaaaattgatgaaaaatttattattccaaagctatttcatttgttctttacctttgccagtgactaaacactgaaggggtaattatgtaaattttaactagctatttatgttcaaatatttttggttcagtaaccaagactgtaatctgctcagtacagaaaaccctatcagatgttgttttttgacatctggtttctgagcatgatggtgaagtgttcgtcaactgcaacagaacagaggtataaggagcctcactttttgtaatgatctggctctctgtcactatccactgatctggaacgtaagtatttgtgggtgactcatcaaatgtagagaagagctttgaatgtgagaatgtttaaattgcttgaaaatatcacctctaaagataaagtcttggcacaatttaaattcaagatacaacttaacatggttttgaatttcccaagagattcttgaattgttctcataggctgaaaaacatacagcagtaataagtgaccagataacatccatttcacttattccatttctttgataagaacagatattaatatttgatatagagaaagatcaccttcagcatttgcattgtctggtttaatttggtttggttgtttgaactacataacgccagattttctgtgttttctgagagagtacaggtataaatccgaaatttatagatgattcgtatatttggcaaaatgattaatcgagaacattttaaaccaaatcctgagatggagaagaaattctaagatataaaattatactcacagagaacaatgtgatctgaagaaattctaagatagaaaatcatacccacagagcacaatgtgaggtagcagcatcaactcaataaatctcaggtgtgtggagcaaataggttttgggaagatgacttatgtggattgtggacaagaaccaaaattttaacaacaaaaacaggttagcatgatttttcagtatttccagtgtcataacttgtgagggttagtatttatgaagagggcactgaatagtgataataatactgagagtaataataactattataattctagctacagcttttattcagaacttaggctgtactcactgcctgtagctataattcccaattgtaaatattattattatccattaaaaaatctttattttcctctgggatgcgatcctgtttgtgcagcttggttctttgttttgttttgtttattgttgttgttgttttgagacaggatctcactctgttgagtgcaatggcacagtcatagttcactgtaacctcgaactcctggcctcaagtgatcctcctcccttggcctcccgagttgctgagataataggcgcgagccactgtgcccagcctatcgcgtctgttttgcagttgaagaaactgaagttcagagataccatgtaacttattctactagtaataaataataaggtagctaagaataaagaatcgagatttcattggtgctttaaaaattagtaggttatggaatcaatgggcttaaaaaaaacatattccaggactagataacagagtaaaagtgggggaaacaattgtttgcttagatggcacactgtaaaggatggcattttggaaatagtgtcatggcatgcttcttatacatcaggtgggtgagtgggcaggagtaagatgtccaagcctgtcaatgatcaagaaacttctggcagctgactcttaactgctgtgtctcatttcttctgtgttgggctggaacagctttaaagtaacatattctggttgccccaggccactagtgggatggggtgggattaatgacaagaaaaggatagtgaaaaaatacaagatatgcttttatgaggtgacctcttctttctttcctaatgtttcctgcccctctatcctcccttgctcccatttgggcttctagtacaatctgacctacttgttttcaaacatgctgtttcttttgtttgtagcctgactgtctatcttgcaaactgcccccttttttaaagtcagttgaaatctgacttcagtggcaaagcttctcctgactccccattagggaaggcttcagtgctcaggctgatgtttacacagccctccactgaaacaatagtgttagaatattgtgattgtttgcttgtttctttgacttcccaccagattgtatacttacctaagacaaggagattttactttttttgtatctttgtgcttccagtgccttacacatggtactctataataaaaaatgtattgaagttcaataactgaataaatgaataaatcagtcatagtttggagagaatagtgtagtggcatagtaaggacatacgtaaagaaggcattcaggggactatttaaatatctacaagtgcagctcacaggagagaggtgggtgaggatgaaagacaagagcagctaagtgatattattgtgggaattgtcaacagactacacagctaagctgaagttatgaattgtacacactgctcagattataaaataggcaaaacagaaaaatgtaccggtgataacacaatccaactctctggatagctgctcagaattttagtgtgctaaaagcagaacatctgattaatattttacaatttcagctctcagaaggcaccggaaggagcaaggggaaggctgatcagggcctagcgttaacgtagtgctggcaggcatggtgtggaagagacagaaatcccgggaaggggagacttggctgtctttgcaataaacgagtacttttattgttctagccattaaaattatgcacatatttgtaaaaagtggaatgtaaagaaatgtagaaagagaaaaatatagccctaatctttgatccccattactgctaacatttgtggtatttcttcaaatctttaaaaataatgaatgtatgtataatacatgcatttttcacacatttgggatgtatttttccactttccactaattttcactaatttggtaatgtatttttaaaaattaatattattccaagagtctttttcccatattattttatttatttatttatttattttttgagacagagtttcgctcttgtcacccaggctggagtgcagtggcttgatctcagctcactgcaacctctgcctcccgggttcaagcgatgctcctccctcagcctcctgagtagctgggattacaggcgcccagcaccatgcctggctaattttttgtatttttagtagagatggggtttcaccatgttgctcaggctggtctcaaatgcctgacctcaggtgatccacccgtctcagcctcccaaagtgctgagattacaggcgtgagccaccgtgcccagccttccatattattttagattcctttataatatcactttcttagatgtataatattccatctatgtataaatcataactcggaaatacttatctattattgttagatgcttgttttcagtttttgctataataagtaatgctgcaatgaataactttattgaggatgtaactcatatcttttgtatatattttctggatggatttctagagtgaaatgattggtaagacttcatactttcactaatttctttccagaattacacttccactagtggattacagaagtgatattttcattttgtcatgtctcctatataaatatacgtatacacatatgtttgcatgtatatgtcttcgtttgttttctgttgctataacagaatacagactgggtaatctataaataatagaagtctatttggttcacagttctggagtctaggaggtccaagatcgaaagggcacatttggtgagggccttctgctgtgtcatagcatagtcgaaggcatccacatggtgagaaacagtgtgcaccagacaaagagaagaaattgggctgaactcattctttcattaggagcccactttcgagataactaacccatttccactataatggcattaatctatttatgagggtggagccctcatgacctaatcacctcttgaaggccccccacttctcaacactattagaatggcgattaaattccctccttctctccctccctccatccctcctttccttccttccttccttttttttccctctcttctcttctcctcccctcccctccctttcctttcctttttttttttttttttttgacagggtctcgctctgtcacccaggctggagtgcagtcgtgtgaccttggctcactttggctttgacttcctgggctcaagtgatccctccacttcagccttccaagtaactgggactacaggtgcgtgccacaatgcttggctaatttaaaaaaaaaaaaacttggtagaggcagagtctcattatgttgttcaggctggtcttgaactcttgggctcaagctatcctcccaccttggcctcccaaagtactgggattacaggcatgagccactgggcctggcctggcaattaagtttcacatgagttttgcaggggatattgaaaccatggccatatatgtacacgtgtatatataattgtaaatgtacgtccgacatatatgttttgatttgcattttcttgagtactaaagagcatctttgattgattagtgggtacaaatacacagtttgataagagaaataagacctagtgtttgatctatcactagggggattatagtttataattgccttagtccattctcacattactgtatataaatacctgagactgggtaatttataatgaaaagaggtttaattggctcacagttctgcagacagtacaggaagcatggcagcttctgcttctggggaggcctcgggaaacttccaatcatgtaaggagcaggcgtcttacatgtaagaagcaggggtgggggaggcgctacatacttttaagtgaccacatcttgtgagaactcactcgctatctctaggacagtatcaaggaggatggtgctaaaccattcatgagaaaccacctccatgttccaatcacctcccaccaggccctgcctccaacactggggattacaatttgacatgagattaggtggggaaacagatccaaaccatttcaataataatatgttgtatatttcaaaagagctagaagagaataaatcaaatgtttctagcataaagaatagacaaatatttaaggtaatggatatcccaattccactgattggatctttacaaattatatgaatgtattaaattatcacatgtatccaaaaatatgtacatctattatgtatcaataaaaaagagtttctttgactactaaagagtttaaagataactaagagtttagaatactttacggtcagcaaattgtccctttaagacctttgcccggttctttcctgtttagttcttatttatttttccttttcctgacgtataacactatcattttaacaacagagaggcaaaagacttgatcttgccttgaagttatcccgtccatgtagaatatttagaaatcaattaaaataattactgaagacttctaaagataacaaaagttatcttactcaaaatgtacagggaaatttttttttcttttgaaataattccaaatgcacagaaaagtgtcaacaaagttacagttatgttttctgcaccatttgattgttatgttactgctatgatgcaccaatcatttctgaatactttagcatggaattctgacaacaagaacattctcccaaccagtatgcaaccatgaaaatcaggaaattaacatcaatctaaaactgccatctaatcatcagactcctttcaattgtctccattcgtcttcaggatccagtcaaaggttatgtgtagcattggtttcatgactctttagtctctttcaatctggaacaattcctcagtctttccttaacttttatgattttgacacatttgcagataaattactctgtagaatatctcccagtttgggtttatctgatgtttccttttgattagattgagctcattcacctttgacaggagtatcatacaaataaggttgtgttcaccatgttatcgagtggcagtgattttaacatcccattactggtgatgttacctttaattaactgaggaaggtggtgtctgccagtctgctgggcttctctgctgtcaagtgataactcttccctttgtaattaataagttttttttttttttttttttggtgaggagtttcattgtgactctgtacacacctgtctgtaattttttttttttttttgtagaaacgggatcttgctctgctgcccaggctggtctcaaaactggcttcaagtgatcctcctgcttctgcctcccaaatcctccctcctgggattataggcatgaatcaccacacccaaccactgtaaacatctcaatcttaatcaaacttttactttattcattatttatattggtatgaaactcatgaatacctattttatacagtggattataatatgatactatgattgtttactttcatgctgaaattgtcccagatttggtcattggagactctttatgctggcttctgtgttcttttgacttgtcctcattattatttaagcccttccctttttctagcacacaaagttccaagttaatcttatacttttcctgtcccttttctggaattcgtcatttctccaaggagccctgttcacttttaatggagagtggcttttagaaaccaagatctaagctttaaacgtgttcattgctatctagatatagttgcttccaagccctttcagtgactaaagctagagtgtatatgtgtacgtacacacacacacacacacaaacgcacacacactgtcttctatatttatttatctctctatctctcttattaagattcaacgtggtggctcacgcctgtaatcccagcactttgggaggcagaggcgggcggatcacgaggtcaggagatggagaccatcctgctaacacggtgaaaccccgtctctaggaaaaatacaaaaaattagccgggcgtggtggcgggcgcctgtagtcccagctactcgggagactgaggcaggagaatggcgtgaacccgggaggcggagcttgcagtgagccgagatggcgccactgcactccaacctgggcgacagagcgagacttggtctcaaaaaaaaaaaaaaaaaaaaaaaaaaaaaaaagattcatggggccgggcgcagtggctcatgcctgtaatcccagcactctgggaggctgaggtgggtggatcacaaggtcaatagatggagaccatcctgaccaacatggtgaaaccccatctttactaaaaatacaaaaattagctgggcgtggtggcgcgtgcctgtactcccagctactctggaggccgacgcaggagaatagtttgaacccggaaggcagaggttgcagtgagccgagatcacgccactgtactctagcctggcgacagagcgagactccgccttggaaaaaaacaaaaaacaaaaaacagattcatgaattctcagtaatatccactattctaatcaaacactacagggtttttttcttctagttatttctctttctggatttgtaacttccttttctttctttctttctttttttttttttttttggagacagagtcctgttcattcgcccaggctggagtgcagtggcgcgatctccgctcactgcaagctccgcctcccaggttcacgcaattctcctgcctcagcctcccgagtagctgggaccacaggcacccgccaccacgccaggctaatttttttttttttttttttttttgtatttttagtagagatggggtttcaccatgttagccaggatggtcttgatctcctgacctcgtgaaccacccaccttggcctcccaaagtgctgggattacaggcatgagccaccgcgcctggcttgtaacttccttttctaacaatgaggactctggcctccattatcttcaaaaatatttatttattttctcaatcctcttatatgtaacccatctcctgtctctgctgccagcatcttcctcccagaaacactgctcatcctgcttgggctgtgacaccctggccagtgcttctgtcactgccacccacgatccgtcgcttgatggacaccctccttaacccactctagctcagttttcccacccaggcctctgctgctacttgccccatgtagatatcttttaaaccccactgaggcttggatgctccctggtggccaccctaccacatccatcccctgcaaggacaaaccctgaccccgcttggacacaggacaccagagccggagccactgctgttgcttccactcattctccctttgcttccatctgcatgaatgcctgccgtcctcagcccagcctagtttcctttggatagaattgctcaggaaggaaggggggcaggtaggaaggacagaagcagtggaatttctcaacatctgccttcttcacctttctctcacttccacatacctgacagcaactgaaatagaaaaagaaaatcaataaagcaactttcttctctcactttgtaaactacctgcacaactttttaccttttttctgtcagatctttatttggaaaatcgatttatattatctgaattctttatatttcttcaccttactttgcttctgcatataaagggaagaaacttcaggagatgacctagcaagtaagaatcctcagtccttacaagaaccagattggagtagtggctaatgtatatcttttatttctattatggtgaatttttctgaaattggtgtgactgctggagaaagagaaactaacaaagaggggagagagaaaaaggactcaagggcgtaggtggagaacgagaagaaaggaatatattggaaaacaaagcaagagagagtttgaagaaggaggatgtggtcaacagacataatgatccagagtagtcatgtaagataggaacaacaacaaataagcaaactggggttgttgtcaataagattgtctgttaagcatttatcaaatttcattcattgtttagtgctttatatactatccctacttaattctcacattaattttgtgaaattgtataattattattattcccatttacagattaggaagtggagacttacggaggctaagaattgtgcctaagatcacaccactggtatgagatcagatccagatttttcttcctctaaatttgaactatttcaccaccatgattcactattcattgcattgtgaggaacaaggaaagatttcaggagctagattgcacaagaagctgcttttgaagtactaagatcgccattatttattaagcagacattagataaccaattactaggcatgttatgaagggaattcttaaacaggaagggacacgtaaggttcttttggaacactataattgttgggtttggtggtcttcccaaagaagaggtaaactttcaagcttttctgttaaaagaaggtgccatattgccatttcagatctttttgttttgttttgttttagagacagagtcttgctctgtcacccaggctggagtgcagtggcgcaatcacctctactctgccgctttctttcccaattttccactaggaagcctccaggatgccactaaaaccatctataactttcagtccagcctatcgggtgggccctcaggaaatgggaacaatgtttatacttttcaacttctttcaggcctaaaactttgtcttaccttcagaaagaattgttttcagacatcttttttttttttttgagacggagtttcgctcttgttgcccaggctggagtgcaatggcacgatctcagctcaccacaaccttcgcctcccaggttcaagtgattctcctgcctcagcctcctgagtagctgggattacaggcacccatcagcaagcccagctaatttttttttttttttttttttttttggtatttttagtagagactgagtttcaccatgttgaccaggctggtcttgagttcctgaactcaagtgatccacccacctcagcctcccaaggtgctgggattaaagacatgaaccactgcgcccggccaagacatctcatattcctttaagtgatataatgcatatctctggctatcatatctgaaggtattttgtatttttatataaattatatctacacatggatttttaagtaagaggtacagatcatcaatattcagttagtggtttaaggggaatgtttaacattaatgcactactgatgctgggactataaatttctgaatgaggaaaaacaatccatatttatatttctagatacattttagtttaacctgtgttttactaaatttgcagaagattgtttcaagcatccttgcatatttctgtgctcataacctttataatttagataatggtgagtgatcagtgaccacacacttactaacacatgtagctgcaaagacctctgtcttcctgtaagtggcaatttatttggttaatttgaagcatattctgaattcattgctcatctactgactgtgggctctgttcagcacaggtcaagagagtaacataatacaaattataaaagacaattatggtactatccaaaccgatcaaatcaaggcagatagctaatttcgacttgcaagttcaactgatagtgtttatgtgatctgtcaaatacatttaaaagcaatccaagaatagtcgttcataatgtatagatagtaaattcttgagagcacagactgtacgttattcatctttttgtctgcagcaattcccacaaatcctggcataaagtaagtgctcagtgagtgtaggcatatacacgtttgtgatttggagtagtgacaaatctcaccttgtgactatcaacaattgtgtgttttgatttgtaatgtaaaatgaatctactaggagatttttccattgaatttgatttagtcatgtgtttaatgacttttagggaaatttagtaaaacatgtatcaatttattattttagtagagttattaaattttaatttttaatgatattaccaaatcacaatgtaaaaacactcttaagatggctaaaaaagccctggcgtcatggcttatgcctgtaatcccagcactttgggaggctgaggcaggcagatcacctgaggttgggggttgaagaccagcctgaccaacatggagaaagcctctctctactaaaaatacaaaaaaattagctgggtgtggtggcacatgcctgtaatcccagctactagggaggctgaggcaggagaatcgcttgaacccgggaggccgaggttgtggtgagccaagatcgtgccattgcactccagcctggaaaacaagagtgaaactccgtctcaaaaaaaaaaaaaaagtctaaaaacaaatctttctgaaggtaagacaaagttttaggcctgaaagaagttgaaaagtataaacattgttcccgtttcctggaggctcacacagtaggctaggctgaaggttatagatggttttagtggcatcctgggggcttcctagtggaaaattgggaagaaagggggagagtagaggcgggggccagagaagggacagggtgccaggagcaactgaatattatcttgttaatctcctctctctctctgtctcctccagtctcatgaaatgaaacacctacaccacatgagtttgtcatcctctcaactctatttggggagggattgggtgaggaggagcctggcatttctggggttctcaagcaaggagaagtacaggggcctctctccagtcagtgcagcccagttgttgtgcggatgaggcctggaggggctgagaacccgacaaagtgatctctgcctgagcgccaggcaccctggttacttctggcacaaagaagatatgatttatttgggaaaaggcgccacttacttgcccagctttggcccagaggggagtacttttattgctgtgtgaagagcatttgatagagagacaaaactaggcacaggaacctgggcctctcctgaagctctgattgagtgcccagggccctggagtttgagaccatgatgttttccttaaggtagccagccctaaacccaacagtgacctaagctgagtttgtcctggatatctgcccagcctcagttggccaacctttcccccaagaaaactcattgtttgaattctggaccgcagtccgccacagcaaaatccctttgaccctcaggg

SEQ ID NO: 29 - DNA, 395752 bp, Homo sapiens
ctgtagcaaactgggatatttatgacttctccttgcactagatcttcaataattggctctttcttgagaaaggacccatctgctctgtgatacagattttttttattattattatttacactgaggcaagcagggggcgatacatgaggtggtatgcagcttgtagcatgggggcttagagaaggcacagaatggccgggtgcactggctcatgcctgtaattccagcactttgggaggctgaggccggtgtatcacctgaggtcgggagttcaagactagcctggccaacatggtgaaaccccgtctctactaaaagtacaaaaattagccaggagtggtagcaggcgcctgtaatcccagctactcaggaggctgaggcaggagaatcgcctgaacccgggagatggaggttgcagtgagccgagatctcactactgcactccagcctgggtgacaagagtgagactttagtctcaaaaaaaagagatggcacagaattccatctcagaagtagaatgcagggaggggtgttccaagaactgggtgtaaaggtggtatgaacttctggtccacctggaaaaaaaaacagcagtgaatcatttgacatataaaagtcctgggccaggcgcggtggctcacacctgtgatccccgcactttgggaggctgaggcgggcggatcacctgaggtcgggagttcgagaccagcctggccaacacggtggaatcccatgtctactaaaaacacaaaaattaaccgggcgtggtggtgggcgtctgtaatcccagttactcaggaggctgaggcaggagaattgcttgaacccgggaggcggacgttgcagtgagccaagagcacatcattgcactccagcctgcacaacaagagtgaaactccgtcccaaaaaaatacataaataaaaataaatgtcctggctgcctggttgtgaattggttgttgccatcagacactacccatgtgcatgcctgctgcagggcactgagctgggagggggcatggatgcagatgtgcagcttgtggcctaagagggacttaccagccacaccaaatgccagtcccgcccgctgcagctccctagtctccacccagcacaccatatgctggaagtcagtctgcctgcaacctgcgtgcttccatgcctcactggctttggacttgctgaccctctgcctggactgactctctagcctcaaagtctcacctctgtgcagccctcgtggcccccgccccctctgcagagagtggctaaggggtaatgagacgatgcatatgagtgccaggtctggtgctggcataggtgactttcaggcatccgcagctatcacaatgtttatgttcctttgggccagccatactcccatgcacttcgctccctcactttggattttaactaattgtggttcacaggttaagttgcaagctgcctggcttaatgtccaactaggctgtgagtgcctggaggacgtgaatgtgagtcagctctgatttttttttcagggcctagcacaatgcctgtatgtttgtttcattcattcattcatccaataagtcattattgagctccttcttgttccaggcattgcttcaatgtcagggatatagcagcgaacaaaacaaactctgccatcttggagctgatcatctgtggggaagagctagacaatcaaccctaaagaagtcaccgtgagaggccgggcctggtggctaatgcctgtaatcctagcactttgagaggccaaggcaggcagattgcctgagctcaggagttcgagaccagcctgggcaacatggtgaaaccctgtctctactaaaaatacaaaaaaattagctaggcatggtggcacatgcctgtaatcccagctactcgggatgctgaggcaggagaattgcttgaacctgggaggcgcaggttgcagtgagccgagatcacaccactgcactccagcctgggcgacagagtgagactccgtctccaaaaaaaaaaaaaaaagtcactgtgaggctgggcgcagtggctcacacctgtaatcccagcacttgggaggccgaggtgggcagatcacccgaggtcaggagttcgagaccagcctggccaacatggcaaaactccgtctctactaaaaacacaaaaattagccgggcgtggtgatgcatgcgcctgtagtcccagctacttgggaggctgaggcaggagaatcacttgaactcaggaggcaaaggttgcagtgagccgagatcgtgccactgcactctgacctgggcaacagagcaagactccgtctcaaaaaaaaaaaaaggccaggcacggtggctcatgcctgtaatcccagcactttgggaggccgaggcaggcggatcacgaggtcaggaaattgagaccatcctggctaacatggtgaaaccccgtctctaataaaaatacaaaaaaattagccgggcgtggtggcggggcgggcacctgtagtcccagctacctgggaggctgaggcaggagaattgcttgaacctgggaggcggaggttgcagggagccgagatcgcaccactgcactccagcctgggcaacaagaatgaaactccatctcaaaaaaaaaaaaaaaaagtcaccatgagttggcgataagtacagtccaggaaggcaaagcaggtgggggcacaggggataccagaaggggagggggtgtggaagtgtttacagggaggactgggcagtctggctgaggaggtggcattgagcagaaacctcagaatttgggggggcaagatctgggggatacttggagctagaatgcttctggcagagagaaccagtgcaaaggcctcaggcagaaaatgttgtttcaggaagagtcagggggcgagggcagctggaaagtgttgggggtgggagagagtagcaagtgatgaggtcagacaaggcagtgaggggacagggcagggcacaggctatgggaggggttttgcttctgctcgagagatatttgctggatgaagggtttcacagggagagggttagagggtacccggctgtcctcttagggaggtaggacttgaagcacgccctaaaggaacagaaagctcaaaagagggggcagacatcccagggaggaggtcgctgtgcacacaggtgggaaaatgaaattgtagggattgtgcttgggggagtagtgaggagagacttgggcacaaaggctgtgtggagtccatggctgataagtccattaaaaaggtttggggtcagatcagcagggccttgaataacaggataaatggtttggctggagggacccacagcagcagggcctctgaaggcatcttagcagggtactgcattttaataatggcgctaacccctcaaaggaggatcaggcaggggagtccagcccaagctgggaggcagtgggagggccaagggagagacaggtggggttcagggtgcaccctcaacccagtctaaggagtgggaaggcaggtggctgggtgtccaggtcctgctgctcagccaagggatggaagcctggatcaagctttccccttccctgccagctagccatgggccccagagtcagcagaaaatcccggctccagggaggaggcggcgtggagccagaagctgctgagggagcactggcagcaagatgccattgtacatccgcaatcaagatgcttcagaggaaatcaaaagcaccaaccagggaaatgatgtgtgcactctctttctctcaaacacacatacaaacttctgcctccaaaatgggtcaagtgaaggctgtgggcgtgggttggggagggagggctgggagaagtgggggcctgggagcccgggagcaggctgggccctggtgcccactcaccctcctggcataggggatggcagcagctgcagggtggggcgggatgtgaggataaatatacacctcccatgcatatggatcatgctcacagctgccctgcttgcttagtgttcattaggaccaactgtttcaggagcagtggcaggcgggcgggagagggtgatgtacccattcacagactgggggtaggggggctgcctgcagctgtgcagatgcctcccccactgcctggatcagcatctcagcccctgaatgccccttcctcctgctttttcttcttccgacctgctgctatgccagatctggaggtctcagggcgggaaaggggcctggggcatgagtaaggatgaaatccaggctgcatccccataggagctggggagagtgagggaagagttgggctggattggatcccttggtccaggatgggctgttgtttacaaaccaaagcttcttatccccatcttcccagaagccatctgtagcattccagcaggaaaactgctttggcactgtcccctggagactcgagggaagccccattcctatgtgacaaccctagaccaggcttgctctgtgcctccaaagggaatccaagggggctgaggttggtggaccagcatcattctgcaggattctgacgtcctggcagcaaggagggctagggaaggagaatgctgggctccagcccgggaccaggtgctctaggtgggcctgggcctgggctggggaacagtgctgaaatgtaggcccagggaagggtctggctggtgtcacaggcagggccaagtgtagctgtacagcttgtgccctacccaagggaactggctgaggggcctgcagctggtgccacgccttgtactctggtgtggggcataatctcccacatgagtcagtggtggcctgggtgacaggcctctctagtgttaggaatgtggccaagagggcctgcctgtggacggagcccgtgtgtctcctatggtgagctctttctcctcctgctccagcggtcttggggggctcctagggctgtgcctccagggggctggcacaggggcttctgagtcctgggtggaagtggaggcagctgatcccaggccaaagccccaactacaacagcctccccaggccctttccttggttgtaagggtggggctgggcacctcctgccccctctactggtggcatccagagcagcagctgactctgggaccccagggcagggtcttctggatcctgaaaacagggtgagtggcaaaaagcgagggccgcctctcacctacctccctggggtggcatcatggaataaaatgggctttcagcaagtgggctggcgggaatcacagtcaagccatttcctagctgtgtgactctgggcaagtgacttaacctttgtgagccttggtttcatcatctgggaactagggacagtaaacggctatcttgtagggctaatcaaaggatgagacccactaatgactcaaaggagaagcagttggcttagctaaatgggattctgaccccaaccctgtacctctcagcttcaggtatccaagcaaattctccctgccccctcctggacacagcttgctttctgcagttctgtcattaatatttcatttctttagcaaaggctttttgtccctgggacactgctattcgctctggagaagaaactgttccgtgttccttcgtgcagaaggattccttagctccttttctgagagcagagcattaggagccaaaagcaaacaggtattgtggtataaatttgggacccagcagtgaaataggcctgagttcaaatcctgactgtgcccagttcttcctgtgcgatcatgggcgagtgattcaaattctatgagccccatcctcatactgtgaatgacaatacctacagttaacagtgtctttgcgaggattaaataaggtaactgtgaagtacctggtgcaagtggctacctccttaactctttcccccggttctgacactgtgggggactggttgttggctgcacttccacgcctgtgtgtggttggttctggacacacacacacaccagtgctggaccagcagaatgactgcagggagccagggctctctttctctcctccctgcccctgctcctggtggctgcagcttctctgtgttctgcagtgttggaaaaggaaattacagaacagattgcaattaagggggatgagggggagacagggacagaggccgtgagatgcagcttgactgagcactaaactgtgtttgcgcctggagccaatcaggagcctctgataagagcctttcccacttacaaagctaagcaggaggtgtggttggggtggccctgggagtcccgaagggagggggctgctggccttgaaagtcacagagccacatgggagggaaggtgggaggtagaggtcttaggggccttggaaagcctggactccagactttctgccagctgttatatttgctaccattgatttagcacctactactcactgtacggacatctcatctcatcctcttgacaactgtgcagcatgattattgcccaattttgaagataagaaactgagggccaggcacggtggctcacgcctataatcccagcactttgggaggccaaagcacgtggatcacctgaggtcaggagttcaagaccagcctagtcaatatggtgaaaccccatctctacgaaaaatacaaaaattagctggggatggtggcacatgcctgtaatcccagctattcgggaggctgaggcaggagaatcgcttgaacctggaaggtggaggttgcagtgagccgagatcgtgccactgaattccagtctgggcagaagagcgaaactccgtctccaaaaaaaaaaagaaaagaaaaagaaactgaggcatggaatgttccttctatgtgctaggtattgtcctagatctaggcactttgtttacatgagatctcttttaaatctccctgtgctgacctagtcaacatgaaaatgctgggattatgggcataagccaccgcacccagccacactttttaattgcactgcgctgtcccttttttgggcagggagtgctgggaagggttttgccagctttatcaaaacaaaaccaaaaagctaggatggccagttaaatttgaatttaaggtaaacaatgcatttttctaatgttatactgatgtcccaaatattgcatgggatatacttgaattaaaaactattcattgtttatctgaaattcaagtttaactgaatgttctgtaatgtatctggcaaccctaattcttctttctcctgcttccagctaccagctagttctgcccacagcttgctctttaaaggccgggcgcagtggcccacgcctgtaatcccagcactttgggaggccgaggtgggcagatcacgaggtcaggagattgagaccatcctggctaacacggtgaaaccccatctctactaaaaatacaaaaaaaccccaaaagttagccggcgtggtgacagacgcctgtagtcccagctactagggaggctgaggtgggagaatggcatgaacccgggaggcggagcttgcagtgagctgagattgcgccactgcactccagcctgggcgacagagcgagactgtctcaaaaaaaaaaaaaaaaaattagccagacatggtggtacatgcctctagtcccagccacttgggaggctgagttgggaggatggcctgagcccaggaggttgaggctgcagtgagttgtgactgtgccactgcactccagcctgggtgacagagcgaagtcctgtctcaaaaacacaaaacacacacacacacacacaaatggtgaggccctttgggaccagctgtgctgctgtgtctctagcctgctgaagggacaacgaactcttctgctccagagggcagagcccgggacagctgccaactctgcaccttccatgtaacactgggcaggtctgttccctctcggaaccctctgtaaatggaagatccagtattaggtactatgtaactgcaagtctccctgaaggccctaactttgctaattatttcttctccctttttcctgtctgttgggctggacttggccaaggatgaaacccagtctatggttgtgctgtgtgagcagaggacacccaacacctggggcagggaacccaggggagcagtgcttgtcagaggctgaggggaggaggctgggcagaagtagcactcagaggctgggggggctgaggctgctgggagatgagccattgacaaattttttttttttttttttttttgcaatggagttttctcctgttgcccaggctggagtgcaatggcacgatctcagctcactgcaacctctgactcctgggttcaagcaattctcctgcctcagcctcccaagcagctgggattacaggcacgtgccaccacgcccggctaattttgtatttttagtagagacgggatttcaccatgttggtcaggctcgtcttgaactcctgacttcaggagatctacctgccttggcctctgaaagtgctgggattacaggcgtgatccggccttgccattgactgtttttgttctccagaggcggcagcttgctgagcattgagacccaggctccaggccccacctgcacttaaaggctctgtgatttcaggcaaattccttaactggggcaaatgtctcaatgtcctctgctgcaaagggggactaatgctcaccacgatgtatctgaagtgcccggcacgtaggaggggcttaatgaagggctattattgctattgttggtatcctattttatatatatatccttctggaaaaaacctcttgaagaaagctaacccctgaaaggacaaacacatttcaggccctctctgagcttcagcaaagaacacaacacattccaggctgccttcgttccagctaaattttatttgtcggatttttgacagacgtctaaattatacattgagttttccacatgaccaaacaccacatctcttcctttgattatcattttcaaaagggattataaaaaaagaaccttttgatggatcagactgaaccctgaaaccacatggagtgcagagctaaaaataaaaggaagtaagaactggtccccgagaaggaaaggaaagggaaatcaaagcaaactctgacgggaatggagagacgagtcctggtgagggtgacatggtgtcaccctccaggccaggccggataaggagcggccaacagtgagggtggggcgcagagtggcacaaaaatagccactactttagtccagaggggaataaagaaatttgtcaaaagcaaggagagagaagtggagacggagggagggaggaaggaagggggcaggaccatgtcctcccagcagccgtgggagctgcggactcctttaaccctggcacatttctaaccgccggcataatcgctgactttcagctgtgcaccgacatgttccccagctcagcccacatcaatgacacccttgtttccatagtaaccaagggagagtgaaggggaaagggtgtgttgcactgggtgcagggaatccagccaaaagcagccacacggggtaggtcgggaggaggggaggactcgagtttttcccacaactggcttgagcacatatcacgagcaccccccaggccttgcctgccctccggcccccagccctctcccccgcacattcagatgcaattgtgcgcagggcaaaagtctcgctaagactcactggggacaggaggaggggaaaaggggtcttccctttccagcttcaaattctgtcttctggtcagggggcaggagtgggcagggaagaggcaagagggctttaaaaagtattttgtttttaaatgggagctttcaaactctgcctttttcaggcttctctcatctaccccagagccccaggagggttcaaaagggctcaaagggaagatgaaagcgtgtgacatctgcagtgtctctgtgtctctgcagctgagagcaaatcagaacatttacagaggccgttatcagaggagtggcttctgcctgctaggagaggccttgggatggctctttaaaacagtcccctaagttggtggtaaaagaacaaaaatattttacagaccctccaatgccaaagttccatactgcagtgttccaaaattgcagacctccaagcaggcattttgcccctcagataacttgtccctgctgaactattcggaagaaaaaacaatttgcaagtgctagagccacatttgcagcctggtagaagggggatttctgattccttataattctgtgttgcctctgtaagggagagcttgggtgagccagagaagccagtggaggaggctgcagagagcagctagctctgaggttaaaaaaacccctcactttcttttgttttgcaagtccttacaggtctgtccacagcaactctggggcaccttttcacggctggctttgttaatgactttcatgtcagatcgcttttgaagctggctatgcctcagtctctgctgcactcttagccagaagcagctgggtattgagggccaggggctgcagcggccccttcagtctgctcacacgccctgatgggcttgggaagggccacctcccaggatgagaaggcagctggcccccagggacccaccagtcactggacagtctcttattcattctctgaaaacccctgagctcaggcaccagaacagagtttaattcaggagccgggcaatgctctggcctgtttccccatgtttgaagctgaggatttctgaggttcagggaaacaagctcgttttgcaacgaggggcaggagaaatgttctgctattcctctccaatcaatcaacagaggacggacattctgctgcagagaggcagaggagcccagcagctggggtgactcttgattccttggacacgacccctgcagtcacacacacacccatgtcctccccagcagcaaaccctctccatccaggagcatcccacaccaccaagttgccagcactgtaaaaattgatctaaaaatcgatctgcctggcttttctcagtggagcaggttcatggtaaagctgcatttatttctaaaatctgatagcagcggcctattgtgatcgtttaaacacagaattctttgagctttagaaatcctgtctataggacggccgtggagaagccagctaatctcagagtcggctgctcactgctccactgagctggagaaagcctgtttacgctagcctgagccctcgatgtgagagctttttaaggaccttgtaatttttctggaattaaacctcccacctctccttacattccagatgtcattacagtcaaaagtcataagaatttgcttctctgtgtggctggctggggcagaggcaggggtgggtgggatggggtatgtttctgtagtgacttgtctgcaagaaagacttttttttttttttctgtccaaagagtgaggattacatacgtagtctccgacctgcaagacgatgagatggtttaattatctgccttttctccccccacccccacccagcagcttcctgtcggacagactgaagcctggctgggctagtgacggtaaaaatcactgacagcaccagcaaacactgtctgtggtttcaaaaccatggagggaatgcaagggacgggtcagtaaataaatgaactcagcaaagctgcttcttcctctttttctttttctttttttttttttgagaggaaaaaaaagcccactggaattgtctaaactgcaatgcaatctcttgctcatttaaaagatctcattttctaatcatgtgctttgagacatttaatactatttcaattatgcagaggaaataatataattcctttatttgaaaaatgatactgaacctcagagatcagttaaatctactgctggaatggggattctttctaaaccgtgttgttccctctcttcaaacagctggagctgtacacagatggaaaaacatttggtcagaaagcagcaaattagtgtttttcaggaccgaattcggctcccgcagctcctgcatctccattcgtctagattttatttcttctttgcattgacatttttgcagacccagttcatgccatcctttgagggaaatgggcagagaaaggcagtgttagttataagaaaagcaccacacactctagcctggaggggcgggcagtgggggtcccaggccctccctcccagaccgccagctttagggagtttgcttggctcaggggcccacctgggtgaccagggacagtgacctcccaggaggaggaggagggaggtctctgagagcacaagagggcgatgggagggggatgcccagcgcctgaacttgagatgggtcctcaggaactccctctgaaaaaataaacacatctgcctgcatccaaagcctgactgaagagctatcaggaaagattccagccatttttggctttttctaaaaggtgacctttgccagggcattaaattcaataagccacccttttggtgccccatgtgtttacagtgtgacagtgtacacttgggttaaattaaatttctttttggaaaaacaaacctactgcagtgagtgttgcgaggcacacaccagggcgatgtgcatttacttctcttcctgcagcactccagataggtttaaaagggtctggcccgcttcttatagctttaagcaccagcatccagagggactggggagaaggttcccttaaaggcacaatgaccttgaaagcgccctctcttagaaggctgaagagggaccaaggtaaaaatcacacaatgcctacagctacctggcaggcagcataattcctacggatgccaggcctgtcagaggtgaactccttcccaaccccctttggagccaaacctggacactctccccttccctagagtctccccaaccttcaagagtgtgtggagttccctcagaagccctgaacaaaatccaaggcagctgctgccatgagtccttccccttgcatctgtaacagaggctcacggaggtcccagctacatctgcacacatcagccatactggacatgccaccgagtcccacatttcctgtggccatggatctagctgccgaacctgaacagctgagacagcttacagtaataaatatcagctgacacccttggccattcggaacattaatcccataaacaatacatcactgcaaaaaaacaaccagcaggcatcctctctcctggctcatctgaccgtcacctgaatttacagtgattacaactctgccagttgctgtcagtgcacttgggcagcagaactagataatctgacggctgtcccagagccgacatctgacctttgccaagatgaggccggtggcgccgaaagcccgaaggtggacagcacctggcagcagcagggggaagggcagaggaatgccgaggtgggagaaatgaggactccaaacgcatctctaattacaatggggtcagctacttactctgagaagctaaggccaattttaagaccattttatgaaaaggattaatttaaagagaagcatgtttaattttagtagctaattggtttccaggaaaaaaaaaagatcacctgtcaagagacaaaaaagattttacaaataaaagagggatgaataagataagcatcttctctcgcctgggaagctgaatagctcagcacttacatagcactttccaccttcaggggctcacacaaacactcaaaggtgggcacctcaacactctctcctctacggaggctcgcactcaaaccatcttctcagagaaatcaaggacagtgtgcccacactatgtgaatagcgctttgccttttccttgctttatggctgattaaggagagattattgcatataactgaacatgaatgcaggcaaagagataggaaaaatatttactcagctgcaggagcccaaagcagaaggtggagggtgtggggtggttttatgccgggtctctgttatggaggcaaaggagggttcaaacggcagagccctgctgagggacagtgtctggtgtctccaggtgcctgtgagggccagcagtggtgaagcccttctagccactgtcctgccaacagagggcgcacagaggccagtccctgccagctgacccccggcctgggcccctgcagctgccgctgcaaccctgagtgtgggaagcacagggagcgtaaacaggggaccgagccctgtggctgccctgggcccgggaggcccctctaatctgaagcggctagtgcttggggagtggcatctttcttgtgctgggcagaagagaactgggctggaggtgggaggggagggaaggggaggcattggccaacaatggtacctcctcaatcacgtggccatggatctagctggggcaagctttgtcaatcacatcagggcaagctttgtcaagctgcctcctggaaaggaaaggcaatggtggtgcccaagctcccctaggggaggctcccatcagacttgctggagattatattcccagaacctaacatgatgtctagcccacagcccacttaattcacatcttttaagtcaatccttgtagaagcctgcaaagtaggtgctggtgttatttctctatcacagctgaggagatgaaggcacaggacagagcagggcaatggcaagctgtggtgcccagcgtggtgctccagagctgcttaccagttctccacggatgtgggtacctgccgggtgaagggttctgccccaagcttaaagaggagctgggaagcaccctgaagatgggaaaaggaggaattctggttttatcctccttgtgacttccgctaaaaacaggggcctgagactggagtagccccagccaagcctccctgcagctccgatagtgccagaggttgttatgggccattcagttctcaagattcctgggctgtgggtatctgtatatgcagaggcctggttatctgcctggctgcacaatcctcacatattaaccatccacccagaccacctcctccagtggaaatgctacatttagagaaaacatacttgcaagaggaggaaccttctgcttcttatgtttaaataaatgttccataccactcttgctttcacctggcaaggaaggctttttttttgagacggagtcttgctctgtcgcccaggctggagtgcagtggcatgatctcgactcgctgcaagctccgcctcatgccattctcctgcctcagcctcccaagtagctgggactacaggcgcccgccaccatgcccgactaatatttttgtatttttagtagagacagcgtttcaccatgttagccaggatggtctcgatctcctgatcttgtgatccacccacctcagtctcccaaagtgctgggattacaggcgtgagccactgcacctggccgaatctttattgttaaaaactggtttgaccaattttctgtacatttgatcttcattatggggatgacgatcttacggtatgaatagtcctcccttccttccttccctggaccctcccctgaccaatcttgctgaaactgaatttgaattgattagcttcaattcaataacagagactaaagagagacatggaatttcaaatactgagctttgtttggcctcctagagaggaaataaagtttcctatgtcacaatattattctcccctataaccactgggagaaacagcaggccacccctaagcatacaggggaaactcactcctcccaaatctctgcatcccagaagttaaggtgcactgcttctttccaagggaagagtggtctctgactatgctgctctcttaaatttgatctctgtacattgcatccatcactgctcggtagctggaaggaagcggtggcagccatggctgtgtgggcctggtttttagagccatgctggttacgtggtcacagcagtaattgctttaagatgatgaggtgctcggacccttgctgagcaatgcagcctacctcattgtgccatcaggcccccagggtcaagaagcagctggatgctgcttccatcaaatatggctcgctattagtagtttttttttctggtgacaaagggcattgcaccagaaaggtagtgaaatcgcatgtcctgagactgctttcttagtctccagaaaagtttgaaaatttaaaaataaacctgaggtctgactcacagataagcagttccatatacacctggagtcaacaataactgatgccaggcctagaaagaagtggtaaattttgtttttcaaaatatcaggccaggcgtggtggctcacgcctgtaatcccagcactttgggaggctgaggcaggcggatcacctgaggtcaggagttcgagaccagcctggccaacatggtgaaacctcgttgctactaaaaaaaatacaaaaaattagccaggcgtggtggtgggcatctgtaatcccagctactcgggaggctgaggcaggagaatcgcttgaacccaggaggtggaggttgcagtgagccaaggttgtgccatcgcattccagcctgggcaagaagagcgaaactccatctcaaaaaaaaaaaaaaaattaaaattctgtggcatattagggacaagtcccccaaatcaaggaaaaagaagcaaaaccaagaaatgggcgagtgagcatttagtgttcctctggaggctgactcaggcacggatcacagctcggcgctcggactgctcatggccccttttgtggacacaaggcaactgaaagcctatgtgacctgctcatggctcctgtctccaggaggaggagaggaacgtggggcagacatcacaagaaaaggtgagcatgagggggtggcctggagagcagcacccagggcacgatctgctggcttaaggttatgggaggaggcaagtctccgtggtgaccatggctagaggtcaggttaaaacttcggatctctgctttgagaggaaattcaaagccagtatcattttaattacacataccacacacacatgcacactcagagtattttagagagaaaatgtcttcaaatgcctggaactgtaacagcagaaagagctgtggtttggggttcaagttcaggtctgtgggtggaggagggatggatttctcgatacctttctctggctctaagccagatcctttgttcactattttctagacacccaaggagggaaaaaaaagactgagagtcccagtgcagaatgtttcatcctaggaggggccctggcaacctgggcctgacctcgagggcgcagagtgacacttcctccatgttgataatggagtctggcttcggttctccctcccagacatttttcagtttctcctctttccgctttcatccacttgacataactgggtctctcctcatcactcccctggacagtgggcctcttggcacaacagagtttctgagattgatgatctccttctgcttctcgtgccctttacctactctctgctcctgatggtctcccgtgaaaacctgctttaatcatacaatgggctggcttcccagtcagcaccaatgaggaaaagaaaccccggttccatcctctctcaaaagtcagtttccacacctgaagcagaggctggtgaacaacacgtggtacttcccacccctgtaatggcttcgtatgtgctgccttcaggacaccaggtggaacgggaccctgaaatccatcccaggaatcactaacttccatagtctcaaatcatgtgtttaagctactccactaatgagaagtgatgtacctgccctacttcatccacagaggggcgtggcttgccatctagcagctccatggctgtttccttaactcgcccccgtgaggctacctattgttaagcagtacaagacaggtctcttaaatatgttttgattaaacatgtacgatgtatgtgtctgtctttaaacacttgaaactgcaacagaaattccaggtcctttttttatttttaaacctttgtacattttctttcagagttgttagaatcagatgtcacctgacttgcctattcagtgcctaatcatttgggccagcttttggggaggtggggtggggtagggaggaaaaaaacaggaatttagggcatttcagtaattattgcacagttttcacgtttgaaagtgaacctcaaaccattcgatctttattgatatttttctagtaaagtctttcagttttagaatatttttagccctaataaataaaaattactaaaggcctgtacttcaactaagcaatgctggaaaggaattccacttaagtgactctttttaaggcaaaaaccaggaagctggtgtgtggacaagagcttgggtcagaggcaccaccttagggaggtacacggtcaaccagtggctcacagtgaaaagcgcttccacagcaaaactccatgacctttctctagtccccaaaggttaccacgaaaggacaatagacagcagattcccttcttaattaacatttttattaaataacccatttcaaataatggttaaattctctaaatttatatcattctattaaccataatctaatctcattaaccttgaaatcccagtcttaactacccaattctatacaccatggtactatctactaaactaattaagtgaccttcaaactatttctcctccatacaaaaatcattttttattttttgctcatagttttttgttggatctctcttgatatcatttcctgtgaacttggttgctgaaggccccaatctgggaagaactttcttatcaaaatcaaatcatatataataatctcactttactcactcaaactggtttattttgcagtgctcccctgcctgtccccaaccccaccctctagctgcctagtagcttgctgcctcttttgtggcctaaagatcccgtgaagggcactgtctacggtggttacacagccaggagcatggagttctatcctttaatctccacctgatgggagttgggggagggctgggggttgggaagaaaatgacaggagatccctctctacctccaggcttctctgaagcagtgtccttgactttaaatgccacggctctaaatactgattctagattactctagttctcctttttcacatcgctaaggctggtggaagatacaagaggcttactgttaattctcgctttgctttttcttcaacactctggtcaagcaaaagaaagattccagagctgtacttgcactttcttacgaatatgcacacaaactatattgcttttcttcagccccaccttcataatagcccccaacctcaagatgctctcagctttctctctctttttttctttttctgagacagagtctcactctttcacccaggctggagtgcagtagtgcaatctcagctcattgcaagctccgcctcctgggttcaggccattctcctgcctcagcctcccgtgtagctgggactacaggtgcccgccaccacacccggctaatttttttgtatttttagtagagacggggcttcactgtgttagccaggatggtctcgatctcctgacctcgtgatctgcctgcctcggcctcccaaagtgctgggattacaggtgtgagccaccacagccggctactctcagctttctaaatttgtcatctaaaccttttagacaggctcatgctgaagtggttttcagaaacacaagaaaattactatcttttcttgggtctcatcttcatcaaaataaccttaggccttatgactgccatcctatgtgcaatcggagtaaaatatgttagacaaattttgattgtttatttttatttatttatttattttgagagagagtcttgctctgtcgcccaggctggagtgcagtgatgcgatcttggctcactggaaccttcgcctcccagcttcaagcaattctgctgcctcagcctcccaagtagctgggattacaggtgtgcaccaccatgtccggctgattttttttgtatttttagtagagacgggggtttcaccatgttggccaggctggtctcgaacccctgacctcaggtgatccacccgcctcggcctcccaaagtgctgggattacaggcatgagccactgcacctggccttgatgttttaaaaagcagccagggccgggcagggtggctcatgcctgtaatcccagcactttgggaggctgacgcaggcagatcacttggggtcaggagttcaagaccagcctggtcaacatggcgaaatcccgtttctactaaaaatacaaaaaattagctgggtgtggtggtgaatgcctgtaatcccagctacttgcaaggctgaggcaggagaatcacttgaacctggaaggcggaggttgcagtgagccgagattgtgccactgcactccagcctgggcaatgagaatgaaactccgtctcaaaaaaaaaaaaaaaaaaaattagggggagcctgcttttccggtacacagttcctcagtacaaagcatggggctttctgtcagcagaagcctcccagtgggaaaccaacctgaagtagcaggaaacagacaccaaccctaggggtagggaagataaccaacagaagaaacaaaaacacttctaggatgactagtacgtgtatggttattggtggctatcaccttggaagtacaggcattttagcatccgtaatattagacacaacacaaaaccccaatccaatcaatcatcaaagaatcctagagttagagacaatcctcagtcttctgttctcacatccctcccaaaggggaagcttgctgcacatgtggggtggcttacctggggcactgttggggcacctcatgatatctgattggttgctaagcagaaaagaaccaaattcctccatgcccttcatatcttggaatggctcatctgcccatcaagatcagcccaaccaatgagacagaccacctcggttagctgtcatgttgccaggtggccaagccttcctgtaatctcacctgaacgccctctcctgtgagagctgagcaagactggatctgccagactcggtcgcggatggtatgcaggttcagtccttctgcaatttcagaggcaggggctgctgtgagcaaatcctgcttattagcaaagatgagcactggcacacaacttagtttttcttcctccagtaattccgctagttcctggattttgagaagggagagggagggaaggttaaaatctatacatctatgatatttaaccatacactacttttttttttttttttttgagacagagtctcactctgtcacccaggctggagtgcaatggcgtgatctcggctcactgcaaccttcgcttcccaggttcaagtgattctcctgcctcaacctcctgagtagctgggactacaggcatgcaccaccacactcagctaatttttgtatttttagtagagacagggttttgccacgttgggcaggctggtctagaactgcacacctcaggtgatccacccacctcggcctcccaaagtgctgggattacaggcgtgagctaccatgcccggacaaccatgcagttctaatcagaaaaaaaaataacagttaagctgatcaactagcaactttcaagagtagtgattctcaaacttttttttttctttctttttttttttttttgagacagggtctcgctctgtcgcccaggctggagtgcagtggcgcaatcccggctcactgcaacctttcacctcccaggttcaagcaattctcacccctcagcctcctgagtagctgggactgcaggtgcacactaccatgcccagctaatttctgtatttttagtagagatgggttttcaccatgttggtcaggctggtcttgaactcctggcctcaagtgatctgcccgccttggcctcccaaagtgctgggattacggtgtgagccgccgtgctcagtctgattatcaaacttgaacctgtataagattcccctggcagattcctgggcccaacccagagatgctgactttggaaagtctgagctagggctcaggaatttacttttttttttttttttttttttttttttgagacgagtcttgctctgttgcccaggctggagtgcagtggcgcgatctcggctcactgcaacctccgcctcccgggttcaagcaattctctgcctcagcctcccaagtggctgggattacaggcgcccaccaccatgcctcgctaattttttttgtatttttagtagagacggggtttcaccatcttggccaggctagtcttgaactcctgaccttgtgatccaccccccaccttggcctcccaaagtgctgggattacaggcgtgagccaccgcgcccggcataggaatccacatttttagcaaactcctgaagtgattccgctacagatgattcacagatcactttttttttttgagacaatatctcactctgtcatccaggctggagtgcagtggtgcgatcacagcttactgcaggctcaacctcctgggctcaagcaatgcttaacttagcctcctgatcagctagctgggacctcaggtgattgccaccatgcccagctaattaaaaaaaaattttttttggccaggcgcggtggctcacccatgtaatcccagcattttgggaggctgaggtgggcggagttcgagaccagtctgaccaatatggtgaaaccctgtctctattaaaaatacaaaaattagctgtgcatggtggtgggcacatgtagtcccaactacttgggaggctgagacaggagaattgcttgaacccaggaggcaaaggttgcagtgagctaagatcatgccactgcactccagccagggtgacagagtgagattctgcctggaaaaaaaaaatttttttttgtagagacagggttttgatatattgcccacgctggtcttgaactcctgggctcaagggatcctcctgcctcagcctaacaaagtgctagaattatagcgatgagccatcacacctggcccatagaacacttttgagaaaatcattcaagggagaagacaagaagtggtttgagattcaaaacttacccaaggttattacctgcaaataactttcaatgcgtgtgtgtgtgtgtatgtgtgtgtgtgtatgaaatttaaactgaaaatgacaattactttagagataattctgtttcatcaatctctatctctaaaacatgcatgcacatgcttcacatttcatcaaacctacatcctaaaataactttattggtccatctggcaaggtccctgatatttaggttataggttggggtctaaactatatgtgattttgtttacaaaaactataggaaagggtgtatatgtacttaaatgataggccccaccttttcctcattaaatccacattttagctacttaaaacacatgggctttcaaagagaactgtatggatcaagaggcagatgactacataggaccccctccacctccaagctcatttcacatgagtgataatccagaaatcatcagggtatggaagggtggtgggttgtttccagaagtctggagagttctcaactcaatttcaaaaaaagggacataaacatgagaactgctacctttggaaggccacctgtggtcatttaggacacaggccaaggactctgcaatgataactttttaaaaaacttttttttttttttttttttgagagggagtctcactctgtcacccaggctggagtgcagtgacacaatctcggctcagtgcaacctctgcagtgggttcaagtgattctcctgcctcagcctccagagtagctgggactgtacaggcacgtgccaccacacctggctaattttttgtgtttttagtagagacagggtttcactgtgttagccaggatggtcttgatctcctgactgcaagtgatctgcccacctcagcctcccaaagggctgggattacaggcgcgagccaccgcacccagcccttggcatgtgcattttttcctgtcctttcagatttgtcaaagttacccctgaatcaattaagtaggtattgaaaaatgtaaataaaaatgagaagtgacttgttcctctgggttcgttttcacatggcctgggaaaaaacctgaagagcctttgggcatggtgctaagttccacttgtctgtatctcatatattcaatttgattaaagctaaaaagctttaattagaaaactgtttaggctgggcatggaggctcacgcctgtaatcccagcactttgggaggctgaggtgggtggatcatctgaggtcaagagttcaagaccagcctggtcaacatggtgaaaccctgtctctactaaaaatacaaaaaaattagccgggcgtggtggcgcacgcctgtaatcccagctacttgggaggctgaggcaggagaatcacttgaacctgggaggttgaagttgcagtgagctgaaattgtgccattgcactccagcctgggtgacaagagtgaaactccgttttggaggggggaaaaaaaaactgtttaaagaactctcaactaatttcagacaactggtatttttgcctgcttgctagaataactgtcttgtttgaactgtaaaggttaacaaacaaaacaaaacaaaaacctccctcactctcacacatttacaaggttgattaatgaatacccagttatttgggaactatctcaacagaagaattagtatttaaaaaatatactaggctgggcgtggtggctcacgcctgtaatcccagcaccttgtgaggctgaggcgggaagatcacctgaggtcgggagttcaagaccagcctgaccaatgtggtgaaaccctctctctactaaaaatacaaaattagccaggcgtggtggtgcatgctaattccagctactcgggaggctgaggcaggagaattgcttgaacctgggaggcggaggttggggtgagccgagatcatgccattgcactctagcctgggcaacaagagcaaaaactccgtctcaaaaaaaaaaaagtacatacatatatatatataagaactttgatataaaaaagaattatttacctgacccgtctcttcaaatctttttctgtctgcactgtcgattacatatatctataaaggaaaagaagaaggttatttcagtgagcagagatggaaaagacagggcaatttctgcaaaaggagcaggtgatccccaatcagcatattccaattagcacaacatacagaaattgactggtgagtctcatctcatttatgaaggccaaacaaacaaatacacaaattaattaaatagggatgcccagaaaataccttcagcaatgctccaaagtctaggatttaggaaaaccaagtgggataaaatagctacatttaatgggcacttgatgttgtcactaaacattactaggtctactctattaaccctcattacaactctacaatatagatttcactattttcctttttttttttttttttttgagacagagtcttgctctgctctgtcacccaggctggagtgcagtggcatgatttcggctctgggttcaccccattctcctgcctcagcctccccagcagctgggactacaggcacacgccaccatgcccagctaatttttttgtagttttagtagagacggcgtttcaccatgtcggccaggctggtctcgaactcctgacctcaagtgatccacctgcctcagcctcctaaagtgctgggattacaagcatgagctactgtggctggcctactttgtttaaattatgttaagtttaaacacaaagctgatattaataataatacagtaaatgattagtagtaacatgaatatatcttgaaaagacatttatatctgtcaaaaggctgttattatttctcggcctaaagagaaatggaagataccctatcccctcccttccatcacacttcaagttttatttcttagacaaaccctcaaattaataaagctcatgtcagatgttctcaatgtcgtcttccctaagaataactctggtacttctaggagttactcttagtctttcaaacctcttttttttttttttttttgagatggggtcttgctatgttacccaggctggtctcagactcctgggctcaagggatcctcccacctcagcctcctgagtagttgagattacaggcatgcaccaccagacacagtttagagaaccatttaatttaatactccaaagcaagggtaggcaaactttttctgtaagaggtcagcagtcaatattttagcctctgtggcccatacaatctctctttttctttttattatactttaagttttagggtacatgtgcacactgtgcaggttagttacatgtgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgacagtttactgagaatgatgatttccatacaatctctttcacaactcttgaacgctcctgttattgttagaaggcaaccacagaaaatctgtaaacaaatgtatgtggctatgttccaagtaacttcatggacactgaaatgtgaatttcatataattttcacatgttgtgaaacattattcttttggcgtttttctccccaaccacttagaaatgtaaaaaccactcctagcttgaaggctgtacaaaaactggaggcagcctggatcaatttgtcgacctgctctataaagcaagatttgattacggtactctagagataatgggaaagaatgaaccaggcaactcttgtgtcaagcctcaagcctgctcttctaggcagtgtggagtctagcgtaataagtctttttcaaccaacaatggaagactattaaacatagacaaatataacccatccaccaccttcactctaagctgctacaaaactggcagacagggctgtgagtcacaaggccttagaatctaatcccagggactcagttcctccctcatacttgtttaatctcaaacagcactggaaaataatgaaaggttgactctcaatccaaactattatcttgtactagtgtcgagtacaaggatgcagctggaggaagcttctctagtgttgctgtgaaccgatttttgctggattgtacgttaattcccaggtactctcagatcatgtgaatgtggaatccagggttacattatattacaaccaacttgcagtctgccctcaagctgttagagcttatgatttaaaattacccttacctggagaccagaaagtttctgagacctccttatggagacttacaatcattaatgtctttatatacttctcttccttgggtatttctttcaagataccttaatccagcagatgaacagataggaatgtaatttctctcagccacctgctttttcctaactcatgattgaaagaggaaaaaggagtctatagcttttgaaacatgtatacacttttgtttttttgttgagacggagtctcgctctgtcacccaggctggagtgcagtagtgtgatctcggctcactgcaacctctgcctcctgggttcaagcgatactcctgcctcagcttctcgaggagctgggattacaggcatgtgccaccacacctggctaatttttatatttttagcagagatggggtttcgccatgctggccaggctggcctcgaactcctgacctcaggtgatccacccacctcagcctcccaaagtgctgggattacaggtgtgagccctccgtgtcttttttcttttttttgagacagagtctcgctctgtcacccaggctggagtgcagtggcgcgatcttggctcactgcaagctccatcttctgggttcatgccattctcctgcctcagcctccctagtaggctgggactacaggcgcccgccggcacgcccagcttttagtagagacagggtttcaccgtgttagccaggatggtctcgatctcctgacctcgtgatctgcccgccttggcctcccaaactgctgggattacaggcatgagccaccgcacccggcccctctgtgtcttttcatgacttgatagctcatgtatttttatcattgaacaatattctactatacgggtgtaccacagtttgtttatctattaacctattgaaggacatcttggatgcttccaggttttggcaattaggaataaagatgccataaacattcctatgcagaattttgtgtggaatatcaatttccaactaactgggtatatatcttggagtactgctggactgtatgctaagactatgtttagctttgtaagaaactaccaactgtcttccaaagtgggtgtactattttgtatttccaccagcaatgaagaggagtcccattgctctacatccgtatcagcatttggtattgtcagttttttttttattttagccagtctagtaggtattaatatgtagtaccatattattgctgttttaatttgtaaatccataatgacatataatactgaacattttttatatgcttatctgtttctttgatgaggtgtctgttcagatcttttgcccatttgtaaaaccaagttgtttgcttattcttgagttttgagttatttgtatattttagatataactactttaacatatatgtgttttgcaaatattttctcccagtctgtggtttgtatttttattctcttagcagtctcttttgcagagcagaagttttattttatttatttttttgagatagagtctcactctgtcacccagactggagtgcagtagtgatcacagctcactgcagactcaacctcctgggctcaagtgatccttccacctcagtctcccgagtagctgggactacaggtccacatcaccatgactggctaatttttttttattttttgtagagacagggtcacagtatattgtgcaagctggtcttgaacttctggactcgaagcatcctcccacctcggcctcccaaagggctgagattacagacatgagccaccaaatccagcttccagaagttttatttttatttattttttttgagatggattcttgctctgtcgcccaggctggagtgcagtggtgtgatctcggctcactgcaagctctgcctcccacgttcacgccattctcctgcctcagcctcctgagtagctgggactacaggcgcctgccaccgcgcccggctaattttttttgtattttttgtagagatggggtttcaccgtgttagccaggatggtctcgatctcctgacctcgtgatcctcccgccttggcctcccaaagtgctgggattacaggcatgagccaccgcgcccggctgcttccagaagttttaaattcatttaagtccaatttatttctttcatggattatgctttttgtgtatctaaaacctcatcaccaaactcaaggtcacctagatgttctcctatgttgtcttctaggagttttatagtgtttgggttttacatttaggtttaagatccattttgtcaagggctctaggtcgaaggaaaaaagaatctattttaacattttaagttaaggggtaaggatgggtctagattcttttttttttgcatgtcgatgtcccattattccagcgccacttgctgaaaagattatccttcctcccttgaactgtcatgttcttttgtcagagagagtgggccatattcatgtaagcctattttggggctctctattctgttctgttgatcaatttgtctactctttctctaatgtatgctgtcttcttttttttttgagacggagtttcacacttgttgcccaggctggagtgcaatggtgcaatctcggctcactgcaacctctgcctcctgggttcaagcgattctcctgtcttagcctcccgagcagctgggattacaggtgcctgccactacacccggctaatttttgtatttttaatacagatggggtttcaccccattggccaggctgctcttgaactcctgacctcaggtgatctgcctgcctcagcctcccaaagtgttgggagtgcgggcgtgagccactgcgcccggcctatgctgtcttgtttacttgctttacagagaatcttgatgtcaggtagtgtcagtcctctaacttgttccttttcagtactatgttagccatctaaatcttttgcttttccatataaacattagaatcagtttgtcaatatccccaaagtaacttgctgtgattttgattgggattctattaaatctataaatcaagttgggtataactgacatcttaataatactgagttttcctatccatgagcacggactgtctctttatttacctagatcttctttatgagttttgcaggtttcttcaagtaggtcctgaatgtattttgttagatttatgcctaagtgtttcattttgggggtgctaaatggtattttgctattaatttcaaatttcaattgttcactgctgatataaaggaaagcaaccgacttgtacatattaaccttatatcctgcagccttggtatgatcacttattagttctaagtgtttccttgttgatttaaaattttttttttgtttttgagacttgttttttgttttgagactcttgttgccctggctggaatgcaatgccatgatcttggctcaccgcaacctccaccttccgggtttaagcgattttccacctgagtagcttacgggcatgtgccgccacgcccagctaattttgtatttttagtagagacggggtttctccatgttggtcaagctggtctcgaactcctgaccttaagtgatccacttgcctcggcctcccaaagtgctgggattacaggaatgagccatcgcaccaggcctgatttaaaatatttttaattatttttatttttttgtttttttctgaattaaaagaattttatcttacctcaccttatcttatctcatcttatcttagagagagtctcactcttgttgcccaggctggagtgaccaccatgcccggccttattttattttttattcagacagagtctcactctgtcacccaggctggagtgcagtggtgcaatcttggctcactgcaagctccgcctcccaggttcatgccattctcctgcctcagcctcccgagcagctaggactacaggcgcccgccaccatgcccggctatttttttgtattttttagtagagacggggtttcaccgtgttagccaggatggtctcgatctcctgacctcgtgatccacccacctcggcctcccaaagtgctgggattacaagcgttagccacagagcctggccaacattttttttttttttttgagacggagtcttggtctgtcgccaaagctggagagcagtggcgcaatcttggctcactgcaacctgcacctccctgattcaagcaattctctgcctcagcctcccaaatagctgggattacaggcgcccaccaccacgcctggctaattttttgtatttttagtagagatggggtttcaccatcttggccaggctggtcttgaactcctgaccttgtgatccacccgcctcagcctcccaaagtgctgggattacaggcgtgagccaccgcacccggccaacagttttttaaaatgcaaaaattcctgtcctcacggagcttaccttacagtgcaagagaaagctaataaataaaaatacgtctgatggcaataggtacaaagaatctgctgatagatcagatgaggggagtgaggagagggagccaaggatgattgcattgtttccggaggaatgggactcccatttactgagaagactgtgggaagagtagggttgagtagaacaggatgaaaacaggaatttggttttagacatgttgaggctgagggacttaccagccgctgaagtggagatgtcaaataggcagctggcttatatagtcatgtgttgcttaatgacaggggcatgttctgagaaatgcattattaggcaattctgacatggtgccaacatcatacagtgtacttacacacacctagatggtctactgcacacctaggctgtatggcatagcctattgccccaggctacaaacctgtacacgaagttactgtatcgaatactgcaggcaactgtaaaacaatggtaagtatttatggatctaaacatataaaaggtaatgtgttatgacagctatgtcactaggtaatataaatttttcagctttattataatttttttttttttttgagaaagagagtctcgctgtgttgcccaggctggagtgcagtggcgcaatcttggctcaccgcaatctccacctcctgggttcaagcaattctcttcctcagcctcctgagtagctgggattacaggcatccaccaccatgcccagctaattttcatatttttagtagagatgcagtttcaccatcttggccaggctagtcttgaattcctgacctcgtgatccacctgccttggcctcccaaagtgctgggattacaggcgtgagccgctgcgcccggcagctctattataatcttaagggaccactatcatttatgaggtcagtcactgacccaagtgtcattatgtggcacatgactgtatatgaaactcaagttcaggggagaattccaggctagagatgatagtttgagattcataagcatctaagtggtcattaaatccttcaaattagacgaggtcacctaagcagtgactcagagaagaaaaacacaaggactccggggctctctaacatttggaggttgggagattaaaaaaaaatagcaatggagatttaggaggagtagccagtgaggaggaaaaccaagatagaatggtgtcttggaagccaagaaaagacaatgtttcaaagagagcatgaccaatgttaaatggcctgataggtcaagtgagatgagtactgaaaactgaaccctacttttagcaatgtggaattatcagtgaccctgaaaagaaggctcaagagtaactaggaggagataaagcaaagacagagagcataacaaactctttcaaggagttttgctataaagggaggctgaggaatgggacagtattggagggggatgtatggtcaggaggagttttctggggcttattttttcttcattaagcaagagaagctacaggatatgtttatgttgatgggaatgatccagaggagagagacacttaggaaacaacagcagaaggtgaagctgtttgagatgcaagatgatttctttttttttttcttgtcttgagacagagtatcactctgtcttccaggctggagtgtggtggcctgatctcaatctgggctcactgcaacctccgcctcctgggctcaagcgatcctcccacctcagccaccccaaactgctgagattacaggcatgagccaccacacctggtctagatgatttctattcgtaataaagacatagatatggctgctattattgcagtttattgcctttcatcataattgatgtaaacgcaaacttttggttagaggttagtaaaagcgacatgcaatttttctcccatctaagttcatgagcccccctagttttagggtatgattatgcaagtatgtggctgaggtagagtagatgacaagaccattgaaggagggctggtgaaggaactgagaggctgaggttttgtggaaatcatgtaagtggacagtgaaatctccaagaattctgaaactgtgatggtcctaaaggaagtgacagcgagctgggagctaaaatctcggcctccacttgaatgaacgctccctgagtcagggtattcccaatgcacgaggcagcttctcctactactggacgattgtaattataggaaacttcttccttaatctgaattacattctaccacctaacattccccatcttgctcttggctcagccctctagaactattcaatccctctgacttaagataattcttgaagcagcctagacagttcccagtgttctcttttccaggaataacattctcaggtctttcaaccactccttacacatcatggtttccagtactttcactattttgcttgctctctttgcaatacacttgattcgttgtcttcctaggggtgacagtcagtggcatgatcttctgacttcccttctgctattcaaatcactatggcaattaataacactttattttgccaagatgggtgtgggtacaacattgttactgagcgacagcaaaacatcttatacaagttatacaaagatgtttttcctttataatctgtagccttctgctatccctgctaaattcacagtgattaatgttatggtggtggaattactgacaagaaagaatgttacagtgtccatgtttctaacacatggcagaaaatactatgaattagtgcgtcagaaggagtacttacaagaatatcggtattttcaaaataattcttccagtatggtctgattttcctctgtccaccaatgtcccatacattcagtttaaaaccttgtgattgtacacttttgatgttgaaaccctgaaacagggacaaaaacatcaagttttattaaactttgggatcataattctgacaaagttacatttaatagctatgttttttattaattctaaagtactctgccatatgtgatactggtaatgctgaaaatgatttgttgtgacagagaatacagaaacatatttatacatgcttgtttcatccaggttgtggagtcagtgttaataatgtcaggctaacacaatgtttttctacaatgaacatatatacatatataattactgaggataactccaaatgagaatagctctaattaaccaacacacatcacatgcccatgaatcttcaggatggtaaaatttaacaggacatttcatgtaactaacaacaaaaaaaaagctgaatctgaagactcaacaggaaagaacacaagctaaatttaaagaggcaaaagctacaaatctagaggattagattcttcaagagcagctcaaaataaatttcctacagggattaatcaggaaaaagagcagaactgaggatgctatgggggaggctgggtttgtaactcgaatatatcagcccagtagggaggtggagccctcagttgcagacactgatggaaacaaacaagtggtcagttaaaattgtgctttcaggctgggtgcgtagctcacgcctgtaatcccagcactctgggaggccgaggcggatggatcaggaggtcaggagttcgagatcagcctggtcaatatggtgaaacaccgtctctactaaaaatacaaaaattagccaggcgtgttggcgcatgcctggagtcccagctactcaggatgccgaggcaagagaatcacttgaaccctggaggcagaggttgcagtgagctgagatcatgccactgcactctggcctgggcgacagagtgagattccatctcaaaaaaaaaaaaagtgctttcatagggaactatgatgaacttgaacttgaaaaggaagtcttcattttttttttgagacagagtctcgctctgttgcccagactggagtgcagtggcatggtcttggctcactgcaacctccgcctcccaagttcgagtgattctcctgcctcagcctcccgagtagctggaattacaggcgcctgccaccacacccggctaattttttgtatttttagtagagacagggtttcaccatattggtcaggctggtctcaaactcctgacctcatgatccgcccaccttggccttccaaagcactgggattacaggcatgcgccactgtgcccagccggaagtcttttttttttttttttttttgcagagttgtgctctcggctcaccgcaacctccacctcccggattcaagcgattatcctgcctcagcctcccgagtagctgggattacaggcatgcgccaccatgcctggctaattttgtatttttagtagagatggggtttctccatgttggtcaggctggtcttgaactcccgacctcaggtgatccgcccgcctcagcctcccaaagtgctgggattacaggtgtgagccactgcaccgggctggaagtcttcatttttaagacagttacttgaggtgaaactttgaggaaggtgagcaaatcagggacaggcagaattgccaggtgggggtcagtgtggaaagaaacaaattaacaagccctttggggttcccagagaatgtattgcatgaacaagaattttttttaaagtcttcttgcaaaaattacatagggaaaccaggatttgaaaaacccagtcaacagcttgctaccacagaagagacatttcatccagaataactggagttagatagctttggggatgcctccacaaacatttgtttcatgtggtagcctgtcaacactgctgcctggcacagaaggagaaggcacagtgcaataggacaggaatattgccacccaatttccactgcggatacacagtctctggaggataactggggatcctgctgactctcacttctctaacacgccaatgactgaatacattagaagttcgagaattctaaagggaaatggcttaagcttattgaaaaaagtttcattgtgactcactggcaaaactactttagtgtatttaaaaattccacactcaacaatgatattaaatgtcaaactcagtaatactgaatcctttctggaataaagcagaaaataaataacagtaaatcttggaatacaagtaacagtgaatcttggaatttgaccatatgtatcaatgggcttaaacagctataagtcatgagacccaacaaatctaggaatttattctgaggaaataataatgatgaatgggcaaaaacatttagagatgtatattacataagtatttacatatataataacatagaaagatgttcatgatctattattaagtgaacaagaggagacaggttcagtggctcacacccataatcccaattttgggagactgaggcgggaggactgcttgagcccaggagttcaaggccagcctgggcaatgtagtgagaccccatctctaccaaaaaaaaaaaaaaaaaaaaattagctgggtgtggtggcacatgcctgcagtcctaactactcaggagcctgaggtgggaagattgcttgaacccaggaatttgaggctgcagtgagctatggatggtgccactgtactccagcctggccgacagagtgaaaccccgtctctaaaaaaaatctatatctagatatagatgatacaagctagtatatcctctatgagccatttttattttttattttaaatatacccatcatatatatgcatagaaaaaaacttgatacattcctaaatgtgaacagtggtatgtctgactgggcattataggtgacttttagtttctcaattgtatttatttatacttcctaaatttactacaatgagcatttattactttttctaatataaaacaaaaaacataataaaagtttgtttttaaagaatatgaaaccttgacacaatataatatcagagttacctataacacatcaaacaaagcctgaaggttagaatgagaactttgggttcctaactttgagtttatttctgtgtttgcagtgtggaagtcttcacgttagtgttcttgagagacacagtttattgctaatactaaaaaaacaaaaacaaaaacaaaaaaaccccacaagcgcatgcacacaaaaactagtgcttctttttctggcagaaatcttgacacactaatatgtgttttcagcccttctaggctagattactgtaatttgcttgggctatacattaaatttgttcagaagctgtaaaaattgttcatttggtagcagttgaaatgacttttccataaagagttgtgaatcagtaagactcatgggccgtgaagtatgcatgcacaccagcacagccattcaaacctgacaccagggtcttatcacggtacagtgatggaaaataactctggttttgctaaaacctctaacctttaatgctcaaacactttaaagtgactaagaccaacaagctctccctgttggcttagccaaaggtcaggcattcttaggatttcctacagggaatgagttctaagaaacccactacagtttttccaatcaggtcttgtcttttttttttttttttttttttgagacggagtctcactctgtcgccaggctggagtgcaatggcacaatctcagctcactgtaatctccgcctcccaagttcaagccattctcctgcctcagtctcctgagtagctgggataacaggtgcacaccaccacatccagctaatttttgtatttttagtagagacaggatttcaccatgttgtccaggatggtctccatgtcctgacctcatgatccacccacctcggcctcccaaagtgctgggattacaggcatgagccatggtgcccaggacttgtcttttttttttttttttttttttttttttttttttttgtgatggagtctcgctctgtcgcccaggctggagtgcagtggcatgatctcggctcactgcaagctccacctcctgggttcacgccattctcctgcctcagcctcccaagtagctgggactacaggtgcccactgccacgcccagccaattttttgtatttttagtagagacggggtttcaccatgttagccaggatggtctcgatctcctgaccttgtgatccgcccacctcggcctcccaaagtgctgggattatgggcatgagccaccacgcccggcccaggactcatctttaaacctccacgctgtgagcactatcattcccttatcctttatgctttgcttgcttgcccttttcaggaaagaggaaggttgatgagactggatttaaaaaggcaggtaattggccgggcaaggtggttcacgcctgtaatcctagcactttgggaggccgaggcaggtggactgcctgagctcaggagttcgagaccagcctgggcaacaacggtgaaaccctgtctctactaaaatacaacaaattagccaggcgtggtggcgtgcacctgtagtcccagctacttgggaggctgaggcaggagaatcacttgaacccaggaggcgcaggttgcagtgagctgagattgcactgctgcattccagcctgggaaacagaacgagactctgtctccaaaaaaaaaaaaaaaaaaaaaaaggcaggtaatttttttttcttttaaaaattgatacatatttgtatttattaagtctgaaaagtacacggtaaaatattaaccatggtttttctcagagttttctcctttatactttctctgtgttttctacatgcactactttcataatcagagaagataaagctattttttaaaaaagaataggctgggtgtggtggctcacacctgtaatcccagcactttgggaggctggggtgggtggatcattgaggtctggagtttgagaccagcctggccaacatggcaaaaccctggctctacaaaaaaatacaaaaattagcgggccatggcggtgtgcgcctgtaatcccagctactagggaggctgaggtccaagaatcgcttgaacctgggaggcggaggttgcagtgagccaagattgcactaccacacttcagcctgtgtgacaaagcaagactgtgtctcaaaaaataaataatttaaagaaataaaataaaaataaaaagaatataggtactcagatctgctggatttgtctatatacacacaaacacacacatgtgtatatatgtatacatatattttaaattgtaacataacacgtacaatatgcagctgctgaggacatgtgcgggtggggaaggtggggcagagacggaagaggggtgcatgtgctgaaaggtgctgtgtggaggctgaagcccagtgggatgcagatgctgcagtggggtggcctgatgaagtgggtactgtgaagtgtgtctgcgtacacattttaacgttataacataaaacgtaccatttcagccattttaaagtgtacagttccatggcattaaatacattcacactgtgggccgttacccacagaactctttccatcttgcaaaactgactcactgtacccgttaaacaataactccccattccccctccccagctccagtaaccaccattctgcattctgtctctatgaatctgactactctaaatacctcatgagaatggaatctcttacatatttttgaaatctggttatctttagattgtatagacttttctcagagacaaaacttggaagtggacaaaactgtatttcccattttgtctttcacattgctattatcgtcttcctgtgtcacacggcatctggagccaaggcagtgctcacctgtgtaggtgtgatgtggctgatgtcttcagatgcaagctgcttcagaagagtggtcttgccagcattatccaagcccaggagaagtattctcacctcctggtctggtgcacttttcaacttgcgcaaaattgagagcaagcccttcaacaaccacaaaggagacagattactctgggggcactgactgtgatattaactggatatgagaataacttctccttgaaaaaagttattggttatggagagcttatgttattatttttcattctaatgccacttattccatttgcttcctctttccaagtttcggtagaagtgctacagtaaattcagcaacttaataagtagcagggcttatttctgctcctccaatcaatctagcttagcagtcaccccaaatctcctgggagtgtgaactctaccccatctgtgttcctaaagccctttacatacacttagagcagaacattcatcatatcaaactaggtaactgatgtttgtatttttctcctttactaaagtttctcgtggtaagggctatacttgtcccataatgcctggcacttatcaaacagacactagataacacttgtggaattaaataggatgacacacccaagttaacacacgattttaaggtgttatacaaaaatatataaaaaggctatataaaattatagttgggcttcctgttaatgattttatctatttcatcatttcacattgcatgcctgtatcaaaacatctcatgtaccctataaatatataacaccatggacccacaaaaattaaaaggaaaaaatttttaaaaaagattttatcgccgggcacggtggctcacatctgtaatcccagcactttgggaggccaaggtgggcggatcacgaggtcaggagatcgagaccatcctggctaacacggtgaaaccctgtctctacaaaaaatataaaaaattagtcgggcgtggtggcaggcgctttgtagtcccacctactcgaaatgctgaggcaggagaatcgcttgaacctgggaggcggaggttgcagtgagccgatattgcacactgcactccagcctgggtgacagagcaagactccgtctcaaaaaaaaagattttatctatttcagcacatcttcaagacttcttcattcaaaatgttctactatcatctttcacaagaccctacaggataggtgcatggtatagataatctgtgttttttagatgaaaaatttggtacaacagagaagttaagaaatcataaaaggcatccatgaagcaaaacaaaacaaaacaaaacaaaaacccaccaaaattaaccaaggaattttttactgttaatctaatatttccctctgtcacccaggctggagtgcagtggtgcaatctcggctcaactacaacctctgtctcctgggttcaagcaattcttgtgcctcagcctccagagtagctggtattacaggcatgtgccaccatgcctagctaatttttatatttttagtagagatggggtttcgccatgttagccaggctggtcttgaactcctggcctccagcgatcagcccaccttggcctcccaaagtgctgggattacaggccatgagccacctctcctggccattatttattattttttatggatagaaatataaagcatgttgctgggcatggtggctcacgcctataatcccagcactttgggaggccaaggcaggagggctgcttgagcccaggagttcaagaccagccctggcaacatagtgagaccctgtccctacaaaaaataaaaaacaaataagccaggcatggtggcgcaggcctgtggtcccagctactcaggaagctgaggtgagagaattgctagagcctgggaggtcgagattgcagtaagctgtatttgtaccactgcactccagcctgggtgacagagtgagactctgtctcaaaaagaaaaaaaaagaaaaaagaaaaagaaaacaaagaaaaaataaataaaccatgttgatttttagttaagaacataagaacatctttataggaaagttatttgttctgtgctatagctgataatcttgttctaacgacacatggctagaacaagagtcaaagaatcccagagtttaaagggcatataatttaatctcccagcccaagaagaaattccttcaaactgagtcttagaattatgcaaaatggttgtatttgttattcacattgtaccaggcaataattcaaaccagtttgttcactaagatcaaaggatacttctgagaaataattctcaacaactgcatctttggacaatcatacgcaaatatgcataattattaagaattcctttctgcctcagagactctttgtttaccacttctagtactgtatctgtactgacttgctaaggaccacattaacctttctatgcctcaattttttccagcagtaagatggaaggtttagtctaagctagacaaattctatgccaaaagatttgggggacagagattgaatagattggaaacaaacagaagtctggctttttaaaaggccagacttttttttcctttttcttttttttggggggacagggtcttcctctgtggcctaggctggaatgtagtggcgtgaacacggctaactgcagcttcgactccctgggctcaagcgatcctcccacctcagcctctccagtagctgggactaccggctcacaccaccacgccccactaagttttgtattttttgtagagatggggttttgccatgttgcccaggctggtcttgaactcctaagctcaagcgatccacccaaaggcaagatttttttttttgctgtttttatctcatctggtcttgaatactttgacagcattccttcttaaaactatatttacaagaagtctccctggtttctattagctatattgcaatcactcatttataatatcacctttcagaaaagtaaaaattaaaattctgagatccttaggggactggtgacataaaaaggctaagaggaaaacccattttactactcatcctgagttcctgattgtaagtgaaaagaagaggtctcattacctcttaaaataaattataaaacatctggaatttatcaaattagtacattaaatgacacaggcaaagttcttctcatgcattttctgcttagtgcagaaattatgaaggaagatctgtttcctattttaaaaaaaattttttttggccgggtgtggtggctcacacctgtaattccagcactttgggaggccgaggtgggtggatcacttgaggtcaggagttcgagaccagcctggccaacatggcgaaatcccgtatctactaaaaatacaaaattagccgggtatggtggcacatgcctgtaatcccagctacttgggaagctgaggcaggagaattgcttaaacccaggaggtagaggttgcagtgagccaagatcatgcctctgcactccagcctggacaacaaaagtgaaactccatctcaaaacaaaaacaaaaaataaaaccatatattatatatatatatatatatatattttttttttttttgagacaaggtctcactcctaatgccaggctggagtacagtggtgaaatcatggttcactacagcttcagcctcccaggctcaggtgatccttccacctcagcctccggagtagctgggactatagatgtgtacaaccgcacccagctaattttgtgtatttttagtagagacagggtttcactatgttgcccaagctagtctcaaactcctggccttaggcaatctgcccgtgacggcctcccaaagtgctgggattacaagagtgagccactgcacccggcctataaaatattttcaaagtttaaaattaatgttttgggtttttcctcatgtgtctcttttaaagaagttactaaaaatactgttttttttttcaggcagagacttgctccacactcattacatttgatattaaagaattaagagaaaaacaaggccaggcacagtggttcacacctgtaataccagtgctttgggaggctgaggcaggaggatagctcaaggccaggaattcaagatcagcctgggcaacaaacacgagacacatatccctaccaaaaaaaaaaaaaaaaaattatccaggtgtggtggtgtgcacctgcggttccagctactcaggaggctgagacagaaggatggcttgagcccaagagtttgaggctgcagtgaactatggtcgggccactgcattatgggctaggtgacagagcaagactctgtctcaaaaaaaaaaaaaaaaaaaaagagacaaacataatgtttattcaccttaaaaggagaggagcaaagcacagataagaaagaaaaagaaatcattctaactataaggctgagtgcagtggctcatgcctgtaatcccagcacttcgggaggctgaggctggcggatcatttgaggccaggagtttgagaccaacctggccaacatggtgaaaccctgcctctactaaaaatacaaaaaattggccaggcatggtggtgggcacctatattcccagctacttgggaggctgaggcaggagaatcgcttgaacctgcgaggtggaggttgcagtgagccgagatcacaccagtgtactccagcctgggccacagagctagactgtttcaaaaaaaaaaaaaattctaactatagataaactttattaacctaatggtgtagaatacagtgcttctacatttctaatgagtaattttccttattaggaaataataacttcagatacttcacctttgagtgaaattacagagaaatgcaaagttcagctaatgttttcttccagcaaaatgataaatggcatttcaagcatggtctagggaagacaagtgcaaatataatacagcatcatattaatccaactactgaggatgggatcacaggattatcagggtttgctaaatagggaagaggatatttatagagatcagggttctgcctgaaaggtacaaagtaagctgatttaagaggctggatgaaagagaccagaataagtctattctgtgcatctatacatatatgcccatattttattttaactgtcaaatgaagggagacagcgattagaagttaaatttatcatagggctgagttttgcagtataaatacaatgacattaatttttaaagtgcattttttggccaaaatatccattcacgcaattatcattaaacacccttaatgtgccccaagtacaacagtgagcaaaacgggcatgatctctatgtaggatttatattcctgtgacattaaataaaacaatttaagaaacatgaacttcagttaaaagtatattgtgtgttaccagcatgtgtgtatacaagttatctacaccctggtgggcagaagtggtctgactcaaccacaaaacatttaaacaaacttttctacagtcaaatcatgaatagatgtgctatggactacagacgttttatctgcctcgaaatcagcttaaactactggcagaggcatggtgccctgacctaaaacaatacaaactaggtcattcaaagaaaccagagtggtggagggagaaggaatgcgttggtatatggaaaatatatgtggttgtgaggaccagctaaaatttgaattctgaaattacgaagccaacagtcaagtacatacggtccccataactagcttaaatataactgacttccatttgtttttacgtctttcaactgaactcctatcagcttaaagctcaaaattgagaacttaatccaaactgtgtcttctttctcatcaccctctcctaaataaatacaaacaatgtttcctaaggaacaaagtctgagcatctcctcaggaagagtgggttcccacttcaccagagtcctaatgaaatgaatgttatgggctttagaatttcacagacttgtattcagcttctgtgtgtgtgtgtgtgtgtgtgtatatatatatatatatgtatgtatatgtatctgtatatatatatgtatatatatgtatgtgtgtgtgtgtttttatatatatatatgtatatacataacactgcacacagtttcagctagaaaataggaacaggccgggcgcggtggctcacgcctgtaatcccggcactttgggaggccgaggcgggcggatcacgaggtcaggagatacagaccatcctggctaacatggtgaaaccccgtctctactaaaaacacacacacacaaaattagccgggcgtggtggcgggcgcccatagtcccatctgctgcggaggctaaggcaggagaatggcgtgaacccgggaggcggagcttgcagtgaacggagatcgcgccactgcactccagtctgggtgacagagcaagactccgtctcaaaaaaagaaaaaaaaaagaagaaaacaggaacaatacttacatctcaagagatgatgctatgaggatgaaatgaggtcatgtatgtaaagcatgacacataacagccactgaaaagactaccctcgtgttttgtttatttttttaaaataatttttcacgggccattttctaaccagaaaacataagtaactgttgggaacaatcttcaaatgttgaacatgcttgagaacgaccacaagctccatatatgtagaaagtgctccataaataattactgaatgaaggaatcatatgttaaatataagtggttagttacgtgctaaaattactgtcattttagtattttagtaattcatcaagaacctggcactgtaaagcaggggtaaaatagctgactctaaatgttcagagaaacccatatttgggtttttgccacagttacccaaatttgaaaaaaaatatgtatttgtcacagctgaagtttaaaacaaaaaccaaaaaaaccttggggttcacgcttcagttgtacagttaaccatgggggctcatgggataccagatgggatacacttaagtcacacgactgactaaattcagtgtttcacttcaagttttaagaacagctcacgcttgtggagatagaaaaaaaatgtttttgggaaaccagataaagaatccggaataatttgtcttaatttcttattgttcatcttaggaaaaaggaaaaaagaaaaacaaaatctgttttcatcattgaacacaacagttgtatacaacagtgttgtatatacactgtaaatttgttgtatactgtgccaatttgcacctggaaacatgggcagtggttaatttactgtggcctgtaattataaattaaacaatcatggattacacagtacacttaattgatcaacaaactgggaaaagttagccaactctcatgcacttctcatccataatgatgaatctcaatctctgttggttcggcatgcccttttcattccaattctagctattttctgggtaaatatttatgtttgtactcatttgttgagaaaaactttaactttaaaaggacagctcacgtataaatgattaagaaaaagaaacagttgtaaaaatctgtttagcctgaggttaaaaaaaaactgcaagtgtagcaagtgtgaaatgtgattggcaacttcagatcaaataaccctacttctttaacaatctgacaatgtaaaatcaattgagttttttttttcctttctaaatctactcactggataatctgaccaaacatacatctatttttttttttcctgggcatctagtttttttgtttttttttttacttcttaaatcaacagaaatggctcaacatttctaaaagtcaagaaaggaactaggaagagagttggagcagtgactataagtttgatgacaggctctttgcagccaactaacctgctttaagtgttcaaaatcaatttttctttgatagctctaaaattactcaattccattttaactccctccaactaactgtacagacattaacaagaaacagagtgtcaacggtcagatctgtcacaaccataatttagaatttgggaaagctttaattgggactgacagagaaaagccttgccccggattgaagttcgatctccatttttaacttctcgttcttttcagtttggagaactcaagctaggattaagatcttttggtcctggtatggtcacacgcaagaggagactgcaaaaggtttcgaaggaaattctagagacggagcagctaatatgtcttcatcaacatggattatgtattgaatgaaaaatcggtcatcaccaacaatcagatcctgcaaaactctcagcaaataactaaataattcgggactgaggaagcgcacccgccacgcagacaccaagacggcgtaaaatccaccaggcatcccttccaagcggcacccctttgtgtcgtgggacttacttccctaccccccaggggcccgcacagcgcgagaaggaggagagctaggctaccatctcccctgctaccgccagggcgacctcagagccaatggggccggccttctctccgcttctggccgggctccagacgaaccccactttactgcaaagccgcgagaccgattgcccgggaagtctaagcctgctagcgaaagctgctctccgcagttcctgggatccgccctcacccctgtccccagagtaatgatggagcccgggctccgcacccggccagccgcgcactctgccagccccttccccaagcctcggacccgctgcaagccccgccttcctctccaggcccaggcctccctccagggcccaccctcgggtctccccgccgacccccgaaatcagtccacaacccagatagcaggctgagcgacgtcccattccctccttggctttaagcgcagtgctccgccctgggcctggggacgggagggggataaccggccggctccaagggggcccaggcccccacactcaccatcctcccgccgagtccctcctcctcctcctcctcctgctgcctcccccgttaccaggggcaactgctgcggcgccgcccccgacgtccctcgcacgcacagctgaggagctgagcagcaatacggggcggggtgcagctccgctttccccagagtgcgcaagtgcgctaaggcgcccgcccacgcagtgggcgggctacgggagctgcagaggccgccgccggctcgcctggaccagggagtggagaaagcctgcccacgtggctggcgggagcctcccggcctgggattggtcgaaaaggaggggcgtggggcgggcgtgggggcagttccccagcccaggtcctcctctcacccgggccagttttcaaggcgggctgtaactggtggcatttgtcccgggaccaggtaaggggccttgggacaatggcgctcgccctgtctacctccaatccccacatctcgggtgggtgctgagattgctgtcctgactgcccaggcggggctgcagcgcgggctggacttccacctgcagaagccacgtggcgcgaagtgcgccctggggctgcagatgggcccctctgctctgacccccattgcctaggagtgccaggccgagcggctggggcgttacgagctgtccgggatgggggagtaccgatggggggaggccgtctgtcggagggcaagaagcagcctgggggctggccctgagccctgaggtgagctgaaagcacaggtgaaaggcgttttggggatcggcccggtttttgttttgacacagggtgtcgctctgtcgcccgggccggagtgcggtggcgcgatctcggctcactgcagcctttgcctcacaggcttaagcgattctcccgcctcagactctcgagtagctgggattgcaggcgggcgccaccacgcctggataattttttgtattttgtttttgtagagacggagtttcgccatgttgcccaggctgggctcgaactcctggggtcaagccatccgcccgcctaggcctcccaaagtgctgagactacaggtgttccaaagtggtgagccactgtgcccagcctctggccggttttgctaagctgctttggacaggaccgcgtaccatctgtagtcctggaggaggcaaaaatgagcctgcatttttagccaaggaagagcaagtgggacactggggtgggttgggaagtgctacctcccatccctttcccgatgcagaggactataagaagagtttacacaaacgtgctaggccctgttctagacgctggagacacagcagtggacaaaatcagcccgtatggaaattacatccttcctaatgaaatacatttcataccaaatttcattttcacaacccctagaaattggtaattgcggccaggcgcagtggctcatgcctataatcccagcactttgagaggtggaaggggaggaaggcttgagcccaggagttggagaccagcccgggcaacacagtaggaccctgcctctacaaaaaaaaattttttttaattagccaggttccgtggcgcacttgtagtcctagctactcgggaggttgaggctggaggattgcttgagcccaggagctattatcacatcactgtactccagcctgggtgaaagagcaagaccctgcctcaaaaaaaaaaaaaaaaatgaaaacaaaaatcaacatctgctgcttgcatacctgcttcagatccttggagagaaaaagcagttcagagccttgactaaggaggtgatgaatggaggtgatacaggagcacaaacccctataatctactcatctccagactgttggcccttttgtgaaaaaggcaagggaggttgctctttctaagttgtctggtgcctaacagcccacttgccttggagtcagacgagtacccataagcctatacctgggcctgctcttgtaattattaccctcattttccagcttgctctaggcagccttgaccttaatccttgcctgtctcagtggtctttgtgtctgaccttctggggtctttggctaccttgatcttcctctgatgtgagtaccagcgatgatgtttcgtttttctccctacctggggctacaaacagtaatcttgtgcacttctgcttgtaagaggatacctcagaaggaatttggaagcttgttttctgatctctgataccatttgccagagaaaatctgctctttctgggaaggatgagcattacgtcagaggtggcagtagtctattactttttttttctctttgtttccctctctttctttcctttttttttttttttttttttttgagatggagtttcactcttattgcccaggctggagtgcaacggtgcgatctcggctcatcacaacctccacctctcgggttcaaacgattctcctgccttagcctcccaagtagctgggattacaggtatgcaccaccacgcctggctaattttttatttttagtagagacgggggtttctccatgttggtcaggctggtcttgaactctcaacctcaggtgatctctctgctttgggctctcaaagtgttgggattacaggtgtgagccaccgtgccaggcctcggagttggcaagtaggctatagtggatagaggaccttggggaagtaaggccttagctgttgtccaatctttgaggactggatctgttgattgttcgtgtttatatctgctgcaagcgcttagtgcagggccaagtgtatcaaaaatgcccactgtggtggcccaatccatgtgcacctttctaggcttcagtttcctcttctgtaaactgagatcttagatcacatgtcttcaggctatgacattctctctctcttttttttttttttttttttttgtggagacggagtctcgctctgtcacccagactggagtgcagtggtgcgatcttggctcactacaacctccgcctcccgggttcaagcgatcctccttcctcagcttcctgagtagctaggattacaggtgcgtgccaccacgcctggctaattttttgtatttttagtagagacagagtttcacagggttagccaggatggtctcgatctgacctcgtgatccgtccgcctcggcctcctaaattgctgggattacaggcgtgagccactgcgcccggcctcaagctgtgacattctctaatcctaggagggagatatcattaaatcactggtctgatttttactcctactttgttcctagtagtgggaccatacagaagtggggctaccctggacatgatgatgacctttttagggaagactagatgtggcttgtgtgggaggagggacagtaactgtagaagaaaatttagagaccagtatgacttagtacaggcaaggtagacagttttgcaacttcatgaaagaaagcgtgctcttaattctgtaacctaggcaggttctaagtttgacttaaaagaggtgacatccttgatgccaagagacccaagaagaagttggaatgcatttcaggtaagcagtaaatattcttcgagggcatgtgaaacatgtagcagtaaacatcacagacatgatcccgatgcttgtgagccttacagtctgtcaggggaggcagactttacacaaatcacagtcaatgacaagaaggtgacaatcacaaacgcccagcatgctgcaaaggacaggatgctgtaggagtatatatcacagaaggatttgagtttgtcctgaaggagtcggggaagagtgcccattgggggacagtgggtgtgtggggggaaatgttccagacagatcgtttagtgttttttttgttttgtttttgttttggctttatgttttatttaagacagggactctgcagtttctatcctgacttcaattaagaaggcaaaggctcttgcataattagcaaatgtttagattaccccttgatgatagtccctccattctgagaagcagaggactttgcaatgttgtgttaaggtgaacagagatgtcagagaaggtctggctctgtgtgtatgtgtgtgctgagggggaggcatagcattttgctcagtcaggctgtctccagcatgtatgagcctggggctctgtaagccaaggcagcgtgtgttcagccagccaagctgactccttttaggttcatgtagagcatgggaaagtgaactctttcccctcctcccactcttgcttcagctgggactgagataaatgcctttggtctttgaagcagcctgcaggaggccaggtggcagggagaggggaagtctgttttggcagtggactctttctgtctgccttctgacttctctggagattgccgcttcagagaagcatcggggccaggccagggcgctgtggatactccatattgagcctctcctcttgttcctggtctttcctcttaggaaatggcgtacctccagcatatcagcttcctgatgtctcttccgccttaacgaaaaatctaaaaattgaccactgctcttccttccccaacactgtcccttctgcctcctttcttgaacttgaactcctggcctcccaaagtgctgggattacaggcctgtgcctgtctccacctcctttctctcttctttctggtggttcttcccatctttgggggcttccttttctcggcttcttttttttttttttttttttttttgagacagggtcttgctatgttgccaagatggagtgcagtggcgccatctcggctcgctgcaaccttcacctcccgggttcaagtgattctcctgcctcagcctcccaagtagctgggattacaggcgcctgccaccacgcccggctaattttttgtatttttagtagagacagggtttcaccatgttagccaggctggtctcaaactcctgacctcgtgatccgcccgcctcagccttccaaagcactggggttacaggcatgagccaccgtgcccggcctcagcttctttttttttgagacagagtctcactctgttgcccaggctggagtacagtggcacaatctcggctcactgcaacctccgcctcctgggttcaatcaattcttgtgcctcagcctcctgaatagctaggatgataggtgcctgccaccacgcccagctaatttttgtattttttttttttattagagatggggtttcaccatcttggccagcctggtctcaaacccctgacctcaggtgatccacccgcctcggcctcccaaagtgctgggattacaggtgtgagccactgtgcccggccttggcttcttaaatgtcctgatttttcagggtttgtcctcagctctctcctcttcccattctgtgtgttctcactggaaaactttatcgtaaatcacctcgatgctgctgactcagttttttccttctagctctgacctctgtttcctttcaagcctgaatacccacaggctgatgaacttcttattcagcaaatacttgaatattgtgctaggcactggggtgacagtcgtgagcaaaatgaacataccacctcacttcacaggtgaattatttaacttagctaaggtgctatttccaagaaaaaaacaaaatgacctagtagtagaagctatagaagtaaatctgaaaattatttgtacaaaaaaataaaaggacaaataggtactatttagtgaagagaggaaagactagcttttgagtattgtgtttggaaaggacctgagacaggaagaggcctattgcatttaagaaaatcccggccgggcttggtggctcacgcctgtaatcccaacacttggggaggccgacgcgggtaatgggtcacgaggtcaggagatcgagaccatcctggctaacacggtgaaaccgcgtctctactaaaaatacaaacaattagctgggtgtggtggcacgcacctgtaatcccagctactcaggaggctgaggcaggagaattgcttgaacccaggaggtggacgttgcagtgagccgagatcgcaccactgcactccagtctgggtgacagagcaagactccctctcaaaaaaaaaaaaaaaaaaaaaaaaaacccatggcaggaccggggctggtagctcactcctgtaatcccagcactttgggaggctgaggcaggtagatcccttgagctcaggagttgagaccagcctagcaacatagggagaccctgtctctacaaaaaatacaaaaactagccgggcatgttggcacatgcctgtggtcccagctacttgagaggctaaggtcagaggatcgtttgagcctgggaggtggaggctggagtagtgagccatgatcataccactgtactcccacctgggcaacagagcaagaccctgtctcaaaaaaaaaaaaaaatcccatggtatttgaaacttaacatgcagaaatcaagcttactattaatattttctccctcaaagccaatttttctgtgctctccctgttagcacctatcgcccaagtcagaaaccctaggtatcactctggatatttgtcatgtgtcaacttggctaagctaagcaagactcccgggattccctctctggtatattccagttatagtggctacccaggagcacacacacaccatcttccagctcttcagacaaacagtaatctaggtgctgctgtgaggggattttgcagacctaattaaattcctcaattgtttggctttaagttaatcaaaagggagattatcctgggtggcctgacctaatcaggtggaagccctttaaaggagggctagaacacccctgaaccccctctgaggttctggactctgagccattacccgcgttgctccctctcccctgggatggtctgttgctggccgcctgccctgctgacttcaggattgcctagccaacagccacagttatgtgagccaattcgctaattccttgtgataaatcaatttctatattttatcaatattatattacgtcagcattatatatatttaggccaggagtggtgcatgcctgtaatcccagcacttagggaggatgagatgggaggattccttgagcccaggagtttgagattacagtgagctatgattgcaccactccactctaccctgggcaaccagctgagaccctgcctaaaaaaagaagaaaaaattataaaatctatatagatagatcaacatatatttataacatataaagttatatatttatatatgattttatatagctatatgaattatttatgtttatatattatttttatatgttatatttaaacgtaattcatgtctatataaataaatgtatatataaatttatatattataaatatatgttgctatatctataaatttaaaaaattatatatttatatagttatataatttatatatttagaaaatatatattatagtatacaaatatattttagaaatatataaaatatgtatatgtgtgtgtcatagccaggtgcagtggcacacacctgtaatcctggcactttgggaggccaaggcaggcagattgcttgagctcaggagttagaggaactccatgttgccccatgttatgttttggtatctacctgtctgtctgtctgtaatctactgattctgcttctctggttgaaccttgactgataaaatgttcctcttatacctattgcttagcagaccttaacattccgcttctttgaaagattctctcctgttggtctctcctctgagtgcacgtgggttcatttgagccctacctcttcttgcctggattactggggttctcgtccagctggtctccctgcatcccgtgaggtccatccacatcctgtttattctcatgactacccagtttgttcttagtaaactacatatctgatcttgtcactcttcttcttaaagtctttcaatgactccctgaagctttcaggcaaacatttaaaagcgtcagctttttttgtatgactccattttctctcctctcttagcatatcaattatacttcttttgaaaacctttttagtggttgcccaggagtctgcaatgtacatttatgactaatccaaatccactttcaaataacactataccactgcatggagtgtgcaagtaccttagaatggagtcctcccaattctcccctcctgtccttgatattactgctgtcatggatttctctgatccataaactgtaatcaccaaatacattgttgctactattgttttaaacaaacgtatctgtttgttaactgttaacagttcagaataagagaaataaagatttttatttgtttgtttgttagtgttttttcccagacagggtctcactctgtcgtgcaggctggagtgcagtggcacgatcacagttcactgcaggcttagccttagcctcccagactcaagcagtccccgcacctcagcctcccaagtagctgggaccacaggcacatgcaaccacgcctggctatgtttttttcttttttaatttttatagagacagggtctcactctgttgcccagactggtctcaaactcctgggctcaagcgatgctcctgccttggcctgccaaagtgctgggattataggtgtgaaccatcccacctgaccagaagaacttcttttaacatcttgtaagtcaggtctgccagtgacaaatttcctgttttgtttgtccaagaaagtccttttttttttttttttttttttttgagacagggtcttactctgtcacccaggctggagtgcagtggcttgatcttggctcactgcagcctccgcctcctgggctcaagcattcctcccacatcagcctccccagtagctgggactgcaggtgtgcaccaccacacctggctaatttttctattttttggtagaaaaaaaaatacaaaatgaggtttcaccatgttggccaggctggtctcaaacttttgacctcaggtggtccaccggccttggcctccaaagtgctgagattacagatgtgagctaccatgcctggccgactagaaagttttgttttttttttttgacagagtctcactctgtcacccaggcttgagtgcagtggcgtgatctcggctcactgcaacctctgctgcccaggtacaagcgattctcctgcctcagcctcccgaattgctgagataacgggcacctgccactgcgcccggctaatttttgtatttttagtagagatggggtttcaccgtcttggtcaggctggtctcaaactcccgacctcaggtgatccaaccgcctcggcctcccaaagtgttgggattacaggtgtgagccactgcgcctggccccaactagaaatgttttaagggatataaagcagttagtacttgagatgattcttctgtaagatatgggataggtggaaatgggtaacgactaacagaatcagatggtatgcatccccaaatagtaattccaatgatctaggaagaccaacattcccacaccatccctaccaccacagactcagtgtttctcaatgagagacagaatttgtgtatggaggatctgagtccaagcccttctattagtataattgcattaatattatttgtttcttttttttgttttaacttttactttagattcaggggtacacgtgcaggtttgttacataggtaaacttgtgtcactggggttgtacagattgtttcatcacccagctactaagtttagtacccattagttattttttctgatcctctccctcctcccacccttcaccctcaagtgagccccagtggggtctgttgctcccgtttttgtgtccatgtgttcttatcatttagctcccacttttaagtgagatatttggttttcttacttataaatgtgatatttggttttctgttcctgcattagtttgctaaggataatggcctccatcttcatccatgtccctgcaaaggacgtgatctcgttcttttttgtggctgcatagtattccatggtgtacatataccacattttctttatccagtctgccatggatgggccttttgcatttggacaatttctactgacacgtgttcaggctcactgattctttccctggccatgtccagtctactgatgagtccatccaagactttcttcatctttgttacagtatttttgatttccaacatttccttttgattctttcttaagagtttccggctggacgtggtggctcacgcctgtaatcccagcactttgggaggccgaggtgggcggatcacgaggtcaggagatcgagaccatcctggctaacatggtgaaaccccatctctactaaaaatacaaaaaatagctgggcatggtggtgcacgcctgtagtctcagctacttgggaggctgaggcaggagaaccacttgaacacgggaggcagaggttgaagtgagccgagatcgtgccattgtactccagcctggtggcagagcaagactccgtctcaaaaaaaaaaagattttccatcactgcttatgttatttgtctgttcttgtctgttgtccacttttcccttcagagtccttagaatattaaccatcgttgtaattaattaattaattaattttaaccatagttatttaaaattcctggtctgataattctaaaatctcatatctaaatctgattctgatacttggcctgtttcttcaaactgcgttttttttttttttctttttagtatgccttgtaatttttcactgaaagctggacatgatgtaccctgtgagaggaactgaggggtgaggttttgtttatctaggctatgtttactgtttgctgtagctataggtataaaaggctaaattttcttctggtgtccttgttcttatctcccttgctgtctatgggtctctagagacttcttaaatagggcctaagacttgttactctttttgttataatccttgtaatgatacaggagccctgctggtgcagtggtgaggtgagggagtggaggatctacagtcctgtgatgaggtctcagtcttctggggagcctgtgcccctgaaccttcacaagagcttctcagcctccccttgtcctctttaggtgaggcaggaaggcaagaggtggctggagttctctttccccaagtcacttaagttctggtacaacccaagatggttaggctctggtaaaatagtttccctcaagggtagaccttgttgagaagaataaaagggctgggcatgatagtgcatgcctgtagtcccagctacttgggaggctgaggttggaggattgcttgagcccaggagttcgaggttgcagtgagctataatcatgcctgtcaattaccattcactccagcctggataaaataatgagactctgtctctaaataataaaacaggccagatgcggcagctcacacctgtaatcccagcactttgggaggccgaggcagaaggattgcttgaacctaggagtttgaaaccagcctgggcaacatagcgaggtgccatctctacaaaaaaatacaaaaattagccagggtggtggtatgtgcctgtagtcccagttactcaggaggctgacctgggaggtaatagttgcattgaaccatgatcacaccactgcatcccagcctgggtgagagaatgagaccctgtctcaaaaaaaaagtaaaattaaataaaaaaaagaagtataaagggctttgggtgtttttttgtttgtttgttttgttttgtttttccccccaagatggagtcttgctctgtcacccaggctcaggctggagtgcagtggtgtgatctcagctcactgcaacctctgcctcctgggttcaagcaatttttctgcctcagcctcctgagtagctgggattacaggtgcctggcactgcgcccggctcatttttgtatttttagtagagatggggtttcaccatgttggccaggctggtctcaaactcctgacctcatgatccccctgcctcggcctcccaaagtactgggattacaggcatgagccactgcacccagctggctgtttttcaaaatggctacttttcccatctcccctgccagaaacacctgggggtattatactatttaatgggtgggcttttgttcccagagctctccaagcacaggcactgtattgtccccttttccagtccctcctgctgtatggtcaagcacagagctggccaccagcaggccctcaggaaacacatgttggtgcccagttgctcaatctgatgaccattcacttgggccctcccaagctgagtcagacgatgcccagtagctggtgagagcaggcagtctgcaacagtgggacgtgctcaggtcctctgtggtgggctttgatttaggggacagtcatcttcttcctttgtcccttaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggtgaggggtcggggaaggggctggaagtagtagggtaacattgatggggtcctcttgggaggaggtggaaaccgaaggtgaaggaataggcagaaatctcagggctgggggctggaagaagtgagagtggggagactgggagacattgatcaggcaggatggtgactgcctgctgtccttgggtggcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggtgggacctgggggcagggccgtgggaggtacagctgcctggatctgctggtcagggagccatactatgataataataatagttctcttgattggtcacttaccagataccaggcactatgctacattctttgctcgtattgcttcatttaaccctcgcaacaaccctacactataggtactattatttccattttatagatgaagaactagagttctagagaagctgaagaacttgtccaggtttaaacaggcaggaaatatgggtgcctggattttaactgaggcagtcctgtgtagaaccctcaacaaataagctaccccaattccctctttaaaaagtacttattccacaatgattttaattatgtaacacccaaacaaaacaataggaagtccctttcttggcttggttggggagagaatagactgcctctgtagctgctggacatgtgactcttcttcctacctcttccttcctcccctgcgtcccccaccccacgcattgattggttcagctattgagctgggctttgggccgggtgttgggaatgtgaaggcttcagtaacctcccgtcaaggagctcccagttttgttgaggagaccaagaagtaaacagttacagtacagcttggtaagtggtaggttggaggaagaacatggggttgtgggagcaggagcatggagtgacttactctgtctcaggaggggcagggaaagggtcgggaaggttccatggaggaagtgatccctctcaacagggcagggttggccatgtatggaaggaggagggggagatatttgaggcagaggggccagcctgcgcagaagcccaggtgcataaaacagtatgggaacaagctgggcacggtggctcatgtctgtaatcccagcactttgggaagccaaggcgggtggattacttgaggtcaagagttcaagaccagcctgaccaatatggtgaaaccccgtctctactaaaaatacaaaaattagccaggcgtggtggtgtgtgcctgtagtcccagccacttgggaggctgagacaggagaattgcttgaacctgggaggcggaggttgcagtgagctgagatcgtaccactgcactccagcctgggtgacagagtgagactccgtctcaaaaaaataaaaataaaaaactagtatgggaacagtgtggggacctgcagatcatgtgctttgactggcataccctcaggactccctgccatctgacttctctctgcctctcctggccttcctcactggtaggacgatgccggcggtgatcttctggcagtgggtgaaccagtccttcaatgccttagtcaactacaccaacaggaatgcggcttcccccacatcagtcaggtaggagacctgaaccccaggctgtcctcgtgtctccccacgaacagcttttctaaagggttctgggctgtcagtccttcctgggtagcacctgcactgagcaggtgaccaagtcaccctttcccagggtttggaaatattttctcaagctgagtaggggtggatcttcttcctagaccaattccaaatgtgtttattcattcattctctaaatatttcttcttgagtgtgtcttatgtgctggggatgtgcatggttctagatgctgggatacattgttaagacatgtggttgggccaggcacggtggttctcacctgtaatcctagcgctttgggaggctgaggcaggcagattgcctaagatcagtctcaaaacaaacaaaaaaaaccacccagaaaaccagggttgcaaggcagagaacagcagagcggtgtctgtgtagttaggccacttagagcagtcccatctgtgaagacgacatttcaactgtcctgaaggatgagggatgaatgacccaagagcccagggaacacctccccgcatagggagcagccgtgtgcagaggctccgaggcagggaggaacttggcatgttcacagtactgaaagaagaccaagggggctggagcactgtgagtgagggggagagggtcacaagataaggctggggacagatcctgtgcggttttcacgcacgaagcctcgccagccgactttctccctgaagcccgtggtttggccctcagccggcaggggccccactcccaagcatctctctcctcccccaggcagatggccctttcctacttcacagccacaaccactgctgtggccacggctgtgggcatgaacatgttgacaaaggtatggtctggggccgctgcagcatggtggccacgcgggggcagcagagtcctagggaaaacgtccttcccccagggacagttccccaggctgggtgagttgggaatggccagagcccggctggccaagtgatgagaaatacaccagggccgtccccaggttggttcttcttgggcctttgagggagtttggggttcccagactgggtgtctggatgtgtggcggtagcaaggcctagttttcttttttgtattctagtcgttcagccccctcccctcccatcttccagcgcttctgaacaactcctactgttctcttcccccaacagaaagcgccgcccttggtgggccgctgggtgccctttgccgctgtggctgcggctaactgtgtcaatatccccatgatgcgacagcagtgagtaaaggcccctttttctccctacaaaccacaagattagcagaaaaggggcaagaaaccaaagcagtgggtggcttctggggactgcggtgggcatggggagggctgctgggctgagcctctgaagggccctgggattggcagctcccatggtgatggccccgggagtggtgggtgactttgggttaggccgtgtgttgagtcccgtgggagtcctctcctgggtgatgtgggatgggaaagacagggtggacctgtggagttttacactggatcatgtccttttggacctgtgttaaaattgtgaactcctcctacttcccaagccctggggatggcatacagaatgaaatgtagcaggctgaggtgtctaaagatagcatagaacccagaagctttgaaagaagccagaggagtagacagaagttttccaggcacccaactctaagcttttcaggagaaaaggtaaaggagaaactcattgtgtctcacagttcttatttcttgactagagaaatctctgttatgaggttttaatgatgtaatatatgtaaagcactcaaaatagcacctggaacataagagatgctacataagtgttcactgttatttctaccattgtcatcatcatcaatatctacaagccacattttcttgggactaccaacaaatggaaaatgttcacactagtctttgtagaggaagcactaccagaatagttgtgcacacatgctgctccattcatctttccttccccatccagtggccctttcctaacaggagaatgagtccctgccacctaccggggcttgagttgagtgctgtcaagaactggcctgagaagaacagctggggtgggctgggtgcggtggctcacgcctgtaatcccagcactttgggatgctgaggcaggaggatcacctgaggccaggagtttgagaccagcctggccaacatggcaaaaccccatctctactaaaaatacaaaaattagggccaggcgtggtagctcacgcctgtaatcccagcactttgggaggctgaggtgggcggatcacgaggtcaggagatcgagaccatcctggctaacacggtgaaaccccgtctctactaaaaaatacaaaaaattagccaggtatggtggcgggtgcctgtagtcccggcaacttgggaggctgaggcaggagaatgttgtgaacccgggaggcggagcttgtagtgagccaagatcgcaccactgcactccagcctgggtgacagagtgagactccatcacaaaaaaaaaaccaaaaaacaaaaacaaaaattagccgggcatggtggcgcatgcctgtaattctagctactggggaggttgaggcaggagaatcgcttgaacccaggagatggaggttgcagtgagccaagatcatgccactacactccagcctgggtgacagagtgcgattgtctcaaaaaaaaaaaaaaaaaaaaaaggaatagctagagtagctactgtttgtggagtgatcacactgtgtgtcaggtgctggaccaagtatttcatagccattatctcatttaatccttaccaggtcctgtaaagtgggtgccaggatgatccccattttgcagataagcaaaactgaggctttgggagggttaaagactgtgctcaaggtcacacacatcccctgcagtttcaggactcaacccagacagtccgggcccagggccaccgctctcagccactgccctagatcactcctaagatactgcttattggagtgcagaaggaaggtcaaaggcccaggctacaggaggtggcttcctggagcttaagtggcctggccttggtcccctggcatgtcatgtggctggcaggcttccatcacccctttcccaagtccattaactcctgtctgtgtttagggagctcataaagggaatctgcgtgaaggacaggaatgaaaatgagattggtcattcccgggtgagcagaggcctccctttggggtgggaggagggaattccctctcataccctgtcccctccttagtggtcagagtaggcaccaatataggattgagaagccttttctggctccatcctcactccctatcaaattttccccatgtttctctgttcagaacaggccccttctctcttttctccatcatttctggtccataaaaacctggctaggtgggaggggataaagtgaggtcactcagcaactggagggtccttcccttcccctttaccatctcagacttggccatgatgctgacccagccccctggtgcagcacatgtacactggatacatcatttctgacaacttactattttctgccctcagagagctgcggccataggcatcacccaagtagttatttctcggatcaccatgtcagctcctgggatgagtaagatggggaagcccttccatcctggggaagcctgtgacacagggtggaggtctcagccacactcagcttttgggtgggaggtggggcccaccttctacagccatgcttctcaaactgctttgcttgattgctgtaagcctagaagaaccacactagttcctagaacatcagttcatccaaggtttggggtagaaagttattttcattttattaatacttgtcaagcccttgtgtttaatgttagacacagtgtggggtgctagggagagtgatagagaaaataaattccctgctttggtttgcttccagcagtgggtgtattgcaaaatttgtttgcacgaacgtacaaatacatttttgagttttgagaaggtagctttggacctagcagcacatgttttcctgatattgcaagtgtgcaggttgagaagcttgggaagcactgttctgccaggactttggggagaaagtttgggggtggtcatgcctacttgctcttctgttctgcctagtggtaagtattttctggagcttctgctgaaggagagggaaccacttggttcctggtctgacttcagaaggagtcctggggagagcctcccagccctcccctcagcttctccctggtctcttccagtcttgctgccagtcatcatggaaaggcttgagaaattgcacttcatgcaggtatgtagggtttgctttggcattttccctgcccagagtgcgtccagccacatctgtccctagggatacctgacctgccctcccccacccatccttccctttagctaccatgctgtcatctcactcaagcccacaccaatctccactgacctcctgtttagatataccatggccagtttccttacctggtctgcagagaacaaggccttctttaagggccagggggtccttgcctgtgggtttttcttttttcttttgagatggagtctcgctctgtcgcccaggctggagtgcagtggcgcgatcttggctcactgcaagctccgcttcctgggttcatgccattctcctgcctcagcctcccgagcagctgggactacaggtgcctgccaccacgcccagctattttttttgtatttttagtagagacgggttttcactgtgttagccaggatggtctcgatctcctgaccttgtgatctgcccatctcggtctcccaaagtgctgggattacaggcatgagccactgcgcccagccacctgtgggcttttctagctggctgatccatggcagagcagggttggggttcaccttaaggcatagaagtaccatgtggatctgtcttttatttgtttttatacagaaagtcaaggtcctgcacgccccattgcaggtcatgctgagcgggtgcttgtaagtatcatattttgatgatttgggttctgcgtggctggagcactcaagatgtgtcgtcttgtctagcccgtgttggagaacgtgtactcctttacctgactttaaaagtggtcaagctcagaatacctgtggtccatctggaaagctctcaccccatcttttgtgagggcatcaggctggctagactttatgcacgtgtccatgtaggaagtccagtgctgaggtgccctcccatcccagggtctctcctttgaccttaagtctggagcaatttttttgttttttgcttttttttttttgagatggagtctcgctctgtcgcccagtctggagtgcaatggcgcagcctcagctcgctgcaacctccacctcccaggttcaagcaatgctcctgcctcagcctcctgagtagctgggattacaggcacgcaccatgatgccttgctaatttttgtatttcatcatgttggccaggctggtctcgaactcctgacctcaagtgatccacctgcctcggcctcccaaattgctgggattataggcatgagccactgcgcctggctgtctggagcagttttacagaagagataagaacgaggagacatagctttggctgggactgtcatgtgtcccagactcacacaggagggaaatgccaccagtcacgtcagggttcttaggtatctgccattaactggagatgtcctagcgttcaccatgcatttcagggccacgagactaatgacagcatcactaacagctaacactgactgtatattttctctgtgtccccactgaacccagtgtttcatatctataatttcacttaattctcccagccttagaaatctacatattattatcatctccttttacaaatgaagaaactgagacttagacagagtaagaaacttgcccaagggtatatagctggtaactgctggagctgagatttgatcaacagtctaacattatgctataccaacttctgctaattgagtagttaccatgggctgggtgctttacatacatatctcattgaatcctcacagtaaccctgcaaagtaggcactgcaaagtggtctgcagtagccctaaaaagtaggttgtcctccctctgtgtctctgaggtaacttgtccaagatggcacagctagtaagtggtaaaactgggataccaacccaggtctgtcagagtcccgcgtcctgtaagaccttgcctcccaaaccctggtccatgccagcatcgttggcatcctctgataacttgttagaagtaaagactctgaagtccttccccagaccccctcagttggcacctggcattttaataagctcctgaagttatatgcacagtgaagctggagaaactgcctttcactgtgctctgacagcccaggtgttcaaccaataaagaagcaggtctcagaatccacagactcactcctccccctccatagtgcccctcccccactccaaagtgcccctccccatcctggtcactcctcccgatacaagtcaatcctccccctccaagttgctcctctccctcctcatccctcctcccctctgtgtccttcctccctctccatgttgctcctcccctccatgtccttctccctctccatgttgctcctccctgtccaagtagttcttcctactccaagtagttccttccctccaagtcactcctcccccttcaagtcgctcctccccatccaagttgctcctcaacctccaagtcattcttccctctccaagtcgctccccaccctccatgctgttcctccaagttgctcctgtccctccatgtcgctcctccccctccatgtccctcctctccctccatgatgctcctcccctccatgtcgctcttccccctccatgttgctcctccccctccaagtttctcctctccctcctcgtcgctcctttcgctcgatgccagcagtgcctgtgctccttaggcctgctgctcacagtccctgtttacttcattgtcttcttcctctgcttgaacaatgcagtaagggtgggaatgagtgatgggggtcaggagggtactggttttatccccctgccagaatgagtatcctcgcactgcgggaacaggaggagggttggagggagaggatatggtgccagctgggaaggcaggccaggtgcctgggcattgctcctttcccttggggatgggggatggacgggcctgtggggagatgtcccctgatgctttggtttctcctttcttgcagcctcatcttcatggtgccagtggcgtgtgggcttttcccacagaaatggtatctgctgttcattccttacttggtttaattgaccatgctgccagcgcgctccctgatctgcctgctgtccagaaggagacagggaaggggcaggaagggcagcacctgtctgaggacaagtgtccatcagcctaaaggctgggcctcttaaccctggtgaattctgacaaacgaaaacagatctgcgaggggcaggagaagccagggacaggaataaggttgctccctcccagtggagcaagcactgccttgaagagaaggtgggggagcaacaacagactttctcttcctgccagctgggttattaggaagctctcctctggctggatctggtttttaacttttttttttttcttttttttgagatggagtttcactcttgttgtctaggctggagtgcagtggcacgatctcggctcaccacagcctccgcctcccagttcaagtgattctcctgcctcagcctccagagtagctgggattacaggtgcctgccaccatgcccagctcatttttttttttttttttgagatggagtttcactccgtcgccaggctggggtgcagaggtgcagtctcggctcactgcaacctccgactccctgaacgattctcctgcctcagcctcacgagtagctgggattataggcacgtgccaccacgcacagctaatttttgtatttttagtagagacggggtttcaccatgttggccaggatggtctcaatctcctcaccttgtgatccgcccgcctcagcctcccaaagtgctggcactacaggcgtgagccaccgcgcctggcctcattttgtatttttagtagagatggggtttcaccatgttggccatggttggtcttgaaatcctgacctcaggtgatctgcccgcctcagcctcccaaagtattgggattacaggcgtgagccaccgttccccgttggtcgttaacattaaataagggggctggtcgtggtggctcacgcctgtaaccccagcactttgggaggccgaggtgggcagatcacctgaggtcgagagttcaagaccagcctgaccaacatggagaaaccccgtctctactaaaaatacaaaattatctgggtgtggtggtgcatgcctgtaatcccagctacttgggaagctgaagcaggagaattgcttgaacctgggaagtggaggttgcggtgagccgagattgcaccactgcactccagcctgggcaacaagagtgaaactccatctcaataaataagtaaataaataaataaataaataaagggacaggcagagggctgacaaccgaaacccctctatttcctttgtgtgtccaagaaggaggaagcagggagaagggatgatggaaaagggaagggatacatcagactagggggtggagggtgactgaccccaggagacaagtgtagcttgaatatatacccagacaattccagtctccccttcctcagtactctagttcaatactacttccatggtcatctgctagacatctcttgtgtcccaagcactgtgtttgtaatcttgtggagaagatggaagttgaaacgaagaaccatagcccaaggagaatgaagtcaggcctgcgtaatggtaaagcaacattgtggtatacagaggccaataataatcctagatggaaaaatcaggagggcttcttggaggtgatattcatctgagggtaacttactgcttgttcctggtggcatgctcataatccacttctctcttttcagtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaactgtaaactaagttaatgaagcctgaatggaaagcaggatctggccttactttggccttggcatgtcagaaggtatcacaactactatataaggggaacttgtctgatgcctggaggctgttgtttatttccctcattaaaggggaaatccacctgtctccacaggaagctccagatctcccagaatgggagctgtgttgccctagagcaagagttggcaagctatggctcaaggggccaaatccacctgccacctgtttttgtgcaattggaagctaagaatgtttttacatttttaaagagttgtaaaagggaacaacaggaatgacagagaccctacctatgtggcatacaaagcctaaaatatttactgtctgatccttgacacaaaaagtttcccctgccctggagcagtggttcttaagcacatgcatcaaccgggcgcagtggctcatgcctgtaatccccacactttgggaggccgaggcaggtggatcacctgaggtcaggagttcgagaccagcctgatcaacatggtgaaacccgatctctactaaaaatacaaaaaatttgctgggtgtggtggcatacacctgtaatcccagctactcggggggctgagactggagaatcacttgaacctgggaggtggaggttgtggtgagccaagattgcgccactgcactccaacctgggcgactccgtctcaaaaaaaaaaaagaaaacacatcagaattagctggcaggcttgttaaagcacagattgcaggatccattgccagattctgtcactctgggctggagcctgagaacgtgcatttctagtcattgcccggtgatgctgattctgttggtcttggcaccatacgtggaggagcactgctctaaggggaaagggcctcctccccgaggccaaggaattcactgcaacttgatttttctccccgtttaaaaaagttaaaatataactcacataccataaacttagtccttttaaagtgtacaattcagtggtttttaatgtagtcacaaagttgtacaagcatcaccactaattccagaattattttgagacaggatctcactctgttaccctggttggagtgcagtagtgcaatcactgctcattgcagcctcaacctcctgagctcaagtaatcctcctgcctcagcctctggggtagctgggaccacaggctaatttgatttttttgatgaggtctcactatgttgccccaggctggtctcgaactcatggcctcaagtgatcctcctccctcagccttccaaagtgttggaattacacacatgagccactgcatctggtctcagaacatttttcttagccccaaaagaaaccccatacccattggcagtcactccacattctccctacctgccagcgcctcacaattcacttcctgtctttagagatttgcgtattctgaacatttcatgtaagtggagtaatgcagtatgtggccctctgtgtctggtttctttccttaggataatgttttcaaggttcatccatgttgtagcatatgcaatttgattttagctggtgtctgaacagaaaagtctgtctttgagctagcttctttaggacaggagacctggctttatttccaaaagcaaataggaaaagggaaacattaccagagccagtagagcttggaaacaactcctgactgatgttctttcagaacatacaatgtttccccttccttctcagctcctcaagcctcttggatttcctgttctcttatagacaactgctcttttggaaatgtctggaaggtatgtggtggctataatgttcagggacattctaaaaagtggtcactcaaactgcatctcagtctcattttgtaacatctctcttctttgagttggctgctgtgggatgttgaataagaggcagttaaggttactaaaaggccttggtgtgggaagtgctaatccagactgtcctatccaatagctcagcttgagctttcaggtaaaaggagaaagggaagttggggcaaaatcccctgtgtttgccaaactgaattggggtttcttatttattgagagaaagagggtatcactttcttgcccaggctggagtgcaatggtatgatcatgactcattgcttcctcagcctcctggactcaagtgatcctcctgccttagcctcccgagtagcttctttttcctgagttcggctagaatagcatgggtaaaaggttccattgctcgggagaggaggaggaagggaagaagaagaggtatagaagcttccttttgatccaaggtcttttcctcaatcctggctagaaccagaatcctaaaggtttcctgactacaggtacatgccaccatgcccagctaatttttaaattttttgtagacagagggcctcactatgtttcccaggttggtcttgaacccctgacctcaagcaatcctcatgccttggcctcccaaagtgttgggattacaggcgtgagccactacatcccacctggggtttcttagtgatgatgaaacctagcctttatgtggaagacttacaactttttgaggccaggaattagagaccttgtgccatgaaaataatttggtccttccctagtactcaatttttacttctcctctaaggagcttgacttgtggaatggataaatttctaagaaacgagagattggcaaaaatacgtgtcactttttatagtacttggaaaagcaggatcaagataaaggcagaactatggactttcttaagctgagggaagactgacttaactcttacctgtttcccatttttccaacacttaagccaagaacaacttcctctgggctcagatgtgggctagactgggccaggctgtaaaacactttgacaggtttttgagaggaaattgactgctaaagtcaactgtgttatttgccatgggtcttcctttgtccatttattttaccaacttttttttttcttttttttttgagacagagtctcactctgtcacctagggtggagtgcagtggcacagtcttggctcactgcaacctctgcctcccaggttcaagcgattcttctgctttagcctcctgagtagctgggactacaggcatgcaccaccacgcctggctaattttttgtatttttagtagagattgggtttcacaatgttggccaggctcgaactcctgaccatgtgatccgcccacctcggcctcccaaagtgctgggattacaggcaggagccaccgcacctggcctttttttttttttgagacagggtctcactctgttgcccaggctggagtacagtggcacaatcaaggctcattgcagcttcaatctccctagctctggtgattgtcccacctcagcctcccaagtagctgggactacaagtgtgcaccaccatgcttggctaatttggctaatttagtttttttatttttgtagagacagggttctctccatgttgcccaggctggtttcaaactcctgagctcaagggatctacctgcctcagcctcccaaagggctaggattataagcatgagccaccacacctggctattttaccaacattgatcaagctctggttgagccttgtacaggatattataggctttaaaagaagaagaagaaagacctggtatgctgtacaaaaaactgcaaaccaggcacgcagatataagtgttacaagaatccagaagaagcagcaaggagatggggctaggagtttgtaagcagggaactgtatctgtaatatgtaaatgaagttactgggcatctcttcaatggtcagtgtgagtggaatgtgtgggaaaatgtagtggtgagaggtgagataaagagaagtagacagggacgaagtcacagagaggaccgtgttgggaagtttggactctctattctgtaggtagatgaagtatttaaaagaagaggccatgatatagtaatatttggtttaatgtggtatggttgtagtgtgtggcggaaatttgagaggaagaattgtcaacttgcagggcagcagggaagccatttgtatttagctagaagaacatggattgaagcaatggatgatggatttcagagcaatttgtgaagtagaaccagaattttgtccgtcgaacttggggtgacgaagcactatgcctcagataaaggtactatcttctagggaattcaaacggacctaagctgctatttgggcagttgagaccaagagaggcatcctggtaatagtgctgtgcttcaagacaaaagacattaaaatatttttacattgcaattgttttcctcttcaggagcgcctggttacctttcaggaataatttattttccaacacccttgagaaacattaaaccttttttctttttttgatgtggaaaactggaaaactagtacttccgccacactcaagatggctacatcagaaatagacttttccatccacctgggtggccccgcccccttatgaagctgcttccgccactctctgcgggttgggacgaattttacacttcttcgcagcattcaagatggtccggcttcctcctactttttattggctgcatcgcttcgtcttcaggggaaggcgggacttatatttgatcgacagctacattgatcaatggacaaagggcaaaggccaatgaagcgctggaactggagagtctctcgcgtgtctgggagggtgttttgcgcggggcggggtggagcagagccggaagcgggaggggagcgtcaaacaggaaaagaagggaagaaggaagaagagggtagaggaggagagggaggaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggtaagggggagggggcgtctgggccatgttgggtcctgggggtcgtcgaggcctggctggaggggtctgaaggagtgttgttgccaagagttgaggggtcccgagaggggcgtctatgcctggcgtggacaggatctaaaggggcgtcggtatttagctgagggacacctgtgacagttttggtgtcaaggaggtggcagaggcatgatgccaagcgagtgaggggcgtttgagacggcaggttggttaggtgggctggggtgactgtggctggatagcggtgccaagctgaggatgtgggccttattcgtgtccctctgtggagcaggtgtcccaggcagtaatgcagtatgtacgtctgtgtgtgtaggggtacacaggctattgagttggcctgtgagggaggggatcctgaggatatttctttaaggatggactggggaaagttccgagggcatcttagtacgtttaaaaaaaattactatgttcctgggagagacttggccccattttaaaatctgtaagccatggcgcacttggttggagggaggactctcagaaggcaggtgggatgaaacagagtggaacccctcaggaggaggagcacacttgagctgtaacaagctcttgctgttaggctggctggcctgggagagcaagtcacggatgctgatctgagccagctcagggcttttgaccagagggtggttctgatgccaatatgggcagcaaatggagcaccctagcttttcttgctgggtggcttgctctttatccaggcagagaagcttgcttgtgctgattccagctccagctggcatttcaaaaccctaatgggagcgttactcctggtgccaagttgggtggggtgcagtgggggcaatcacccctccttccttgcatgtggcaaagctttatgattcttttttcttcactttctgttcttttccccgttttttcagaaaggcatacacacatagacgcatagcgtagtggcaaagtttatacaacttagcgcttgaacttgtgttgtgaacaagagcagaaactgagtgccagcaaaaatacttatcttttccctaggagttttagggctgccttttcacaaatacatcttgttttgcccattatcctctattttaaaatactgattaaaaaataagttgaaattcacatgacaaaaaccattttaaagtgaacaattcagtggcatttagtacacttacaatgttgtgcaactaccacctctatctagttccaaaacattttcatcaccccaatagaaaacctcgtccctactaagcagttactctctgtctcccttttcccccagcccctggcaaccacccgtctgctttcagtctctatggatttatctattctggatattttatataaacgggatcctacaatatgtggtctttgtgcctggctcctttcacttagcgtaatgtttataaggcccatccacatcgtagcatgtactagtacttcattcctgttcatgaccaagtaacattctgttatctgtaaaccacaatttatttatgcattgaagtgtctaatttttcctcaggatatgtttgtgtatactagaaataccatgtgaaaggaatgtagctcattttctagcccagtgtattcccttttcgagggttgggacccttctgttttagcctttgttggggttgtttttccagtggaaatcataaactggcagaagaaatatattttttttgtttactagaaatgttatagccctcaggaccagtaaagttaagtataggtattgacaacaaaatatagaatatagtaaatacagaatttacttttcctttgcacatgtctgtttctgtaagtatctcgaaaaggctgtccccagtaaccaataaataacatcggtagaggtttggtttaggaatgtcagagcctttggagatgggctggtcaaagataggaactagatccactttttcagcaacggggatgatggaaagtggaggttcctaccaggtcgtggagcctgggaggtgttgtgaacatgtggaaggggattgttaatgttatattctaattgcagtttgcaaaccacaggctgctttcttatatctgtggcacttctaatacttaattttggggacaggtgtcttttgtactttgttccatttggatgaatgctatcactgaccaacagctgttacacggttacaattcctgcagagaagggaaagttttcgtaatgagcagtggccctcttcctaaccagcccccacataccctcactcctgacgctccctatacaattccatcccccaccttatactcctgtctctttctgtctgggagtactagatatctatagtgagatttctgttttgaattttaaccttcggaatgcaagttactatataattattaactctgaatccaccgcaatttagtcagtgtatttttttgggtttttttggggggggtgggggaaggggttgcttgtacaaatcagtaaggaaaaaaaaatcccaaggccattttggcacagggcatactttaagtacccatggtccttaattcaacaatgaagtccagctaactttgaattcaggaggacttactatactcattctgtatcgaataatggtattggtaccttattgcatttctcccacaaaattgatctacttacaatacaatcttttttttacatgcacaatcttttttttacatacacatttaccatcagaaataaatgatactaggcaacttgctttccctgttaccagctctgcactgaaacagccatttcttgtttatgcaggcaggccctggaaagttcatcagctagttcattctgtggttaggaacttagacttaactctcctacaggttatgacattacaactcacagacgtgaatccttaaatctataaagaatgaaaaaggctgggcatggtggctcacccctgtaatcccagcactttgggaggccaaggcaggcagatcacaaggtcaggagatcaagaccattctggccaacatggtgaaaccctgtctctactaaaaatacaaaaattagccaggcatggtggcacacctgtagtctcagctactcgggaggctgaggcagaagaatcgcttgaacgtgggaggtagaggttgtggtgagccaagatcatgccactgcactctagcctggtgacagagcgagactccgtctcaaaaaaaaaaaaaaaaaaaaaagaatgagaaaacagtagatgctccaaatagtaaggctccgacagccttggcgtttgtttcctccagttaaattatcattgagatacatagagtttcttttggttgtttagatttaaccagaatgtttgtttttgttgttgttgtttttgttttgtttttgagacaggatctcactctgttgcccaggctggagtgtagtggtgtgatgtgatcttggatcactgcagcctcgacctcccaggctcaaacgagcctcccacctcagcctcctgagtaactgggactacaggtgcatgccaccacgccctgctaatttttgtatttttctgtagagatggggtttcgccatgttgcccaggccggtcgcaaactcctgggctcaagcgatctgcccatctcagcctcccagagtgttgggattacaggcatgagccactctgcccagcctaaacagaatatttgactatgttatttaaaacaaagttttggtagaaatgtctttttttaatagggtaactcagccagtggtttagggacaaatctctagagatgcagtccttacctttcctttgccaggcttaaaactttgagctgggcctggcacggtggctcacacctgtaatcccagcactttgggaggccgaggcaggcggatcacgagatcaggagattgagaccatcctggctaacacagtgaaaccccgtctctactaaaaatacaaaaaattagctgggcatggtggtgggcacctgtagtcccagctactcgggaggctgaggcaggagaatggcgtgaacctgggaggcggagcttgcagtgagccgaggtcgcgccactgcactctccagcctgggcaacagagcgagactccgtctcaaaaaaaaaaaaccaaacaaacaaaaaaaaactttgagctggatgggggcctcagttcctgctattttttcccacctcaccctcaatggtataccctttggttcccaccttacctttactcacctccattcccagttttcagtctggaagccctactccattctcctttcttacaaatggtatttcaatgccatcaccatcattcctccttatacaatagtgggattcgagacttccagattctaatcccttttacctcacctgcttagtgcgtttgatgtaccaaagtgtaaaatcagcaccttgagtttctgcaaactctttcagtggaattcagtaggcatcaaagaatggacatttactgaaatgtctactctttgcagcaggctattattgctaggccctgggaaccatcaaatgagtatggaatccctgttccccaggagctggaaatcttgtggcaaggacagatagcgcacacagtgaattgtaatccagaggttttgctgaaatggaagtacaaacaaaggactgtcagcacaactgattctgctagggcaagaggaagatggggtgctaagaagaacttcattaaggaaaaagcatttgttcaggactttaaaggttgataagcatgggtagagtatggaccaggaaggggaaaaatggattccagtgtggaagaatgaaaatggagagtgtgtttggaggtgacatgtactctgtggcagaagctttgtgtgtggatgtgtagaggagtgtggaagtgggggaggctcgaaagagaggctgttgtcacatggtcaggaggcctttcatccattcatctaaggctgcaccatccagtagaaccttctgtgatgctggaaatgatctctctctgtgccgtccaattcagtagccacttagccaggtggctgctgagcatttgaaatgtggctaggataactgaggaactgaattttgaaacatatttaattttgaaacatatttgtttatttacatatttttattttttagagacagaatcttgctctgttgcccatagggtttctgtcgctggaatgcagtggtgtagtcgtagctcactgcagctttgaactcctgggctcaagcgatccttctgcctcagcctcccaaggagctaggattgttggtgcatgccaccacacctggccctatatttaattttttttcttttttttttctctctaataaaaaaaatttttttttaagtagagatgagtgtctcaccatgttgcccaggtgggtctagaactccttgggctcaagtgatccttccaccttggcctcccaaagtgtttggattacaggcgtgagccaccatgcctggcctaattttttttaattaaaaaaatttttttatagagcagaagtctcactatattgcccagtctggtcttgaactccttggctcaagtgattttcctgcctcagcctcccaaagtgctgggattgcaggcgtgagccactgttcctggccctccatatttatttatttatttatttattttttgagatggagtttcattcttgttgcccaggctggagtgcaatggtgcagtcttggctcactgccacctctgactcccgggttcaagggattctcatgcctcagcctcccaaatagctgggattacaagcactgccaccatgcctgggtaattttttttgtattttttttgtagatacggggtttcaccatgttggccaggctggtctcgaactcctgacctcagatgatctgcccgccttggcctctcaaagtgttgggattacaggcgttagcgaccacgcctggctgcccatatttaattttttatatcaactttattgagatataatcaggtcaggcgcagtggttcacacctgtaatcccagcactttgggaggctgaggcgggtggatcatttgaggtcaggagttctagaccagcgtggccaacatggtgaaacctcatctctaccaaaaatagaaaaattagcgtgcacctgtaatcccagctactcaggaggctgaggcaggagaatcgcttgagccccataggcagaggctgcagcgagcctagatcacgccactgcactccagtctgggcgatagagtgagaccctgtctcaaaaaaagaaaaaaaaactttattgaggtaatttacatgccaaaaaaattcacccttttaaagtatacataaattggtgtttcagtatagtcacagaatttgtgactatcagtgctaattttagcatattttctttttttttttcttttgaaacggtgtcttgctccgtcgcccaggttggagtgcaaactccgcctccagagttcaagcgcttctcctgcctcagcctcctgagtagctgggactacaggtgcccaccaccacacctggctaattttttgtatttttagtacagatggggtttcactgtgttagccaggatggtctcgatctcctgaccttgtgatccgcccgcctcagcctcccaaagttctagaattacaggtgtgagccaccacgcccggcccaattttagcatattttctttaccccagaaagaaaccccatagccattagcagtcacttccctttctagccccttttcttccatcccttagtgaccactgatctacttgccattcctatggatttgcctgttctagacatttcatataaagtgaatggtacactatgtggtcttttgtggcttatttcacttaccataaggttttcctttctttttttgagacagagtctcactctgtcacccaggctggagtgcagtggtgtgatcttggctcactgcaacctctgcctcctgggttcaagtgattctcctgtctcagcctcctgagtagctgggactacaggtatgcaccaccatgcctagctaacttttgtattttttagtagagatggggttttgccatgttggccaggctgttctcgaactcctgacctcaggcgatctgcccgacttggcctcccaaagtgctgagattacaggtgtgtgccactgcgcccaatcaaggttttcttttttctttcctttttttttttttgagacacgatctccctctgttgcccaggctgaagtgcagtggtgcaatctcagctcactgcaatctccacctcaagcaaacctcctatctcagccctcctagtagctggagctacaggtgcgcacccacacccagttaatttttgtattttttgtagagatggagtttcaccacgttggccaggctggtcttgaactcctgggcacaagcgatctgctcgccttggcctctcaaagtgttgggattacaggtgtgagccaccacacctggccaatgtgatatttacttaaaataatttaaactaaatagctgtatgtagatagtgactacatattggaggatactgatctaacaactttccagagtagggatttggtacagtcaaacctagtggtcatgtcatgagctctggggtcagaccacctgagttccaaatttgatactgtccttgagcaagttacataacctctttgtgcctcagcttcctcatctataaaatgggaattgtactagtatggggttgtcatgaggtgaaaagacataatatatgtaaagctcttggaatatattcaatgattaataagtataataataattatcaccattattgctgttggcagtcctcagagtgtattatggtttgtaagttagtgtcaactcccagactaacttcaggaactgagatctggagattttgcaagtgactttctttattctgttctatgtctgaatttaggtttggggagaattttgtccttccagaggacattagtcactgtcacagcttgggagtgccactggtatctagtgagtggaggccagggatgctgcttagcatcctggaatgctcaggacagccccccacgacaaagacttttccagcccagaatgtcagtggtcccgaggtggagaaatcctggcttagtgggacctgctgtggccttaccaggtcctgttcattattgcagagcttggggtcagctttcttgcaagaacaacatagcattgtgaagtgtatgaaataaccttggacagcgagttttcggtgggacttgaagctttgatatgccgaatctcactgcctttcaggtttgttgatgtatgtggtcagtcagctctgtcttgtcagccaacatcaaacattttgaaaacacgtttttttgatttgtgattcagtaagcaggtgagcctcccttatttaccccatcttgaactttctttcctcttgctttgatctgctctgtggttttattttaagaacatgatttgctttgctcccagtgaaagcctgatggtcagttattttctgtgtcctccatagtcctgcaaccaatctgaactgagtcatgttcttagaactttttcctttccccattccaagtcctggctctactctgattttcggcctcaggaatgttggtttgctctcacgcacgcttagcctgtggaaatcattaggtgttctcagggtctgtcacaagagaagctaagtgtcctggacctcagggtggctgtgtcttgaggagagtcctcttttcaggcccccaagaggcagctcatctgtggatgtttgagccgtcgggtctttgttgttgtcatgggtatcttgcatggctttggattcaaaacttcacctgtcttttgaatgcctgtccacccatacccttgagaggacctcttgctttcctgccatcagctattaggactaacacttgggagatcatcaggttccaggtggtagaatggcttgggttggttccttgctcctactaccccattcatggacaccactggggccgctgatcccactgtaactgcacagccagtaagagcagccactgagtgatggattatcctgcctccgcctctcaagtagctaggactacaggcacacgctacagcaacagagggtcttggtggcttctctccttggtggcatacagtagacaggctgaggtctggtctgtgggcacctcccttttgaaacatccttttcagttccactaggtggagcaaagtctggcctgaaaactgcatgctatgtggaaaccacaaagaaacacaagtaaatccagaacattgcaacctgggaggtcaagaagggggaaacaaatcccatcctattgaattttaaggcttgttgatacaattctgagctttcctgatctggggattaagtaggtcatcctctcagacttgcagatcacccgtcttgcatggtctgggtttttgggatatgcttgcttactcagttacattcccatagctctgatttatttacttttggttttctcctttccacactttcttctgtgggaaatcagaggagttgtttttcttctgctcctggtgctgtcgtcttcacagtgccaaagctaagttttgattcaagatctcaggtgtttaaaataatttaacttaaacatttttggaagaggtaaaaataaatgtaagatgttacaagaatatctgtggcttggaagggtgggtcctagaatggagagttacaaaaacatgtctgttttgatttttaaatatctagcaagacaaatgttatgttgtaacacttttattacacattctttcagatcagaggcatgcattcatggagaaaatattcgtatttttcaaaattctacatgttactttttggtttgccatttcctaatttattttcctcatttaaaattccacctgacagtttcatcaaacacagaaacaacaagggaaaaaaccacagcttagtttattgatcagatttaaatatttttctctcttagtagttcatttgggagaagaaattactatttggctttctacaccaggatgttggaatattgtaactctttggaacttaaatacagaattgaatagtgtgagttcatcctgcttactcctttctttttccctggataatttgtctttaagttttgcaaatccctttgctacatttgggagggggtaaggagcataaaacctaccccagtatgatttggcactatggctgactttccatttttcttccttagagctgattgctgcttttctttgagctttaaaatacctttcaccttttttttggagatgaagtcttgctctgttgcccaagctggagtgcagcggtgcgatctcagctcactgcaacctccgcctcccaggttcaagcgattctcctgcctcagcctcccgagtggctgggactacaggcatgtgccaccatgcctggctaatttttgtattttagaagagatggggtttcactatgttggccaggctggtctcgaactcctgacgtaatccacctgcctcgacctcccaaagtgctgggcttacaggcatgagacaccgcggcaggcccctttttacattttttgtttttgttttttagcgtcagggtctcgctatgctgcccaggctggagtacagtggcgcaatcatagctcactgcagcttcgaactcctgggctaaagcgattctcctgcctctgcctcccaagtagctaggactacaggcacacactacagtgtccagctaattttgttttatttatttatttatttatttatttattttttgagatggaatcttggtctgtcacccagctttaaaatacctttcaccttttttttttgagatgaagtctcgctctgtcgcccaggctggagtgcattggcacgaccttggctcactgcaacctccgcctcctgggttcaagccattctcctgcctcagcctccccagtagttgggattacaggtgcgcaccaccatgcccagctaatttttgtattttaactagagacgggtttcaccatgttggccaggctggtcttgaacccctgaccttgtgatccacccgcctcagcttcccaaagtgctgggattacaggtgtgagccaccgcacctggccttgttttattttttgtagaggtagggtcttgctatgttgcccaggttggagtacagtggtgattcccaggcatagtcatagtgcacggcagctttgaatccctggcctcaagtgttccttctgccttagcctcctgagtagctaggactattactttttatttgagatggagttttgctccattgcccaggctggagtgcagtggtacaatcttggcttactgcaacctccgcctcctgggtacaagtgattctcctgcctcagctccctgagtacctgggattacaggcacacactactatgcctggctaatttttgtatttttattagagatcgggatttcaccatgttggccaggctggtcttgaactcctgagctcaagtgatctgcctgtcttggcctcccagagtgctgggattacaggtgtgagccactgtgcccagcctacattctttttaaatgacacaaaaacaacacgtgctcataacaatgttaaataatagattttaaaatgttggccgggcgcggtggctcatgcctgtaattccagcactttgggaggccaaggcaggtggatcacgaggtcaggagatcgagaccatcctggctaacatggtgaaaccccgtctctactaaaaatacaaaaaattagccgggcgtggtggtgggtgcctgtagtcccagctactcgggaggctgaggcaggagaatggcatgaacccgggaggcagagcttgcagcgagccaagatggcctatggctcaggctagagtgcagtggctagatatagacaaccatatatctatatatagtctatatatagagaaccataacattgtttggtatgggtagggttctttatttgttttaaaaacaaaaatgtggccgtgcgtggtggctcatgcctgtaatcccagcactttgggaggccaaggcgggtggatcacgaggtcaggagttcgagaccagcctggccaacatgtgaaacctcgtctctactaaaagtacaaaagttagccaggcatggtggcgcatggctgtagtcctagctactgaagaggctgaggcaggagaatcacttgaacccgggaagcagaggttgcagtgagccaagatcgtgcctccatactccagcctgggtgacagagcaagactctgtctcaggggggtggtggggggaagggatcatttgtaatgtagcatttcacaagatgcatttttttttaaccttaatatactgtggactaatttccatattgtagatactcctctgatttcttaaaatacctgtattctgttgctttataccgtgatttatttaaacacttctccattgttaatggagtttttgccatttcacacagtgctacgttgaacattgttgtacttatttctttttgcaattgtgctagattcctaaaagtggaactgaggattgtgtggttatagggtatgcacatttaaaggctggagtagatagtgccacgttgttctccggtatggttgtatcagtttacattcgcatcaataggatctgcaggccgggtccactggctcacgcctgtaatcccagtactttgggagactgaggtgggcagatcgcttgagcccaggagttcgagaccagcctgggcaacagagcgagtctctgtatctttgagacagagtctcgatctgttgcccaggctggagtgcagtggcacaatctcaattcactgcagtctctgcctcctgggtttaaacaattctcgggcctcagccccatgagtagctgggattaccaacgtttgccaccacacctagctaatttttttgtgtttttaatagagacaaggttttgccatgttggtcaggctggtctcaaactcctgtcctcaatgatccatccatcttagcctctcaaagtgctgggattacagatgtgagccaccacacccagcccaatttttaaattttttatagagacagggtcttgctatgttccccaggctggtcttgaattcctggcctcaagtgcttctgcctcagcatcccaagtagctgggattacaggcacaagtcaccgcacccagcgatactattattcttgtttgcacatcatcgtgcccttgagtgagaagagtgatggggtcaccgccaaggcggatgggcactgtttgtcaagtatgggggtcgtcacccatcttgaccacagggctagaccacatgtggctctgtctgctctcatacacagtactgtgctgcagtgagggggatccttaacttctgtccccaacctccatttggcacttcctgttctcaggggaagatggtttctgagcctttttttttttttttttttttttgttgatacaagctctccctgtgtcacccaggctggagtgcagtggcatgatcatagttcatggcagcctgacctcctgagttctagcgatcatcccaccttagcctccttagtagctgggactataggcgtgcaccattatgcccagctaatatttgtatttttagtacagactgggtttcactgtgttgaccaagctggtcttgaactcctgacctccagtgatcctcctgcctcggcctcccaaagtgctgggattacagcatgagccactgtacctgccctcccccccccccttttttttttttttttgagacagagtctcactctgtcacccaggctgaagtgcaatggcacgatctcggctcactgtaacctccgcttcccaggttcaggcaattcccctgcctcagcctcctgagtagctggactacaggcgcccgctaccacgcctggctaatttttgtatttttagtagagacggggtttccccatgttggccagactggtctcgaactcctgacctcatgtgatccacccgcctcggcctcccaaagtactgggattacaggcgtgagccaccatgcacagccctttttttttttagtaacagttttattaagatctaattcacagaccataacattcaccattttcaagggtattaattaagtggtttttaatatatccacaaggtgagccaccatcaccgctatcttaattttagactattttcatcactccaaaaagaagccttatagccattagcattcattccccttattttcttccctccagtccctggcaaccactcatctacttcctgtttttatggatttatctattctggacatttcatatgaatggaaccatacaccatgtggtcttttatgactggttttctttacttagcatgttttcaaggttcatccatgttgtagcatgtatcaatacttcatacctttttatggtcaattaatgtaggtccagccctatggggcttagcgggtgttctccctgtgtgcggagacgagagattgtaataaataaagacacaagacaaagagataaagagaaagcagctgggcctgggggaccactaccatcaagatgcagagaccggtagtggccccgagcagctgggcttgctgagatttattgcatacaagacaagggggcagggtaaggagggtcagtcttctaagtggttgacaaggtgaagcaggtcacgtgcttacaggatagggggcccttccttttaggtagccagagcagagagagaaggcagcatacgtcagcgttttcttctctgcacttacaaagaaaagatcaaagactttaagactttcactatttcttctaccgctatctactacgaacttcaaagaggaaccaggagtacgggaggagcatgaaagtggacaaggagcgtgaccactgaagcacagcaccacagggaggggtttaggactccggatgactgtgggcaggcctggataatatccagccttccacaagaagctggtggagcagagtgttccctgactcctccaaggaaaggagactccctttcgcggtctgctaagtaacgggtgccttcccagacactggcgttaccgcttgaccaaggagccctcaagcggcccttatgcgggcatgacagaaggctcacctcttgccttctaggtcacttctcacaatgtcccttcagcacctgaccctatacctgccggttattcctaggttatattagtaatgcaacaaaaagtaacattaaaagctaatgattaataatgtttataataatgattgataattgtccatgatcatctctgtatctaatttgtattatgactattcttattctgttttctttattatactgaaatagtttgtgccttcagtctcttgccttggcacctgggtactctttgcctacaaattaatactccattttatagatatactccattttatttattcatcaattgatgaacatttgagctgtttccagtttgggactattatgaataatgctgctgtgaacgttggtgtacaagtttttttgtttgtttgttgtagagatgggggtcttactatattgcccaggctggggagtaagctattcacaggaaagatcatagctcactacagcctccaactcccaggctcaagcgaatcctcctgcctcagcctcctgagtagctgcaactacaggcacatgccactctgcctgacttgatgtacaagtttttatgtggacttgtttttaattatcttgggtatatacctagtagtggaattgctgggttatttggtaatgctatgtttaactttttgagagacttccagacttttctgaagcagctgcaccattttacacccccaccagcaatgtatgagagtttcaatttctccaacacttgttatggtctgcctttttaattacagccatgctagtgggtgtgaagtagtttctcattgtgattttgatttgcatttccctaatgactagtaatatcaaatatttttcctgttcttattggccatttgtgtatcttccttggagaaatttctattcaatcctttgtccatttacccttatctgactcgggggccagagctcttcccagtgagtgatgcccagggtgagattttcttttaaactgggctcggtcagggctctggcatttccagacctggctatgttcctgcctagtcttgtgaccctgggccacttaacctctctgagccttccttgtttctttctttctttctttctttctttttttttttttttttgaggtggagttttgctcttgtagcccaggctggagtgcaatggcacgatcttggctcaactcaacctccgcctcccgggttcaagcgattctcctgcctcagccttccgagtagctgggattacgggcatgcaccaccacgccctgctaattttgtattgttagtagagacggggtttctctatgttggtcaggctagtctcgaactcctgagctcaggtgatcgcctgcctcagcctccaaaagtgctgggattacaggcgtgagccaccgtgcctggccgagtcttccttatttccatcagcattgcccagagactgctctgaggccagccattctgtgataagaggcccatgtggtcagagaaggctccccgctcgtttggggagtcttagtgcatatgcttacagttcagcttctgaacagtcacacagttaggacatctatatgaatcttttatccaatatataaattgcaaatgttttctcccgttctgttttgcccccacttttttttgagatggagtctctgtcatctgggctggagtgcagtggcacaatctcggctcattgcaacctctgcctcccgagttcaagtgattctccttcctcagcttccttagtagctgggaatacaagtgtgtgccaccacacctggctaatttttttttattttttaattttttgtgttttttggtagagacagggtttcaccatgttggccaggctgtttttttttttttttttcttttcttttcttttttttgagacggagtctcactctgctgcccaggctggagtgcagtggcgcgatcttggctcactgcagcctctacctcctgggttccagtgattctcctgcctcagcctctcaagtagctgggattacaggcacctaccaccatgcctggctaatttttgtatttttagtagagatggggttttcctgtgttgatcaggctggtctggaactcctgacctcaggcaatctgcctgcctcggcctcccaaagtgctgggattacaggcgtgagccactacactcagccttaaatttttttatgtttaattttttctttttttgagacggagtttcactcttgttgcccaggctggagtgcaatggtacaatcttggctcattgcaacctccgcctcccaggttcaagtgagtctcctgcctcagccttctgagtagctgggattacaggcaccttccaccatgcccagctaattttttgtatttttagtggagacagggtttaactgtgttagccaggatggtctcaatttcctgatctcgtgatacacccacctcggcctaattttttgtatttttagtagagatggggtttcaccatgttggccaggcttgtctcgaactccagatttcaggtgatccacccacctcggcctccgaaagtgctgggattataagtgtgagccactgtgccaggcctttaatgtttaattttttagggacagtgtcttgctgttgcccaggctggagtgcagtggcgtgatcacagctcactgtagcctcaaactcctgagctcaagcaatccccctaccttaacctctccagtagctgggactgcaagtgtgtgccaccacatctagctaatttttaaaacaatttttttatagaggcggagtctccctatgttgcttacgttggtctagaactcctggcctcaagcattcttcccacctcagcttcccaaagtgctaagattacagacaggagccgctacagctggccatcttttagtggtcgcaccactccagcctgggtgaccctgtctcaaaaaatgaagaagtaaaaataaataaaaaatgaatctctgaaagataacaatgttcctcaacattagtcatcccatagcatacccagaaaacttgacaataatcccttaatgttgtaggataggatcttgcacttgagaatttaaataagatctaagaataaaaatattactacaaaattcagctaattatgacagttcttcagttttcttaagtaattagccctcaggaagttcctctacttgaaaaaatgttactcccaacagtacccttaatcccatgagaatcaaaagtgctcttccaatcccagcattctcagtcttacttgaacaggtctagtagtggcgttttaaccataacctttcttccaccctgcaaaacttggtctttcattttctttgacacacacatccatttccaacctttgcttagtggataaagtgaaagattaacttacgacgtttgccctcaatttttagtgaagagagaattttggggaaaatcctactcttatctgagattgcataaatgttcagagaaacgtggaaaaatgaagagaccctgccagcatatcttctcctcttccagctcttcggggatgcaagctgttggtccctatcctgtgtttggctgactatgcctacccttccggtacagtactgggggtttcagggcaggtgagcaaggctgctgagggagaaatggaacatagaatttagagactgaggctgggtgcagtggctcacgcttgtaatcccagtgctttgggtggccaaggtggaaggatcacttgagcccaggagtttgagaccagcctgggcaagatggtcaaaccctgtctctacaaaaatacaaaaattagctgggtggtgtggctcatgcctgttgtcccagctacttcggaagctgaggtgggaggatcacttgagactgggaggcagaggctgcagtgagctgagatcatcgcaccattgcactccagcctgggtgacagagtgaaacttttgtctcaaaaaaaaaaaaaaaaaaaagaatttggagactgaaagacactggagagataacgatactgtgaacagatgttcagttagagagtctgtgctgctcaaaatataggagatttggggttgagcagactcaactgtgtgactgttccgaggcttaaccgtaagcttatacattgtgactccacaaacgagatggtagactttgattacatgggcctcttatcacagaaatggctggcctgggaggggtctctgtgcactgctgatagaagtaaggaaggctcagagagattaagtcattcgcccagagtaatgagactaggtgctagcatggccaggtctggaatgcaagagacctggaacaatttagtttaaaggaaagtctccccctgggcattcttcactggagtcccatgggaagacctctgtcccttcagccagaaacccttagtccaatccaaggtcactttacattttcagacctccagtatattcatctgggaagcagggatagcaatatcctgttaccagctgtattccagctgatagaaggagcagctaaaatggatgggtaagttgtttatcaaccttgaattctgattttgttgaattttctttctgtttttttgagacagagtctcgctctgtcatccaggctggagtgcagtggcgcgatctcgactcactgcaacctctgcctcccagattccagcaattctcatgcctcagcctcccaagtagctgggactataggtgtgcgccaccacgcccggctaattttcgtatttttggtaaagacatggtttcaccatgttggcgaggtcggtctcaaactcctgacctcaggtgatccgcctgcctcggcctcccaaaatgctgagattacaggtgtgagccaccacgcccggccttctctgtattttcttgaagtttgctgagcttccttaaaaccctgagttctctgcaagaagaaggatgatgacttatggtgcctctcactggtgaggtccaccttttctgcaattttgagcacagtccaaggccttggaaaagctttgtttcttgagtctctcaaataagaacaacaacattagcttttctgggagggccaatggctgtgctgtgatggggcatggatgctttctcagaggtactttccccctaagctttaggcacgtctgaccatttcttctgctttggtccagtgctttcctcatgatttagactctggatgaaggtgtttttgaagtaggtttacttgctgctgtcatcctgtgtcacctcactctctgtggcctggaagtgcagggtttcaggcctggctgtgggcggccattatatgacaaagggttcagcgtcccctgcatctggtatgatgccctctctggtttcaccacctttagtcatcattttacttggggtgtggacatatttgttccaggagcttccccaccctctacaacttattggagggataaattgtcctaatgttttcttctggtgtttttaaccatgaaatcttagacctggagtagatttggttaccaaatagcctaaggagagaggacataatatttgatttatgtaagatccaggaaatgaggaaaggcacggtgccatgagctgtgcttccagccagaccttattaactttcacaattctttatgcaaaagagacaacttccaggtgttgctaatggaggtatctcatgacctagagacaaaaccaggagcagcttccttctatttctccaaatccaaaaacgattgctagggagttagaccatggcccagctctgctttgagaaagggaattttgcttttgagatgattgaagtgctttaaattcctcagctgagaaatgagagatgtacagataatgagacacacggaggctttgccgcatcagacttcatgagcttggagaacatgcaggtgctcttctgacctcttagctgtttgtcaggtttctatgaccaggcaggtgttaccagcactaatgtttagggattcagctatattttagcttcatttttatgatcctttttttttccagacaggatcttgcacaggctggagtgcagtggtgtgatcacagctcactgcagcctcaacctccctggacactcagttgatcctcctacctcaccctccccagcaactaggactacagtcatgtgccatcacgcccgactaatttttgtattttttttgtggagatggagttttgccatgttgccagactggtctcgaactcctgggctcaagtgatccaccctccttggcctcccaaagtgctggcattacaggcatgtgccaccacacccagccaggatcctctctttagtcacgtctttatctcttcattcatgtgacgatcttttcttgagggcctgctttgtgcaaggcatcgtgcttggtcctgtgagggatatggaagtgaacgtttcacatcttacccctaagttgcttactttagaggagaaggtagggctgagaagaaatatctaaaacataaagtgtgaaatggctttgttgagtttatgagttgcatgtaagaagtgagtggattttcctataaaagcacaaccaagatgattgctttctggacagtgagaatgcttagagcacccagaactgcttctaaggactcagagagagttgagatgtctgtcataaaatgaccttgctgttagcctttttcttgggtcagccaccattgtacccacattcccacttaatatagaccatgtctctctttatctcacccaaagtttaaataacagtgaaagatgaaatcagattggtggagacctggaagcttaattttcctaatggttctctttccaaattacatctggccgaggcaggaggatcacttgaacctaggagttcgagaccagccttggcaacataggaagaccctgcctctataaagattaaaaaaaattagccagggccaggtgcagtggctcacatctgtaatcccagcactttgggaggccgaggcaggcggatcacctcaggtcgggagtttgagaccagcctgaccaacatggaaaaaccccatctctactaaaaatacaaaaattagctgggcatggtgcgcatgcctgtaatctcagctactcaggaagctgaggtaggagaatttcttgaacccgggaggcggaggttgcagttagctgagatcgcaccattgcactccagcctgggcaacaagagcgaaactctgtctcaaaaaaaaaaaaaaaaaaaaaggaaaaaaaataagttgggcattgtagtaaacgcctgtagtctcagctacttgggaggctgaggtgggaggattgcttgtgcctgcgaggttggaggctacagtgagccatgatcgcaccactgcagtccagcttgggtgacagagcaagatcctgtctcaaaaacaaaaagccggcctggccaacatggtgaaaccatgtctctattgaaaatacaaaaattagctgggcatggtggcacgagcctgtagtcctagctacttgggaggctgagcaggagaattgcttgaactcaggaggcggaggttgcagtgagccgagattgcgcctctgcactccagcctgagcgacagagcgagactctgtctcaaaaaaaaaaaaagcaaaaaacaaatttcatctgagtgtgtttcatgtagttggtgtgatctacatccctccttttgttcttattccgatctttggtttggagagcaattgtgaggaggcatgaaatgtatctggagatagctatgagctgcagcctgctgattttcatgtaattcttggctacttgccagtatggttggggttaaactgtttccagggtaggaaaaacacgaacctagcattttgatatgaaaacaaacaaggctactttgtacttgatgaagctcaagttgcagatccagtgagagcccattaactattggtgaaggcccactgacagtgttgagtttcagagacccctgcacattctggagatggcagcgaattgttgtgcagcctacgaaagtaataaatatttctgcagtgattgtcaacaacaaaatgattttcttgtttggggggtggggaggcaagaggcagaaaccttaggaagctgttgcaaaccagtttcagcttctgctacttttatttctttccatttaaagctgggtgcagtggcacatgcctgtagtcccagttactcaggagcctgaggtgggaggctcacttgaacccaggattttgaggctgcagtgtattatgatggcccctgtaagtagccactgcaccccagccagggcaacataatgagaccctgtctctcaaaaaaaataaaagactgaggctgcaccaatgacatggggtggagtcaggaacctaggactctttctggcccactttggagaccgagagcaggattctgtgaggttgaggtcaatgactgggaaagccccaaagttctcatctgtatcttccttccacctcccccaacctctgcaataaaacaaaatcaactccaagattgaccatattttagtagtaaatatcaaacaagcaaaatgagggcctaaaatactccactaaaatagaaattcctatatttgatattcatgctgctactgtaatcatcagaaagaaaaactgtgctggtcaaagatactcactcattagatgtgtacatgtgtagggccttgacattctacccccaactaatctttgcgtcatctttttctgcctttggacgtatgccccatgcgtccttgtttccatacttttattcatgctctgctctgcgtagtgtgctcattttatccactgaaaccctacgtattatttcagtatccatctctttggggttttttagtttgtttgctttttgagacgaattcttgctctgttgcccaggctgacatgcattggcatgatctcggctcactgcaacctccgcctcctgggttcaagcgattcgttctcctgcctcagcctcccaagtagctgagtttacaggcatgtgccaccatgcccggctaatttttatatttttagtagaggctggttttgccatgtttgccaggctggtcttgaactcctgatctcagatgttccacccaccttggcttcctaaagtgcttgagccattgcgcctggcattagttttttgtttttttttttttttttttttttttgagacggagtctcgctctgtcgcccaggctggactgcggactgcagtggcgcaatctcggctcactgcaagctccgcttcccgggttcaacgccattctcctgcctcagcctccccagtagctgtgactacaggcgcccgccaccgcgcccggctaatttttttttgtatttttagtagagacggggtttcaccttgttagccaggatggtctcgatctcctgacctcatgatccacccgcctcggcctcccaaagtgctgggattacaggcgtgagccaccgcgcccggccagtttttttttttttttgagacagagtctcgctctgtcccccaggctggagtgcagtggtgtgatctcggctcactgaaagctccacctcccgggttcatgccattctcctgcctcagcctcccaagtagctgggactacaggtgcctgccaccacgcccggctaattttttgtattttttagtagagacggggtttcaccgtgttagccaggatggtcttgatctcctgacctcgtgatccacctgcctcagcctcccaaagtgctgagattacaggcttgagccattgcgcttggcctcgtttgtttttcaagagaaaaggtctcactctgatacccaggctagagtgcagtggtataatcacagctcactacaacctcaacttcttgggctcaagtgatcctcctgcctcagcctactgagtagctgaacctacaaggtgtacgccgccatgcctggctaatttcttaatttttgtagaaacagggtctccctatgttgctcaggctggtcttgaaatcctggcctcaagtgatcatcccacatcagcctcctgaagtgttggggaaccactgtgttcagctcttgataaaattttctttgaaaacaaaaaccttctttggccattctgtccctcaacagcatcccttctttgttttcttttttctttcttttttttttttttactggaagctgagaggatcatccagcatctcttctttgagctcctcttgtgtgactgtgtttgtccctcgcctcaccatgtttatcatagagtgcgtatgtttgtttctgtgtaactaactaaataaatcctccagggcaagactgattcatccaacagtacatctttgttatccccacagcacatcctgggtggactggatgcaactgtaaatatcaggtcacaagtaagggggaagtgacgattaatatcaaaatcctatctgcatatgtgtccaagccattttggagtcatacagacctggttgagattctggctgcactgcctattaggtgtgtgtccttgaacgagttacctaacgtcactgtgtaaaatatgagatgtcaccatctgttggaatcttccctctctgaaatacatgatttgatgtttagcaaaggattacatactgcagttaagaaccgtttacctaactctctttcctgaaagactcagtagtaggaaagcaccatgggtttttatagataccttgtggaagagataagctctgtgacttgtaaaacgccttgtcctgcccagaagcaggagaggtgtgtgttttcttgcctcagcaggcctgctacatgcctgcctttgtccagccccaggacatagataaagctagtgttcttggtttctagcagttaagcaacctatagtgtttctgcctggcagagttctgggtttgggatttatccccttgcattccccaaaattattacttcaggattcttttgttaatgcctagcctcacacccatgacatgaagatgtctcagtttaacttttgttgtgacactcatgttggtttgaggtttgagttagtattcattctctcctttcttgagttagaactctgaggcatttaaatgggtgcgtgcccaaaccggagaaagataagaaagatctcttatcttagacattctgtgtctgcccagcagcctctgctcaaagctcctggaaataaaatggccttacgcctggagattatctcctaccctagaagcctggcagttactgtcctgttctgacaaactctctttcttcagatcccttgattgtaaaataagatacccctagaccttcagccctagtcgccgtcagcctcagttgaccagatggcaaaggtgtgggaacagctcaccaggttcccaagagccatgtcctaggaaggtctccagcctattccttgtgtgtggatctgttgtgcattaggaacagatgagaactttagggctttcccagtctttgacctcatagaaccttgctttccaaagtgggtcagaaggaccctaggaccctgacttcacactccagaacaccaccatcatatccagtgtgcatggcagtctcataaacagggttccagagcgctgaccagggacctgcctgtctgcttaacattcacctgaccctcagttctggtttttgctgtttgttttttccttgtttgtaacttctgatattctaatagctgacgcctgtgtgttcataaaggaaagagcctgtggagccagagtcttcactcaaatccttgctgtctcacagccagctgtgtgaccttgggcaagttacataaaccccatttgcctccatttctgtaactgagtaatagggatggtaatagccacatcatagggttgttgtggctgtgagatacttagcatggagtctggctcatggtcagggttgaacaaatgattatctctcccctaccccaccccagaatttaaagattataaatatatagactgcctacaaaaatgttgccaaaagatacttaaacaaattttctacagtaaaagaatgaattcaggtagctgtgagcatgtatgtttttgcagtatgtcttaaattaatccggtacggcacagtggttcgtgcctgtgatgtcagcatttgaggatgctgaggtgggaagattgcttgaggccagggattcgagaccagcttgggtaacatagcaagactccctatttaaaataaaattttagggaggcacggtggctcagtcctgatgtcctggctcataaggaggcgaggtgaagcgttcgagaccagcctgggcaacataggaagccctcatctataatgacagaaaaaattttaaataaaaatttaaaaagttaatctgaggccagacatggtggctcatgcctgtaatcccagcactttggttgaggtcaggagttcgagaccagcctggccaacatggtgaaaccccatctctaataaaaagacaaaaattagctgggagtggtggcgcacacttgtagtcccagctacttgggagtctgaggcagggggatcgcttgaacctgggaggcagaggttgcagtgagccaagatcgtgccaccacactccagcctggttgacagagtgagactctgtctcaagaaaaaaaaaaaaaagttaatctgaatccaaagggtagtatttccagcagtactatctctgggggttctctgaattgcagaggaggagactgcctcggtagaaggatatctcagatgctgcttggggccataagtagttgttaatctgcaacatttttttttttttcttgagacggagtctcgctctgtcgcccaggctggagtgcagtggcacaatctcagctcactgcaagctctgcctcccgggttcactccattctcctgcctcagctcccaagtagctggaactacaggcgcccgccaccacgctggttaattttttgtatttttagtagagacggggtttcaccatgttagccaggatggtcttgatctcccgacttcgtgatccacccgcctctgcctcctaaagtgctgggattacaagcgtaagccactgcgcccggcctttttttttttttttttttttttgagacagtctcgctctgtcgcccaggctggagtgcagtggcatgatctcagctcactgcagcctccatctcccaggttcaagtgattctcctgcttcagtctctcaagtagctgggactacaggtatgtgtcaccatgcttagctaatttttctatttttagtagagatggggtttccccatgtcggtcaggctggtctggaactcctgacctcaggtgatctgcctgccttggcctcccaaagtgctgggattacaagcatgagccatgcccggccctttttttttttttttttttttttttttttgagacagagtctcgttctgtcgctcaggctggagtgcagtggtgtgatcttggctcactgcaacctctccctcctgggctcaagtgtccctcccacctcagcttcccgagtagctgagacaacaggcatgtgccaccatgcccagctaatttttgtattttctgtagagatggggttttgccatgttgcccaagctggttttgaactcctgggctcaagcaatctgcccacctcagcctcccaaagtactaggattacaggcgtgagccatggtgcccagccaacctgcaacattttgacaacataatcctgcttaattctaatttagtatgacttcctttttttttttttttttaagttggtgaattcagcattgaatttaattctgcattggcaggcggatgactaaagtcatttgaagaaggatttaccctacctttggctcatcatgtatgaggctggatcacgtacataggagaacccattttttcaggctagcagaaattgttaatgatcatcttgcttttcaaatggcaaagctgactcctttgtcactaggttgtagtaatatttgtataacatggcagaaagtgaactcactttcctgggaatgcctgaatttgccaactcaatctctttttctcctcacccctcagatatcagcgcttagtgaacgttagtgaggggctgtaggcaagaagttgatagaaagaagctgttgtcagcagtcacttttttagaatatattgtattgtactaggtgtaatgccttgggttaaatgctgccttgcacacaagaatttataatctgtgagaagataaaaatagacgaatgctgattagaaacactgtcttgggtagcatcataaaaggatgattcattaggaaatcaggaagtctataatgcaattttgatcatttaggttgtatttttacaagtttttttttggatttctagtaattttgttgcaattccacttctgagatcatcactgatgaatattatttagaattatggggccaagcttagtggctcatgcctgtaatcttaacactttgaaaggctgaggcaggaggatcacttgaggacaagagttcaagcctggacaacatagtgagaccctgtctctacaaaaaataaaaattaaaaaaacttagctgagtgtggtggcgtggtggcgtgtgcctgtagtgccagctttttgggaggatgaggcaggaggatcacttgagcctagggtgacagaacaaaaccctatctcttaaaaaaacaaaacaaaaaaaaaaaaggaaggaagaaaaatatggaacacttcatagcccattagagcaaggtttattgtgtgttttggtcatagtggcatccccagtgcctaaaacaatgcctggcacactgtaggcattcagtgagcgtggagtgagtgaatgaatggtacacttatgccatggcactctttctggagaatttcaggtgccagtctgtcttgttagatcagtgcagattacattgcccatgaggggatgaggatgctgtttccatcagtttgattgccaaagttagtgctgcgtatgttttgtggttctcagtggttgccagggaaccgaggaagtgaaaggaaggggttgaaagcagcctcattgctgttccctgggcggctgtgccttgatgtccagccttgtctgtatggcagtttggcctggttgtgagagtggtgacaaggcctgggatagactgaccatgtcttgagaatatgtatgtgctgaagaatggcttcccagtccccaaacaccggcagcagcaggagccacttcttttacacatcagccaccttttcctctagcaatgaagctgtgatccattctttcagtgagtctcaaggaaatggttcagccagtttggcacattcattttcttgtcaggaaagtcaatgtgaccttgaccatcattggggacctgcggtaaacacgttgtgtgtctggctggattctaatgatcaaacagtgcttttggcacctcactgtgctgtacgtgtcatgtgctcctaatttattgtcctaggttgggggttataggtactaatttgcaagaatcatttctgacttacatggatcatgcccagcacagtgccactaccatggaggccttggataagtatcatgaaagaaaattgttgcagaaaatgaaaggaaagatgaaatatacttgctttgagtcctggacagtgtaattaatttgtagctgaggaagttattgaaaagtaactttttgtaatcccagcactttaggaggctaaggtgggcagatcacttgagcccaggagttcaagaccagcctgggcaacatggcgaaaccccatctctacacaaaaaaacaaaaattagctgcgcatggtagcacgtgcctgtggtaccagctccttgggaggctgaggtgggaggatcgcttgagctcggaaggcagaggttgcagtgagccaagatcatcacaccactgtactccagcctgggtaacagagtgagaccctatctcaaaaaaaaaaaaaaaaaaaaaaaagtaactttcgatttataaagctcctctgaagattgttctccttgagtcatttctggaaatccgaacccaaacatggaccttttgtgctgtgcaagtgttgtctttggtagaggattcaggccgagggagagctgctgtgacctcctgtttcagggagggtagccagaagggatttggcttacaccaccgactagggaaagtcagagcaggacaccatccccagggcccttgcttgtgcaaagcttgcgttagagaactcttgtctccctgagctgaacttagtgaagaaagcacgacaaacctaaggcggtgaacttttctgaaccaagagttggtttaaatatagatgatctgcctttctggcaacttggaggctgcggtgggacttgttgtaccttttataagacaagtgaggaaagatgttggcacctgtacttgcgcagtttgtttatgaaatataaactctccggtggaagcgagggctcgaaaggtcagtgtccaaggtagcgtgtcgtaccttagctggggaaaaggtgcctctccaagcccccgctgcgaattgcctcattccctagagaaagttgggacagccaggcttcatgtcctattatttactgagcaccgactctggcaggggtgggggtggaaaagtttctgtgaaactgacagacactggacttgattttctttcccagggaggagaaacaatactctaggagctacaaagtcagtccttattcagagcagtgttcctgttttcagctttagagacttgatttatgtaccccccagcctgcttagagccaaggggttgcagcagcctgctcccatctgcagcccccaccatcctcccacagtgggctctggctctaggtgggtccagggctgggcatcgcgggtctgcagcacatcctcctcagtattccagtgcagctgtctgaagttttttctgctgcgcctgaactgatgtcatttcccccttggcagacagcttcggctttgctgcgtctgagatatgtcacgagaaggtgggggtgggccagagccaggcagggggagtagcgaggagagcaggagacagtgtgcctgctcggtcccaggactctgtttactttgtctgctttgctaaagaaggccggtgaaccaggaccaccgcacacacaggcccaccaggggcaatgctcattccaagaccttaacttttaagagccctttgttccaacgttagtgtggacgatgctcttgcaggatgcctttccttttgggtcttagacaggtaattgtttctgcacggatcgggtttggaagggaagaaggggtgggagcttgtttattgtactactgctttgggtggagggaatattttagcaaatgcctctcagttagaccaggccagctcccacacagaactttccagtctcccttcttgtttgctagttgctccttactttcagagccaccgtgttcttaaccctctacgtccccgaggtttctctagggctgaccagttctgattttccatcagacactgtaaaactgctttggaaacttcacggagaaacagctgaagaatggggctggggaaggggagaggcagagtgcgattcttgctccaaaccccttttattccttctccattttgatttggctagttagtggagatttcctcacagtcctctggttctgaagggactctgtgttgggggtggggtgagggctccgttcttcttttaaaggaaaggctttcttcctttcaagcatgtgcctggggctgtgcagctgagggacgttcccgacgcctcaggggaaggggtgtggaattgaccccattttggccttactgaccagtttttcaaaaagacccctgtggcagagacttgattgctcggtgagccgccctttgaagtgggagcactgcattcattccagccggtaaagcagtgtggaatgagagaacagtagcaagccaccaactgctgtctgctgagaacacagctgttgccaactatttgttccagggcttctgagagtcagacacccccaccccctcttcgtctgagaggcatgtctgtatcggaatgtgtaactgtaaccagcagctgctggccataaggggtggggagggagcacacaccctctgctgcctgttcctgggtgaggaaaagccacagatgagctcacagcagaagccctagaggggagctgctagggaccactggttgccctcactctgagaaaagtgctaggtggacaactctcccttgagttgcctacagttctgttcaaaggaagctcctctgaaaagccccaaacattccattacagctcttgttatcttcagagtgttgcgttgacacagctgatgggcagagaggtgaccactctgaacatcccttctgcccccacaagaaaggctgtccttttttttttttttttttttttttttgagatggagtctcactctgttgcccaggctggagtgtagtggcgttagctcactgcaacttctgtctcctgggttcaagcgattctcctgcctcagcctcctgagtagctgggattacaggcatgtgccactatacccggctaagttttgtatttttagtagagacggggtttcgccatgttggtctgactggtctcgaactcctgacctccggtgatccggccacctcagcctcccgaagtgctaggattacaggcgtgagccactgtgcctggccagaaaggctgtccttttaacctatgggcagagtgagccctggagaggatttcaagcagtgttggaaataggatgaagctggatgaagcgtctcatgctgtgtcagcaggctggtagggtgaaaactgcctaacagagtggaaagagtgggctgggagctggaaagacctgcgttcatatcccagcttccctgaggtcttgggcaggcccttaactgttctgaacctcatctctgaggtcacacagggattccacgaaagaatgtatgtgaacgttagcacctgggctggtagagagtagacataactcttactttgatctactcattcccaaaggatgcaacactgcaggggtgcaggaaacgagaagcgaagggactgataccttgacaggagccaggtgtgctgggcaggagcccacagccaggggagtgagctcttgcatctgtagtcagtgactgccattgtgcagtgacgtacagctgggaggccacctcttactctaccgagacactgttaatcttatatactgaggtggcaagagggcgagggcttgtgtccagttacttggacatgtagtgagagaatgaagcagtgggtagcattaaactcttcaaggagagtgaagggttgggatggttgttttgggaaggatctgagaggatcaacagcaggtgaacctttagctcttgtgtctgaacagttgcctggtggaaggcagaatttagaagacctccgaaggcccttcctgccctaggcttctgtgactcaaatgttgcctgtacaatcttggagtagttttggttacatattttgtatatttctagtattttctgtcagacagtgtaactatgttctttattggagccatgtagccttctaaagatcacttggtgataattctgtttaagaaaaaatgacacataatgcacacacacacacataaaattcatctttatcgtacatatgtatgcactttgatttatttttttcccttaatccatatgattgttttttccccttaatcctgtgtcttatgtggtaggattattctgtttgtacagaggtgcatgctgaggcttagagaagttaagccatttgcccagcattgctcaattgtctagagaaagggtaattgaagatttttgttgctgttttttaacttgagtctttcccaaatcctggatttttctcactacctagactgtgcggctcaatgtctgagagtagagtatgattaatgcattgttctccttggggcatgtttctttctagcctgcctaggtaggagataaaatgctgcttaccccttaatcccagcttttcaggaggctgaggcaggagaatcgcttaaacccgggaggggaaggttgcagtgagccgagaggccccaccattgcactccagcatgggcgacaagagcgagactccatttcaaaaaaaaaaatcattcttgttgagtctcgttcttgtcacccaggctggagtgcaatggtgcgatctcagctcactgcaacctctgccttccggtttcaagccattctcctgcctcagcctcccaggtagctgggactacaggcatgtgccaccacgcccagctaattttttgggtatttttaatagagatggggtttcaccatggctggccaggctgatctcaaactcctgacctcaagtggtccgctcgcctcggcctcccaaagtgctgggattatagacatgagccaccaggcccggccaaaaaaaatgtagattctttatgtctgggccagggccccagaatatgcatttctgtgaagttccccaggtgtttctgatcccggttgtttccggccacactttgagagactgtcctccagagctgggcggcatggaaataattacaagccagcatgctgagactacaacagaggaacgcccagggactgggagagcagagcgtgggggcaggtatctgaatcaggctaggagaggctttcctgagaagccgatatctgatctgactcttgaaggatgaggaggagagtttaccagacatgtgagttggggaaagagcattccggacagatcaggttgggagagttgtttttgttttcttctgcagatgacaagggaagctgtcattcatctcttgagtcttggcattgaatttgcctggggcaagataaggaccttagttcaccaggtatgggtgtcttttatgggtaccaagaaggaggaagacctcagggcccttctttctaataatgagcatggcatgatttcagtgtctgtaaagggcagataaactgtaggatttattagttctttcatgcaagggacagttagacagctcatggaagctacagtgttgactaaaaaaaatgctttttgtgcttagatgagccagagctcagaagaagatagtcacctggtgaactttttgggtatggcactatataccaaattttagatataacaaacaattaggcatgctatccctttattatctgacaagatcagaaaataggttttctggttaagagaaattccattatgtgtacctaacaaagggattactaattttcggagaacagtattgcaacagaatgttcttagtcatgatttgaacgaattctatttcatgtttatccagaagatattgattgggtaatgtcgaaggtttcttaggagcaacactcagcatctgaaaagtcctgtgcacctgttctacccaaagcatgttgtggatacaaagaggtataaactccatccctgccctcaaggggtttacagtcagctagggaaagtagaataagtgcacaggtaatgaggacattctgcaggtggtagcaaatgacactagaaaagaatagaatgccgcagttcagaggtgtgaagaggcaacccttctgcaggtggcccttcccacagtccaatccagtagtatcagttgttgcactataggtgctaggtgtgtggaaggaccagtgggtggtaagttctagttgatggaatgcaggctagatccattaagacactaattttacatcttgcaccttggaatattgcctttctcagtgggaaagacccattgtcctccaagttgtccacaccagtgagatgggatgatccctgatactggaaatgaataatacccatcaaagccctcttagggtcccttttccaggttggaatttgtcatggaaagaggcacagggggcaactcctggcccaaggggctgtttgtatttttgaaagggtgagctggtccctgggctgatgccgaatgtgacaaggcaactagaatgttgcatggtacttactccctgggcataggaagtggctttagagtctcacaaggagagcagtggaaaggctgtgtgatagccagctaaagctgcagggtggagccatgactgtggagagggaagggggggaattgccggcttccaatttaacccctcaactgctgaatgttagccagcattgacttggggtatttattatttcaccacagcggccacccatgagggaggaggtcttatctcctttttgctgtaaggaaactgaaacccagggagaagttatctgttccagaacccagggctaatgtgtggcaggaggggcctggagtacaagtcttcttggtgtctgtctgcccctgcccgttgctctggcttggtacccatatccacagtccactgcaggcctcctcctccctgcctgctctgtgcacagcagaggaccgaatgttgactaccagttgctgttaccctcgggcccaacctctttccaccaggttgaggacaaattaagcaagatcttgcttggaaggaaactagctgtatatagcagcaaacaccaaggtgacacttgtttgtgctaccaaaagttgaagccagaatccttatctaaactgatttgtgaaagtcttgtgacagctccacagaacacctcatttccctactgtcaccacaggtgagaaaggtggtgcttacgcaagccctttcaggttaattttttttggggggggtggggggagggatggagtctcgctcttgctctgtcacccagactggagtgcagtggcgccatcttggcttactacaacttctgcctcccaggttcaaggaattctcgtgcctcagcctcccaagtagctggtagcacctgccaccatgcccagctaatttttctatttttaggaaagatggagtttcaccatgttggccaggttggtctgaaactcctgacctcaggtgatgcacctgccacggcctgtcaaagtgctgggattacaggtgtgagcaactgtgcctggcctcgggttaatttttgaacccccaaccatctctgttgaaagaagctgcttttttttttttttttttttttttgaggaacgtggcttgtttttcattgcatctctgttatcagagcaaagagaaagtgtactggacagtaacttagtggaaaagaggactgtgcctgctgattttgaaacattatccaggatggagccaaagaaaacagtcacttcctccagtgatagcccatgagtttgacccgccccctcccaccccttttccatgaagaggtaaattttagtccaggaaaacagaatactttggggctatttaaaaaaatgctttgaaatcccttcttctgccctaattccttagcactagtaagatactagtttcttacctcttcctctctagggcttcttgactcttatttcttgctaatttgtagcaacagtgggttgaaagagccctgagaatggacctgcctgagccatttctgtgcccctctgtagccattgtttctctgggcagagctcacctgaacttgaaccccagacctcacaagaggcttctattgctggttgctggaaatggtgataaaatcctgtgaggggaggggcagtgcagggaaggagacttggctttgggaatggctggagtgtgacatactgacttcttttcctgaaagtggctgagggtttgccgggactgtgttgcacataagacttcggtttcctctggcattgcatcaaggaggccagagtatttattattgtttggttttcttgcttaacacacaagacttaaggatctcccaactgtgatgcacggtctcgatgtggtttcaaatactgtccaattgatcttgtggtttccatcgagggtgtgaaatccctggttacccaccaggcaggcagtggtttgaatacctgtgatctcccacccctctgggtgtggttctggagtgccgtgggaggttaggacaggctggggcggaccgccagcacaaatagaacatacagtcattcctgcgtctctgtgtaaggttccagattcatgggccaggctcggcttgtgctgggttactgtaaaccaggatgagagagccacagccagagagccacggttcattctcgcactggtcatgtgaaaatcacacccccacagccttgccttaggctttgaaggaccccttcatgctgctgcttgtaccatgtagctaagaggcacgagggatgaccagctcctatggttacttgactcagcggtcgctaggttcaggactttgtgaagggtttttggccagggtaggtatgcttgtgagactgacatcagtcctgcccacggggaatttagagcggggtggtggcagggagtctgtgaggcactcggagaacaagactggctaaaacacggttctgtacaaaatattgtgctgcagtttggctaaaacaggggctctaaactgggacagttttgcccttcccccataggggatatttggcagtgtccagacatggttagctgtcacagctaggggagtaggaagttgctactggcatatctagttaatagaggccagggatgttgctaaacatcctacaatgtacagttcagtcccgtatgacaaataattacctgactccaaatgtcagtagggctaaggtggagaaaccttggggtagaaaccacagactcatagtagtccactctgcttgggaagcaggagtcacaggactgagggaagaagtaccatattgttttaataaaggggaaataggtagagctttcctgctgccttctaagcagtgtgtgttcattatctgcccagaaatttagaattttcacattggttgttcctttaatcactaggtactctgtcttattaatgacaggtacagagtcattttttgtgggccagtagatatgaccaagcccatctgaaatatggatatgaccaagtccatctgaaaagtcggatggaactgacgtttcatcccttactcaaataaccgggattactaccccccaggaggagaggatctcagtggtacccaaatgactttgtacatacaacttaaagaaaaagcaggcatagttattttagcagcagcccatatttcaagccaggtacctattgctgtgggttgggtttattgtaatctatcattagtaacatactaacacccccactcccccaaggttttctacatcactgaagtctattttaatcttaaagtccaagctctcagagttccaaaagttcttgtttcttttttttttttttttttttttgagacagagtcttgctctgtcgcccaggctggagtgcagtggcacaatcttggctcactgcaagctctgcctcctgggttcacgcctttctcctgccccagcctcccaagtagctgggactacaggcgcccgccaccacacccggctaattttttgtatttttagtagagacggggtttcaccgtgttagccaggatggtctcgacctcctgatctcgtgatctgcccaccttggcctcccaaagtgctgggattacaggcgtgagccaccgcgcccggcgaattttttaaatttttaatagagatgaggtcacgcttttttgcccaggctggtctcaaactcctgggctcaagcagtcctcccacttcagcctcccaaagtgctgggattgtaggcctgacccactgcacccagcccacttttttttcttttttttttttttttagggcggggacagagtcttgctctgttacctgggctggagtgcaatggcacgatctcaggtcactgcaacctccgcctccaggttcaagtgattcttccgcctcagcatcccaggtagctgggattacaggcacccgccatcatgcccggctaaattttgtattttgtagagacagggtttcaccatggtagccgggcagatcttgaactcctgacctcaggtaatctgcccaccacagcctcccaaagtgctgggattacaggcgtgagccactgcgccaggcaccagcccacttttttttttttttttttgagacagagtttcgatcttgttgtccacccaggctggagtgcagtagtgcgatttcggctcactgcaagctccacctcccaggttcatgccattctcctgcctcagcctcccgagatgttgggactacaggcgcctgccaccacgcccagctaattttttgtatttttagtagggatggggtttcaccgtgttagccaggatggtctcgaactcctgatctcatgatccacctagctcggcctcccaaagtgctgggattacaggcgtgagccactgcgcccagcctcagcccactttttaaaagttgaaaaacaacggtgccatgtaggcatagaactcattagtgggtccactggggcttaagggccactagtgcaatccccacttttaagaggggagaggcagtgatacaactgtgggaagaaaaggacctacttcatggcaccaactgtgagtggatgacagtaggctaaactgcccctctgctctgcctgagtgccacctgctactcacctgctccgctgcatgctacctgctatttcagccctcagctctctgcaccagcccttgctaaagaagccatgcttctcaatggacttactctgtagcagaagaggccagtgatgaggaattcctggggactgcttttccttctaagtgtccaggggtgaaagagtggtccatgaaccagggtccagtgcctctgtagcctgccagactccacaggcctgcatgccctgggacattgacaagtagaccttaataaaaccatgggatatgttgcaacttccgatttttgctgtgggattttcctaccagggtcaagtagctttttctgaatttgttattcaggttcctaatagcaacacaggaaatggattttaatttttttgctggctgctctgtttgggggctgtttaatgaggatgtagttgcagtgcagctttggcagtaacagtactggtgtggatgggagcgtagctaacatgtcacttctttttaaaatttatgtgtatgatctattatatgttttaatggaatgaggcatagagagtataaataatgtgccttgattctatgtaggtactcttgtgggtaactgtgttgggacacgtttgggattctagaaaacgaatatgagtctatttcatgtttagagagcaggaactgtttattgtatgttctttttagatccagggcagtggttctcaagcttgaatatacataaacataaccaggggagcatgttttaaaaggcggattttcagtccctgcccctagagggtctcagtctatctacattcttgacaaatatttcagatgatctggggcccatggaccacacttttgggaaacacatccctattttgttgcatttgttgtctaagcatgttcattgttatgtgggggcaaattcacttatttataagatgcccttattgtcctgattcactgtgttgcccttcctcagattcttgactagtgttagtctttgggagggaccagaccagattgttccaggatgccctgtgggttgaagtcagtggacctctattgtccccactactacccctgggactcccctttggggaccatgacactgtgggctcatcttgaagcagcagccatctcttttgatcctaggcttttcttacattggtcacaagctccagtctttggctttactctttagggtactctatagctaaagcatgggggactgggtcctcttaagcccagggagctggagtccagagcccttaaggagtaaaccacactatcagatctgagggatgaggctgaaccttatcagaagatttactggcttggttaggggaacctacccatgtagcccaggctatttgttcttttggaaaactactgaattcagccaaacagcataaaaatccattcctagtgtcccattgcatgcaagacaaagtcttggttaacttcttagcagtggcttgccctttatggggaaggatggaattgagtaagctcttttagccaaagcttatggaataattgtcaggtgtggtatatactagaaaggatacgaaagtagtacatgacaaccccaccatcaaagaaagggagattagactgggcacagtggctcccgactgaaatcccagcactgttggaggctgaggcaggagaatcacttgagcccagagtttgagaccagcctgagcaacgtagtgagatcctgtctctacaaccaataaaaaaaattagctgggtgtggtggcgtatgcctgtggtcctagctaattgggaggctgaggtgggaggattgcttgagcctgggaagttgaggctgcagtgagctatgatcgtgccactacactctagccttggtgacagagtgagaccctgtttccagagggggaaaaaaaagagaggggagactagactaacacatgggaagcaataggccaggactcctgctgcatcatcccccttcttgagcttactttcttcatcctcagcccttctgtactctccttctacccaatttgaaaatgtgtgcccttgaacagttctctttatttccctcaggtctttgaacagtctaaaaaaccaatagtggtcaggcacggtggctcacgcctgtaatcccagcactttgggaggccgaggtgggcggatcacctgaggtcaggcgtgcgagaccagcctggccaatatggtgaaaccctgtctctattaataatacaaaaaattagctgggcgtggtggtgcacgcctgatgtcccagctactcgggaggctgaggcaggagaatcactggaacctgggaggtggtggttgcagtgagccgagatcgtgccactgtactctagcctgagtgacagagaccctgcctcaggaaaaaaaaaacaaaaccaatactatcagggagaacgtgatcttaactttctttctttctttttttttttttgagacagtctcactctgtcacccaggctggagtgcagtggtgcgatctcggctcactgcaacctctgcctcctgggttcatgccattctcctgcctcagcctcccgagtagctaccacgcccggctaattttttgcattttttagtagagacggggtttcacagtgttagccaggatggtcttgatctcctgatctcatgatccgcctgtttcggcctcccaaagtgctgggattacaggcatgagccaccacacctggctgatcttaactttctaattgtaaaaatataggtaaaaatataggtgaatacatgaagctttgcctccttaccacctacaaatatgtttctaaggacctgggcttgaaagtgctgcattttcagaacttgaagattctatctaggatagaacaaaaatagctgattctaagttaaagttgtttgctgtcttatttagccatttcaaatgtctgctttatgaaaactgcgttatcctttagctacagagcattaccaaaatcatttagaactttttcctagtagatatgcagtgctagactttggtctcctttctagaaagccattcctggttcaagaatggaaggaaagtttgttttgttgcttactctgcaagagcagccacaacctggctgggggggataaataaaggctcaaggtaaagaataagtatgagagttgcaaaaatatttatatatttattcaagtctccaccataacctaagggagggactagccaaagccaacaatgaattcataaactgtggtactttggagattattttattttattttattatttattttttactgagacggagtcttgctctgttgctcaggctggagtgcagtggcacaatctcggtttgctgcaacctccaccgcctgggttcaagtgattcttgtgcctcagcctcctgagtagctgggactacaggtgcgcacaaccacgcatggctaattttttaaatatttttaatagcgatgggttttcgccatgttggccaggctggtctcgaattcgtaacctcaggtgatccacctgcctcagcctcccaaagtgctgggattacaggcatgagccactgcacccagcctggagattattttaattgttatacaaagcctatgagatctgacctcagctgaattcttagctcccctttcacactgctttccctgagatcactgtactcagctacactagtcttctttctcttccttgagcacaccaagcttgtttctgccctggtgtttttgcgtggatttgatatttcttcttcctggaacactgttctcaccggtctggttaagctggctctttttcagcagtcagggctctactcagatgtcacctactcagagtggcctttcctgaccaccctatctaaaactctttgtctcattatcgtgttttattatcctcatggagcttattactgctagtgaaattataattttgcttgttaattgtccgtcttcccaactggaacatatttaaaaatctttttgcctttgtcactctgcagtttcatacagtgtacctaggtgtgggcttcttattatctggaaattttgtatctttttttttttttttttgacagtctcactctgtcacccaggctggagtgcagtggcatgatctcggctcactgcaacccccgcctctcaggttcaagcgattttcctgcctcagcctcccgagtagctgggactacaggcgcccgccaccacgcccagctaattgtatttttagtagagatggggtttcacagtgttagccaggatggtctcgatctcctgacctcatgatctgcccaacttggcctcccaaagtgctgggattataggcatgagccaccacgcccggccgaaattttgtatctttaatcagtcttatatagaaaatttttagttatccctttaaatatttcctctcctccattcttttcttctcaagcttctttctcatttttcatttccatgttttctcttgtagaagcactttgatggtaattttctcagatctgttctctagttcatcaatttcctctttaacttggtctcctctctgtgtgacccatctgttgagttttttctttcaataactatttttctacaagttttatctgcctgttactatttcttgtttggtagtgttcttttcttgtgtttttaattctttctttttggctttaatcatttgagatatgcttgtatcttatagggactttttttcagggggtcttatcctgctatttgttgaatttgtcatcttgtttgtaatggattagttttgcatacatttttatattttggattgtgagcttatcttcaacagaactttatttttatttttatttttgagacagtctctcactgtcgcccaggctggagtacaatggtgcaatctcggctcactgcaacctctgcctcccgggttcaagcaattctcctgcctcagcgtccggagtagctgggattacaggcgcccgccaccacgcccagctaatttttttgtatttttattagagacaggatttcactatgttggccaggctggtctcgaattcctgacctcgtcatccgcccgcctcagcctcccaaagtcctggaattacaagcgtgagccaccgcgcctggccaacagaactttatgtgtaggaatcctttgtgccgtggctgagggtagatctgttcagttttgtatttctgccagatgttgcaggtttattgccagcctgggactactttttgtgttaaatttttggcttggggatcctcagaccatgtagtagtacaattcaaatctgaaataatctgtgatcacacattattagaggagatactgttttcctcccacttcagagtttttattgtcactatgtgccagtgggctaatgttttttctaatctgttctccccctctgagggcgccagctttgtactggttctcagttccaattccctgtttcaggtgggcccaagatcaacaaactaccccactttctaggtcaactggaaaggcctgatctcatttactactgtggtttctagttcccgctgtcgtttttggtcccaggtgatcctccttgctttcttgcaagttcagctttgtaattaaaagtgattgttgtatagccagggttttatagcagaataatttttagttacctacccagctatattgccagaagcggaaactctcccctcccaccccccgaatctcttgcttattgctatagctatagcatcccacatagtgcctggcacatggttgggggaagggggtcaatacatatgtgttaaatgatttggagaactgaacatttccattaggaattagttcttggccaggcacggtggctcacacctgtaatcccagcactttgggaggccgaggtgggaggatcccttgagcccaggagttcaagaccagcctgggcaacatgaggagaccctgtctctatttaaacaaacaaaaaaagatttagttcttcctgcagggaaagccagaggtgatgctccaaattaattcatatccagcagccaagatatttggtgtcctgtgctttagcatcccaggaaggacttcaattcttatttttcactcttaaactttaaagtgttttcctaaggacatgacgctgttgccattagccagttgctagcagagttttccagacccataaattggcagattaaaaccatgcctggggaaacattactgcccagtgtgtctttttatgctggcacttagaaagtttttacgctgattaaattgacctttacagtggctcagctaagaatagcaactgtaagatgtggaaactgttgaggaaaatgttgttagtcccacagtttatactgccaccaaagagaggagataattttttgcatatgtgcaaaaggcatactgtttatcctttccagtgtaaaaatgttttttccagtttggtgttggtcttgcttgtctcttctttatgcctttgttttctgtttggtaaccatgtgtgccttgtctctcagagctggtcactgtggcaccggggctgaaggcacatacctgtaatagatggggctcctagtagccactaccacggtcattcccgaggtgaaaggcctcgcgtaagcgcattcattatgcaccaaagttcctttttgacaagttgtacatttctagctttctggggttttgttttagccatggagttttgtgcaaatgaaaacattgccaggaagatgatatctttaaaatgcaagtatgatcttgttacctccctgtacagagtggtccccacctacctaactttcctatctactacttctaccatctccttctagccaaaagggctttgcttgtagcgttttctctgcctgcgatgttcttccctgtcctcttcctagttacttttttttttcttttctttttttttttttttttttgagacagtgtttcgctcttgttgcccaggctggcgtgcaatggtgcgatctcagctcaccacagcctccacctcccgggttcaagcgattcttctgcctcaggctcccaagtagctgggattacaggcatgtgccaccacacctggctaatttttgtatctttagtagagacggggtttctccatgctggtcaggctggtttcaaactcctgacctcaagtgatctgcctgccttggcctcccaaattgctggaattacagacgtgagccaccgcgccgcctagttactgactttttaaccgtactgtcaatctcagttcaagcttaccttcctcccagaagctgttctggaccttcttgaccagttcctgggtcttttactcactgtcacctaatctgcacttttccttcccaacatttattgtagtcgcagttttatctgcgtaagtattttaccatctttcattagactgtaagttccgtgaggatggcctaaacaatataataatgtgtaatgtgctttgaagatgcttggaagaaaagcataagctaggtgtggtggctcatgcctgtaaccccagcactttgggaggccaagatgggacgattgcttaaggccaggagtttgagatctgcctgagcaacatagtgagaccctgcctctaccaaaaaagtaaaaataaaaaagccagatatggtggcacatgcctgtagtcctagctactcgggaggctgaggcagaaggatcacgtgagcccaggagtttgaggctgtagtgagctacagtcgtgccactgtactccagcctggacaacagagcaagaccttgtctccaataaatacgtaaatagtaaaagcataggataatcataaagggtgctgataatttttcatatttgacctttccattgcattctttccagttcctttttcttttcttcttcatgtgtctggagcagcccacattgccacagagaacttggctgttctgaaacaattctgagtgaaggcaaagtgctttttggatggtctttcatgctcagcaatagtggctcacagaataatgttgatagtaggagcccagagaatttaattagcccaaggtcacacagttaatagccctactgtaaaagctgggctttgaacccagatccagctcactcttttttttttttgagacagggtctggctctgtcacccaggctagcgtgcagtggtgcaatcatggcttgctgcagcctcaaccttctgggctcaagcagtcctcccacctcagcctcccaagtagctgggactacaggtgtgcaacatcacacccagctaattgtattattatttttttggttgagatggggttttgccatgtccaggctggtctcaaactcctgggctccagtaatctgcccaccttggcctcccaaagtgctgaaattataggcgtgacccaccacacctggccccagcgaactcttaactacttaggctttgtgtagatcttaagccaccgggaggtgtttgagtcctaggtgtgcaacaattaggctcctcatataaggaggggtggaagatcaccaggcagcatttccacaccactgttctttgctgtggatttgcatgagaggagacatagatttcatgatatcttgcattggcttgaggctgctatgtcagggtggaaaggggatggggaggataataaaaccttaaagttgaaggagacggctgggcgtggtggctcacgcctgtaatcccagctactcgggaggctgaggcaggagaatcatttgaacccgggaggtggaggttgcagtgagtcaaaatcacgccactgcataccagcttgggcaacagagtgagactccatcctccccacccccacaaaagaaaatttaaggagacattacaggtgatcttaaccagacctagggccattgagtaacttgcctaaagttcatttctgtgtagtgatagagctgggatctacaaaaattagccgggtgtggtggcgtgcacctgtagtcccagctactcaggaggctgaggcaggaggatcagttgagcctggaggtcgaggctgcagttagctgtgatcaggccactctactccagcctgggcaacagttagactctgagtgaaaaagaaaaaagtaggggggtgcgaggagagctggggccaaacccaaggctcctgggttttccataccactattgactgacaccagcatgtctctctgaaggaactcactttggcactcatatctcactatctcctgaatcctccttcacctcttccttgctagaggtacaccttctttcgtaccgctgcagcagaaaatgacagttcccataaccaagactatcccaggcagctcagggactctgtatttagaggagggagaaggaccacaggggactagatatatagatggccacaacttgtgatggttcaacttagtgatttttcaactttatggtggtgcaattgatacatgcagccagtagaaatcatttgtttttcatttttaatacagtattaagtagatgacatgagatattcaatactttattgtaaaataatttgtgttagaggattttaccaaaccataggctgatgtaagttccgagcagtttaaggtaagctaggctaagctatgctgttcagtagattaactgtgttaaatgcatttttgactgacgatattttcaatttatgatgggtttaccagaacatgaccccatcgtaagccgagaaacttccgtactgtgttaaaaactgtttgaggaacactggattaaatgatgcttccactgttctgctctccctgggaaagcggaggcagaacggtgaagcagagtgaggtcttgtttattccaggccccctgcctcggtgcacagaagatccgagagaaaagctgactgacagcagtaggtcatgaggatgccacttgtttagatttcaaatgcattccactctatgtctcacttaagaccagttgacagccatgtgttccgagcctgggctgcctctggtgaattttcctgagacagaagtgtcattggattctttcttgtgccaagtgtaggcaccactgcctcttttagaaactatgtggacactttgaactgtgctcttttaagccagtgccggaagaatggcattcgcagggcctggtaaactggggagaaactttctgatgtttttatgaaaggcatgttttgctctgaagtcaaagagtgtgtgttctggccaaagtagcaagcatagatctgctttttccacacgcaccaggcttcagaggagaagttgactagatagccagtgtctcattttgtttgtggtgggcatgggatggtgaaaacggaaggaggaagaagtacaggggacaagatatttagatggtccacaacttgcgatggttcaacttaatggtttttcagctatgatggtgtgaatggcatacatggccagtagaaatcattctgtttttcacttttagtacaggattaagtagatggtatgagaaatccaacttgatagccagtgtctcattttgcttatggtggacatgggagggtggtggtggggcggcgggggaaggagcacatagaaggaactctgcgtgcaatgttgtgagggcctcattgtcagggtttatgaatttctcgtttccttctttctaaactgtcatatcagaatgtaaagtttttaagaccaagaaacacctaaagatttatggtggaaacgtgcactaagccggggaactggttttcagtcctgtgctttctcttgtcctctccgtgtggcttcaggtgccagtcctgtttctgcccagcctctagccctgtagacagtcactggagtgcctggtgtatacccttggccaagtagacagtgtagtaaagcatggcccagagaggaggagccgaccatgtgacttcagtttccactggcagctgtccgccggatgtgcactgtgggcagggccagcctgagttgccgcaaatactgtggctttagtttatttgctgagcagggcttttttccttcttaactctgagcttcttggggataaggacaatgtcttattcatctttgtatcccttgaacccaacacaatgcttggcacaaagacagcgtccagtaagtgactgtgttattgtttagaatgaagaaatgttgaaggccacatatagcagatgccttacaggtttcgtcatctgcatagtggccccaagtacattttgggctgaggttaacgttggtctgggaggtattttatatcttacatgtgaaacttttttttaaagttcccctccatcctcatccaccagtgctgtggacagaatttggcagacagctagatggccactcagtagtgccctttatgtgagtgtccctgacaagggacagtatgaatcctggatccagtcaggattctttttcaataagcaaaaatgatctagcagattgaaattagactgggttatctgagcagttcggccctttattgaaaagtaaagaatttcagttgtagattttttttgttgttgccctctttaggatcacactgtgaattaaccttggagagaaagtgttttaaaaagaagaatggaataactgagcagatgctaatcctagaatacataccgctttaattattccaggaagtttcacagaaaagccagttttatttaaaatgtactgctaattaccagggaatcatcaccctcctaccggctgaggttagcaccggaacatgaaatgtttctacttggacctaaagtgaggcagcccttgcctgtcctgtctgaggaaaacttcactctgccaattgcttttgtgtcctgaatctcctctcctctttaataaaccatattttttcccctaaactctgttgttgttgtgtaaatcttttaaagttttttttgtttgtttgtcttttttattttttatttttgagatggagtctcgctctgtcgcccaggctggagtgcagtggcgtgatcttggctcactgcaatctctgcctctcttgttcaagcgattttcctgcctcaacctcctgagtagctgggattacaggcgcgcaccaccacgcctggctaatttttatatttttagtagagacgggatttcatcatgttggtcaggctggtctcgaactcctgacctcgcgatctgcctgcctcggcctcccaaagtgctggcaatacaggtgtgagccaccgcgcctggccaaagttgattttcttaatggaataaacattgatacaaactgttttgggggctggtgaatagacaaccaggaggacaatgatgagaaggaaagtgttcaaaagctgtcatttaatatgctaacatgcttttttaattttttaggataaggaagcctgtgtgggtaccaacaatcaaagctacatctgtgacacaggacactgctgtggacagtctcagtgctgcaactactactatgaactctggtgtaagtccttgcttgggtgcctctcagtatcccagggtcccagttactgcctctgcttagtgggaaactctgggcattagcccttttcggattctcttggggacagtgttggtgagtggaatctgtttatgggttccagaagtgcttcctttgtagaggaagagagttctggtgctctttggactttgttagctgaagactagagaatatggtcttagccaggtctgctgcagaagctcttgcctgaggttctcctggctgccctctccattgtgtgctgagcagctgacaacaacttagatgcttccttgggccctcccagaagcccaggtttgcctttctttttttttttgacggagtctcgctctgtcaccaggctggagtgcaggcgcaacctcagctcattgcagcctctgcctcccgagttcaactgattctcctccctcagcctcctgagtagctggtactacaggtgtgcaccaccatgcccaactaatttttgtatttttaggagagatggggtttcaccgtattggccaagatggtctcgatctgttgacctcgtgatctgcccgccttggcttcccaaagtgctgggattagaggcgtgagccaccacacctggctggcttgctgtttttgcagagagaggttgcaagccaagctactatgaatgccaggccactctagatggtcactatgccattttcttgtaaggaccacaggggcttccagaatttcccatagaacctcatggagtgcctctgtttctgagggtccttcggaaaggaacagtctttccctaggtccttgcctatagaggaccttctggagaaagggagtcttgaggctcagctccttttatttcttacccagttctcacatggaagttcctggaggattctccagtgtacctaaccttttactgtcagctaaatcccatgtggaggctgggcacagtagctcacgcttataatcccagcaccctgggaggccaaggcatgtggatcacttgagcccaagagttcaataccagcctggctaacatggtgaaaccccctctctactaaaaatacaaaaattatctgggcatggtggtgtgtgcctgcagtcccagctactcaggaggctgaggcaggagaatcacttgaacccgggaggcggaggttgcagtgagccgaggttgcgccactgcactccagcctgggcaacagagcgaggctccatctaaaaaaaaaaaaagaaaaatgccatgtggaaaccatctttgtcttgccactggtttgactgaagccagaaccacttgcttcttcaagttgcacgacagtggtgatggtgttagggtcttcagggagtgacccaaggttgcttcaactgacactctttgtactctgaccttcctggaactcagacgagacagtgtaggatgctggacaaagaatgagagggtgttgggggggtggtgcttaggacagcgaggccccaggtgactgacattgccgtagttcttacaattgtctcttgagaaaggagactgcaggcggtttccccagatgattctaagccctcatcactgcctccatttggaaacagacttcgggtttgtcaaaccatgaccttgcccccaccatcctatctgcgcctttcccctttctcatcccccccatcaacccctgtgtcagtgatatggcaagaaagcagccagaaggactattgtttggtccagaaaggaaattagactcttggctgggaggtctgtccatctgaaatgcagttgtatttgtagccaacaggagtggttcctccaaacaagacctctccctcaccctcgcttttcccttttgaggactgaggacgggctcatctgcctttctgaggaattccaggagcagtccagtgcaggagagcacaaggctcaagatgtccccaccagacctgcagatatataagcagcagtgaaggagggcacagtcattgttgctattttagaaggggtggggctgagaaacttactagaggacacacagtgccaagcaggtagacagactctgtttaaatgttttaaaatgcagataaccacagggttcaaattctccttcccaccctttgttaaaacaaaagttgaagctgggctgccaaaaagccacagagctgtagtttgtttttctgggtcctggccaggcggcatcagttgtgaaaaggaacgaagttgctcatggccccgtctcagattgacagagcctcctgggcttttggcagagccgactcaggagccacctgaattgggtcaccaaagccagggcaggggggtggagtggtggggacagggagacccagagggcaaggaggtagtctgggaaagcaggtgcctcaccccaagggcttaaagaaagtcagagaaagagctgcatgaacggctaagtgtctctctagctacgggcgtttaggaaaggaggcccagcagagagcagtgtctagacggagagaaaaggtgccccgttaaatgagctggcatgtgttttccacgttctggaggcatgggagacataaaagcaaaacgcccttctcaggaagtcctccgatctccctctttattgaggtcatggcttctgcctggtgtgtatgggagggaggttgatgttggaacaaacacctgaagttctcatcaaaatggcactttttgttgctttcaaccctgttccctctaactgcctctcaactttgcctgaagtgtgaaagtcacgggctttgggctgatttccttcccaccttcctttggaaagaaaattcctcagccaggaaatcctttggcagagttttcatcagacagggcaactccttaactatagttgcctacaggaaaggcctccgggaaaaaatgccatttctacccaccctttacctctactaaactgcattttcctgtgtgctgaggaaaattctcaattctcacacacatacttacacacacacacggtttacacagacacacaagcacacatagacctgagctctggccggcaacctttcccacatgtcttttcaatgtttcataacccaaaccagttattgggcctgcatgtgttgagaacggcagatcctgtttaataggggcagtagttgaggctattaaggacctgatcgttgttagtattatctccatgcatttttacggcacctgtactttaattcatcattccatcagttattcattcagcaaacccttattccagtgctcttgaactttagcaggcatcagaatttcctgaagggctaccgaaaacacacacttctgggccctactcccagagcttttgattcaaaactgagaatttaaaaacctgagaatgtgcaattgtaacaagttcctagttgatgctgtgacctcctctgggctggaaactggagagacagaattcttaccttcagaaggtaatccagcggggaggggataggatgtgcattggcccaaaccccaaagccactcctccctgttctcatcctggggctctctccactcagcaagctacattttccagggagagatcaaagttgggaatttctgcccttgagatcatttgggagaatttcacccaggcatcagtttcccctggtttgggctttaggagggagaggggtatgtttctggacagtggaatttccctgaagtgacacaaaacaggctattagcaaatcctgtcagtgctgcccaactcgtttttcattttttattctctctctttttttctttctctctctctttcctttccctccctcccatctccctcctcctctctcccctccctctccactcttcctctcccctccctccccacttttcctcccccctccctcccacccttccctacccttccccccacccccacccttcccccaccctgccacccctcccccaccttcccacccttccccccaccctcccctccccttcctccaccctcccctacccttcccccagcctttccctttcccccttccccctcctccttccaccttctccttccttccttccttccttccttccttcctctttttgtgtgtgtgagacaaggtttcactctatcacccaggctggagtgtagtggtatgatctttggtcactgcagccttaacctcctggactcaagggatcctcctgcctcagccacttaagtagctgggactatgagtatgtgccaccatgcccatctaatttttgtatttttttgtagagataaggtttcgccatgttgcccaagcttcgttttttacctgccgtttttttttgttttgtttttagtttgtcttaagatacccattgttagcaagagctcagtaaataggagttgattgaatttccagtgccaagaacagaacctaaaagcagactttggacttgttcctaacctgtgtttcttttttccttttctttcttgagacagcgtctcactccctcgcccaggctgaagtgcagtggcatgatctcgcttcccaggtccaagcgattctcccacctcagcctcccaaatagctggaattacaggtgtgcgccagcatgcccagctaatttttgtatttttagtagagatggggtttcaccatgttggccaggctggtctccaaattctgacctcaagtgatccacctgcctcagcctcccaaagtgctgggattacaggcatgagccaccacactgggccctgtgtttctttatggaatactttttgggggttaaaagggaaattgaaaggaaattttaaaggaaaccctgcccatctatggttaagcctgtaacaacaacaataaacacactaagaacttaccatacatcaggcatagttctgcgtatactacatatattaactcatttagtcctcacagtgaccagataagttagagacctttattctccccgttttacagatgagggaagtaaaaccaaaatgaccaaggtcacaaagctagaatatgtgtttttaagctgggctttgaacccaggccatctgccttttctcttccacgtctgcagtcatgcttgtaggaaagttggctgggctttcagaagaagttgcgagtctctgacgtcttcatttcccaaattcaggccttttccactgtggcagtggcaggagctcttgctgagagcaaggaagggccaggggagccagtcacccaccgtcctgcaggatgggaggagagctcacttacagtatgcttgagcctcctaatggggaatttcctgccagttgaagagtggtgttttcccaagtttgtagtgaactcttggggtttgtagtgtagtcatggggcacatgactcagttcctacactggactgtgattgtttttaaaaacatgttttccattttgcttagcatgacaaatgcaccccacagtgaactcacaattttcaaaacttgtctttgaggaatgtagtctcttggtaggtgtgtgtttgttggggaaaggagggtcatatttctgtctctggtgtgtcttttgttgggttttccttttttttttttttggaggcagggtcttgctctgtctgttgcccaggctggagtgcagtggcgctatcttggctcactgcaagctccgcctcccaggttcacgccattctcctgcctcagcctcccgagtggctgggactataggtgcctgccactacgcccagctaattttttgtatttttagtggagacgaggtttcactgtgttagctaggatggtctcctcgtgattcgcccgccttgtcctcccaaagtgctgggattctagccttgagccaccgcgcccagccaggttttccttttttttaaagttttcttctttgtgcttacttcagcagcacctatactaaaattggaatgatactgagattagtgtggccccggccaaggatagcaggcaaatttgtgaagcactccataaaaaaaagtaaaaaatgtaaaaatgaactttcttccttggttttgaaatctagctaaaagattaaaatttttcctaagttggccaggtgtggtgactcacacctgtaatcccagcactttgggaggctgaggtgggtggatcacttgaggtcaggagttcgagaccagcctggccaacatggtgaaatgccatctccactaaaaatacaaaattagctgggtgtggtggtgcatgcctgtagttccagctacttgggaggctgaggcaggagattcgtttgaacccgagaggcggaggttgcagtgagccgagatcacaccactccactccagcctgggtgacagagcaagaccctgtctcaaaaaaaaaaaaaaaaaagcccttttttttttaaaaaaaaaattatacttctggttcagtgaatctagcctttttctggatcaaggattcctttaaaaatctgatgaacactttaaattctctccccaagaaaaacttgtaatcacactgcagtagtcaggataggctaagttgtgccacaggaacaagcaagtccaaaatcctagtgacctaaaaacagcaggtttattcctcactcacactgtgtgtccatcgaaggttggatgagagttttgtttccacttcaccatcctctgggacccagactgatgtgaaatcaccatctgggatgttgccagttgccaaaacagaaggaagactaatggagggtctcatattagcaagacacattttggcctctaagtgacatatatcacatccaatctcaattcattagttagacttagtcccaaagcctcacccagtcacaagggggtcaggaagttcaagcctacccacatgcctagaaggagaagaagcagaaatacttggcaaacatgaaaaccaatgcatgagattttctttaaaacggggaaaacaaaacaaaacaaaacaaaacaaaaacaaccatgttggccaggtgtggtggctcatacctgtaatcctagcactttgggagccaaggtgggaggattacttgaagccaggagtttgagagcagcctgggcaacaaagtgagaccacccccctatatctacaaaaaatttaaaaattagccaggtgtggtgtgcacctgtagtcctagctactagagaggctaaagtgggctccttgagcccaggagttggaggctgtagtgagttctggtctctactgtactccagcctgggtgacagagtaatacctgtctcaaaaatttattttaattaaattttttaaaaaattgtaaaagctgtgaaatagatcatatatattgcagtataaaagttagaagttggtttacctttaggtagagaactattgaaaaaatgactggtggccaggtaaaaaactagtagagttagatgctggctatcttttttttttttagagatgggatctcgctgtgttacccaggctgacctcacaagaagcaatcctctcatctcagcctcccaagtagctaggattttagttgtgagccactgcgccaagcagatgctgattacctaacgggagaatgtacttttaaaattttaaagtttggccatctctggtatttcacacctgtaatcccagcactttgggaggctgaggcagggggattgcttgagaccagagtttgtttgagaccagcctgggcaaccttgtgagacctcatctcaacaacaacaacaacaaaattagtggggtgtggtggtgcatgcccgtagtcccagctactcaggaggccagagcgggaggatcacctgagcccaggagatcaaggctgcagtgagctgcgttcacaccactgcactctaccctgggtgacagtgagaccttgtctcttaaaaataagttaaaaaaaattggcctggcacggtggctcacacctgtaatcccagcactttgggaggctgaggcgggcggatcacttgagctcaggattttgagaccagcctggccaacatggtgaaaccctgtctctactaaaaatacaaaaaaaaaaaaaccaattagatgggtgtagtggcacgcacctgtagttgcagctgctgaggaggctgaggcacaagaatcacgtgagcctgggaggcggaggttgcagtgagctgagttcccttgccactccagcctaagcgacagaatgagaccctgtctcaaaaaataaataaataacaataaagtaaaaaaaaaaaaagttataaagtaacacagaagtataatggactgtgagattacactgagaaagtaagagaagtataggtaatacaaaatggttgtcagcccagaataatttagacttgactccgaaatacacatgcagccaggttcttaagcagagtgtccaccccaacaaccctaggagatgttatcaaactgcatctgtagccagtttcacctccataactcctttccagcctctccacccttctgcaagggttcctctgccagtgtctactcttaagtcagccagaattcataaagaaagaaacataagttaagcaagtttgactagtgaaccgggaaagaccaaaaaggagactgctaagttcactttatggtctctggttaggaatggattttcctgtctgctgatgggtaacagggaaaaaaatcctctgtctgttctcttgctgcaaggctgcagcatgaagctttggttgaacagcgatacccactgaaagcaattaagtgccgtggaatggtactgccagcctgccggggctggggggcatgtcactgtcctgccccacttggtggagggcagctttgtgaggagattcaatgggggcattccagggggacagagaaagagctgtcgccagatgccacaccctaaatgccaagggatcttttggaaaattgtgtatatacaaataagggggaaaaacatcaaggatttattcatttttacaagtctgttttgtgggggagggaggcatttttttctttttttaaacaaggttaacttgatttaactcattctgacaagagatacatgtggaactacttttaaaattttaaacacaaatttataattacaaagcagatgataaaaaatacacatagcatttggaatggaaaacaatggaagtttttcaagaatagagaacaaacaatattatctattctcatttagtaacaactcatcttaaaattattcctttgatacatttttagttgagaaaaaaatattctttttactacagagaagcacatgtccatcttagaaaaattaggaaatagaacaaaggagcaggtactgtctgtcatccagagttaccccatggttagagcttcctgaccatacccctcctttttctgtccatatatacttttttttttaagactgaatctcactcggttgccaggctggagtgcagtggcgtgatctcagctcactgcaacctcccctcctgggttcaagcgattctcagcctcccaagtagctgggactataggtgtgtgccaccatgcccagctaatttttgtatttatttttagtagagatggggtttcaccatgttggccaggatggtctcgatctcttgatgtcgtgatccgcccaccttggcctcccaaagtgctgggattacagggtgtgagcccctgcgcccagccatacgtactttttttaagcaaaagttaggatcatattttattttgtcatctgctttttttcatttaatatcagaaactctttgtatgtcaaaaataatattatgtgagtaattttttaatgattcatattatttcattgtatagccatattcctagaggaatttaaaaacctacccagaaattattgattaaaaaaaaaaagctagccaaagtaaaattagtcatagatatttttaaaatttaatttgttttggccgggcgcggtggctcacacctgtaatcctagcactttgggaggctgagacgtgaggatctcttgagcccagggttcaagaccagcctgggcaacacagggagaaagccaggcatggtggcatatgcttgtagtcccagctactcagaaggtggaggtgggaggacagcttgcgcccagaaggttgaggcttcggttgagctgtgatcgcaccactgtactccatcctgggtgacagagcaagaccctgtctcagaaaaaaagaaaattaatttgtttctagttttatattttgaaagaaaataatcaaaagaagaaaatttaaatttcttattctgtcatttaaagatgtcattatttttgttttcctttcagttctttccccctcgtgcgtatatgtgtatgtgtgttatgtgaaaagcaaaattcctcattaattaaaaaaaaaatttaaaagccttttgtgccacacatttaaaaattggagaggaggtcttatattggggtttgctgagattctctgagtatgatcccagagacagcacagagggaagtaaagagctgtggggcttggcctctgttccgccacccttccctggagcagggaggaagaagcggctgctaatggccctgcatctactgcaagggcaggccaaagggagggagagttgattgtggcagtgggagatggaattgtacccgattaggattatgtcgagagcagaggaaatcatttacactctctagggaggagatggacctgaggcaattagaatttttccacctctaactttagtgattcttgtattacagaggcatacatgatagagaaaagcacctgatttttttgatgctatcaggagaatcataagacttcttttgtcagggggcccctctgaggccccttgcaagtgctgatcttctgagttgcgggggaggggagatgggcactaagaaagtgaagcattttctcagaaatctcttaagagaggaggaggagaccatcccagaaggtctgcatatttaatgctcacaaaacctataatacggggggacccatcagtggtgctggagagatgccttggcacttgtgccttcccccaaggtgctggaggcgtcctggagtgagagacctgctttgctgtcatcattctgttttgttttgttttgttttgtgacggtgtcttgctcacccaggctggagtgcaatggtgcaatctcggctcactgcagcctccgcctcctgggttcaagcaattctcctgcctcagcctcctgagtagctgggattataggtgcatgccatcacgcctggctaatttttgtatttttagtagagacagggtttcaccatgttggccaggctggtcttgaactcctgacctcaggtgatctgcacgcctcggcctcccaaaatgctgggattacaggcatgagccactgcacccagccattcttttttttgagacagagtcttgctctgtcgcccaggctggagtgcagtggcgcaatcttggctcactacaacctctatctcctggttttaagtgattctcgtgcctcagcctcctgagtagctgggattacaggcgcctgccaccatacctggctgatttttgtatttttagtagagatgggggtttcaccatgttggccaggctggtctcgaactcctgacctcaagtgatccacccatcttggcctgggattacaggcatgagccaccacgcccggcctgttgtcatcattcttacattcctgcccacttctatcccatgtgtctttcactctggcacaagcatttatggaaattgatcacatggcttcaatgtaaattaactgggtgaggcccagccatgccagcttcaaccacgtgggcaccgtccagggacctccctgttccgcaagctgcccctctggctggtactcactgtgtgcctctctgtcttgccttgcccaccccccagggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcagtacgtacacccaagcccccatacccaccctcaggagctcaggtgcacagacccagggctcacactgaatattggtggccaggctcctgtaggcatagggggtttgtcctctccctgcccctccgtagagcaaggtcttgaaagtacaggaacaaggggacactccttcagcacagaggagcatgtgctaggggtgcagttccctgaagccactgggccattccaaagctcacagtggctgggttctggctggatctctgcttctttagcacctgcgtacatacctacctacctaacttcctcccttcctccctcccttccttcctccctccctctttctctctttctttctttctttctttccctgcctgcctgcctttccatccctccctccctcccttcttttccttccttccttccctccttccttccttccctccttccttccttccttccttccttccttccttccttccatccatcctccctccctctctctctctctatttctttttttttttttttttttgagatggagtttctctcttgttgcccaggctggagtgcagtggcgcaatcttggctcactgcaacctctgctttccaggttcaagcgattctcccgcctcagcctccaaagtagctgggattacaggcatgcaccaccacacccagctaatttttgtgtttttagtagagacagggtttctccatgttggtcaggctggcctcgaactcctgacctcaagtgatctgctcgtctcggcctcccaaagtgctgggattacaggcgtgagccaccgtgcccctgccctccccttccctcccctcttttcctttccctcccctcccctccccttcctctttcttttcctttctctttcttacccttcctttctttcccttccttcttccctccctcccttcattcatccatctctctctctctctttaatggcagatagtcagataatagaacaataattattaacatttattgagcacttactatatgccaggtactgtgctaagcacctagtccttctagatgtggaattgaaacaattgtgggccgggctcagtggctcacaccgggctcggtggctcagcactttgggaggccgaggcgggcagatcatttgaggtcaggagtcagttataacgtgagtgaattgagacttggggttcattggcctgaattcctcccattttgcttatttctgtgtgatatgcctgagcagaggctgccatgaaaggggcgggttggggggtggcattgggacttctgagcaccaagaaacttagtgactctctgaagagcacttcccggacttccctggggctccttacatgtgacctctcatatggtcagtggaggcccagctgtgccagttttccaaagccagtctacagtgtattctacaaaataaactttcacaattgtttctttacaattgtttctttttttctttttaagacagaatctcgctctgtcacccaggcttgactgcagtggcgtgatcttggctcactgcaacctcctcctctggggttcaagtgattcttgtgcctgagcttcccaagtagctgggactacaagaccatgccatcacacctagctaatgtttgtatttttagtagagatggggttttaccatgttggtcaggctgttctcaaactcctgagctcaagtgatctgcccgcctcggcttcccacagtgctgagattacaggcgtaagccactgtgacccaccattatttcagttccacatctagaggggttaagtgcttagcacagtgcctggcatatagtaagtgctcaataaatgttagtaatgttatattataattaaattatctgtgtcataaggcattcagcacattcaaaagataactcacctagcatgtttttaataagccttggatggcagaggccccttaccctttgccggtcacccatctgctcctgatctgagtcaaggtgaagcttggtttgtgtttccagaccacctccagccacagtagagacaacagagatttctaaccccctagcaaaagaccctacatagtgcatttggaaggttaggaggaagaaaagtagttaagaagtctgaagttagggaccctggccctgaggcctgtgggacttggatgaaggacacactctaagcaagaacatgagacttgtgtgcatgtggaagtgggtccattccaggcagaagttattttttggccatctaccacgtttgcctaattctctgccttaactcccaacaggcgtgaagtccttgcctacgaagcagctttaggggctctcagatttcaagaagctaggttaggcccttcccaaactgcccctctctctctgcagaattgctcgcagctgtctctcctctgctcacaaccaagagctgtagccatcacttgttgggtgctctggggtgggaagagacaatgcaaatattcagtgggagctttgcagtctgcctagaacaatgaccagtgcagtaatttctccttcctacctccccattttagggtttttgccaaactatttactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggttttttttttttttttggtggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaatatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgctactgctctttcttgctgcactttgttccctcttcttcttcctcagtcttcaggaaattgcacctcaagatcctaaaccacaagcacttttctccacacagagactgagaggttgtcacacagtcattgaggatagggccctgggccaaagagaaaccacagggccaagggcagctggacagtgctgctgggtccacactctgttctgaggagtcctcccctctctctgtcagggtgtgttcctgatgtttggaatactttggaaagtcccacaaacaggctaaaatcagatcccgagaaagcagagacaagttttgtcagataccctgttgctaaaacatggcttttttttgagacacagtctcactctgccgcccaggctggagtgcagtggcgcgatcttgtctcacgcagcctctgcctcccaggttcaagtgattctcctgcctcagcctcctgagtagctgggattacaggtgcctaccaccacgcccggctcatttttgtatttttagtagagacgaggtttcaccatgttggccaggctggtctcaaatctcctgacctcaggtgatccgcctgccttgagctcccaaagtgctgggataacaggccagccaccctggcctgggactataggcatgagccactgtgcccagctatttttttatttttattttttaaataacagagatgggctgggcgaggtggctcacgcctgtaatcccagcattttgggaggccaagctaggcagatcacttgagctcaggagtttgagaccagtctgggtaacatggcaaaacaccatctctacaaaaaatacaaaacttggctgggtgtggtgctgtgtgcctgtggtcccagctatgtgggaggctgaggtgggaggatggcttgagcccaggaagtggaggctgtagtgagctgagatcacaccactgcactccagcctgggcaacagagcgagaccctgtatcaaaaaaaaaaaaaaaaaaaaagaaaaaaactatatgtatgtatatatatatatatatagagagagagagatagggtctgactgtgttgcccaggctgggctcaagtgatcctatagagtctaactatgttgcccaggctgggctcaagtgatcgtactggcttggtttcccaaagtgctgggattacaggtgtaagtcactgtgcccggccaaaacatggcatttaaaagaaagcaagcactctgagagatcttttttgttgatatgatagacatgggggtatatgcttggccttggaatttaacacacagtataatgtatcgagttgcccactttctgcccagcactgtgtcagaggctcaggataatgtcaaagacatagaagatgaggcctctgccctccagaacttacagtcagaaagacaaaacatggccgagcatggtggctcatgcctgtaatcccagcactttgggaggctgaggcgggtggattacctgaggttaggagttcgagaccagcctgaccaacatggagaaaccccgtctctactaaaaatattaaaaaattagccaggtgtggtggcatgcgactgtaatcccagctacttgggagcctgaggcaggagaatcgctttaactcgggaagtggaggttgtggtgagctgagatcgcaccattgcgctccagcctggacaacaagagcgaaactccatctcaaaaaaaaaaaaaaaaaaacatacttgtgtgaaatagttaattaacaatataagttaagtttgaggtgaagtgaatggtacagatttggagcttttcagggaatagtgggaggtagtttgaggtcttgaatgccaagcaagaggtctcggagctgattttaggtagtgaggaagccaccagtgtgccagaatctgtcattgtgggccaatgattctttcctaatacaaggagagttcctttgttcattttaccatctgcttaagactgacctcttaggtgtaagtgctttttttttttttttttgagatggagtctcgctctgtcgcccaggctggagtgcagtcgtgccatttttgctcagtgcaacctccacctcctgggttcaagtaattctcctgcctcagcctcccaagtagctgggattacaggtgcctgccatgacgcccagcttatttttgtatttttagtaaggatggggtttcaccatgttgcccagactggtctcgaactcctggcctcaagtgatccacctgcctcagcctcccaaagtcctgggattacaggcgtgaaccactgtgcctggccaggtataagtccttgtttgaagaacagcttgctacttctctgcccagggaggacacccctacccagcaagactgcagatgggcaaagcaaggtagtacacatcctaggaaccctccaggaaggggttcctgcctccataagtggagtgctcactggtgggctggcacccagggggtgctggcaagtgagtgttgtcctccctaggccctggcttgcccagcagtcagcgctgttttttctgaaggccagttttagccagacatgccgccacccctgtctttgaccctctggcagaggacattcctggcctctcggtgacactagtggagtggttgctgacttgttctttctaaactgttgggttccttcaggcaaccccagtagggccatgctagcatctagagacagttctgttctaaaaccacgggaaagaactgggagtatatcattcttgcctttgagctaatatctgagtggcacaaaaacaaaatggtgtaactcttaggggctggttgccagaggctgtgcatgtaccctgggtgcccaggtctagaggggacaccatgccattgaaccccaggctggtgggtcactgagttcctcatttctgtaatgaagtatgacgttgtttgtctctgttgccccatgtgaccaagtgcagatggcgacagtaccaacgcccagaactgcaaaacagagtacttttggtgaacaagaatttcaagaaactccacattcttcagtttcctgttttcagccaggggcgaaaaccggggtttgactcggaaaaggagggagaagtgggtttggttggtagcttcttgctgaacctgctgggaagggttgtgggtcttgggaggatttgggttctggcctgggggcaagtgtggcctcactgaagagctgagcctttactgagcacctagcaggtgccaaggcatgagaattcaaagatgccttaggactggctcctttcctttttttgagacagagtcttgctctggagtgcagtggtgcgatctcggctcactataacctccgcctcccaggttcaagcgattctcctgtcttagcctcctgagtaactgggattacagatgtgcaccacgacgcctggctaatttttgtatttggggtagagacggggtttcaccatgttggccaggctggtctcaaactcctgacctcaagtgatctgcctgtctcagcctcccaaagtgctgggattacaggtgtggagccaccacgcctggccctggctcctctttagaagagctaatggtattctcgagaggaaggcaggcacatcggcagttttagtaccacatggaaagcaccacgaagcatgtgtgcacagaggagaatctagccaaactaggggattaaggcaggcttcctggaggagatacctctaaattgagtttatcaggtgaagaaaggtgcaagggaattctaggcaaatgttttttctgcagactattgagtgcttactatgtgcctggtgctgaaaagcacaaaaaagcatgggaggcctagaatgggagactctgcatggcatgtagaaagctgcgagcaatttatcactgcattctgggaagtagcaagagatcaaactggagagagaagcaggttgttttattttattttatattatttattttaattttattttattttattttattttattttattttattttattttaattttttgagagggggtcttgctctgtcacccaggctggagtgcagtggtgcaatcttggcttacggcaacctccgccccccgggttgaagtgattctcctgccttagcctcctgagtagctggaattataggcgcacaccaccatgcctggctaattttcatatttttagtagagatggggttttgctatgttgcccaggctggtctcaaactcctgagctcaaatgatccttctgcctcagcctcccgaagtgctgggattacaagcgtgagccactgcacctagcaaaatattttaatttaatttgtctttattgttttgttggttgacggtttccacaatgccagtcttgtgtgagcatcttagctacatttaaaaaaaaaaattagcctcaggccgggcacggtggctcacacctgtaatcctagcactttgggaggccgaggtgggcggatcacctgaggtcgggagttcgagaccagcctgaccaacacagagaaaccccgtctctactaaaaatacgaaattagccaggtgtggtggtgcatgcctgtagtcccagctactcaggaggctgaggcaggagaatcgcttgaacccggggggctcaggttgcagtgagccgagatcacgccattgtactccagcctgggtaacaagagcgaaactccatctcaaaaaaataaaaaaatgtagcctcaaaacaggtctctgaggtatataggctgcaattattcctgctttattaatgggattgtggcatccagaggacttaactaactttataagatcacatagctaataagtggcagagctaggatttgaagccaggtctaatggctccaaggccaatgtaataaccagaaggcaggacagtgaagagctgtaatgtaggtactcacaagccacctgaagaacttgtgacttcttcctctctctcttctcttctcttttggcccaggctggagtgcagtggcacaatctcagctcactgcagcctcaacttcccaggctcaagtgatcttcccacttcatcctccccaagcaggtgagactacaggcgcacaccgtcatgcccagctaatttctgtattttttgtagagacaggattttgccatgttgcctaggctgctcttgaactcctgggctcaagcgatccacctgccttggcctcccaaagtgctgggattacaggcatgagccttgtaatttcttttcaaaggtgagggagaactagagaacaatatattgagctaagagtaacatggtgaaagatgaaacagacaccatttcctcaggagctaccctatctcctcttgctccagggggcagacccccccacacccagccaggcttcacctccaagagcaattcagtgctaaaatggcgtcacccctgggacaggtgatgctgcttgccaccagtattcggaccaatgtcaacttccagggacggtgtaaccccttggaaacactgtaaaattctcaggagttacagtttggatcttctttgtctcttttccttgaaagagtgtttttgttcttcctccaaggtgatgaaagtacagctttctgtgtttgtgaggggagaagaggatttttgtttgacctgaaatttctcctcactctgttttgtttgtttttggcttttttttcttcctttgagatggagttttgctcttgtcgcccaggctggagtgcagtagcgcaatcttggctcactgcaatctccgcctcccgggttcaagtgattctcctgtctcagcctctcaagtagctgggattaacaagcacccaccaacacacctggctaattttttgtatttttagtagagacgaggtttcgccacgttgggcaggctggtcttgaactcctgacctcaggtgatccgcccgcctcggcctcccaaagtgctgagattacgggcatgagccaccacacctggcctctccttactctgttataagcctgttcctcaccatagcttcagattcccttcatttcatgttttttcaccaagaaggctcaagaaacccaatcccacagaaactgtgacggaacacctgtgctggagccgtgagtttgtctttgggttctccacccgctgcccggcagtccatcagccctggctctgcggggacggagtgggcaggtggcaggccaggggctgtagtgggccctgcagggatggaacggggagggtgggttccccagggttccatcctgcggagggactcatctgcacacacccgctccccctcctgaccaaactggtggcttttggggaggtttgtataaaaccctgagaaggactcatttcgtgggtttggatatagacaacgacgagaaacccaatatttatcaaggcactaaatgtatttcataggttcacatttcatcctcacagtaacgctatgacacaaacatcccagttccctaccacccgcccccgccatattacagatgggaaaaccaaggcttaaggccacctaaggtgtccatggccacgcagtctgtaaatgacaacactgggaggatttgtctctgcaacctgacttcgagtcatttgcattcccgtctgtgtgggactctcctgcccacacactcttttctgcctctcatcctcaccagagcctcggaagatgggcagcgcaggtgttaggttcccccacattatccatggggaaattgaggctcaggaagttagtgatgggcctaagatccagggtcaggaaacgggagctggggcagagcaccggggtggtctgggtccaatttatccgttgcgcttcccaccccactgcacggcctctgtgactggatccccaccctccagagaagggcgctaacatctacgagtgtgactgcagagagggctcctcatttgcctcaggttttgtggccaccagaggctgatagaacattcactcactctcaccctcccacaatagggaaggatttccctcctgtcaacaaggagactcaggggaactgcttttctttctcttttttcttttttttttttttgagacaagttcttgctatgtcacccaggctggagcgcagtggcgcactcactgccagccttgacctcctgggttcaatgtgatcctcccacttcagcctcccaagtaactgggaccagctgggaccacaggtatgtgccactacacctggctaattttttgtatttttttgtagtgatggggttttaccatgttgcccagctggtctggaactccagagctcaagagatccacccaccttgacttcccaaagtggtgggattacaaagtgctggtgtggtgagccactgtccccagcccaggaactccttttcgttttttgtttgtctgttttgagacggagtcttgttctgtctcacaggctggagtgcagtggcacaatctcggctcactgcaacctccacctagttctagtgattctcctgcctcagcctcccgagtagctgggactacaggtgcacgccaccacaccccgctaatttttgtatttttagtagagacggggtttcaccaagttggccaggctggtctcaaactcctgacctcaggtgatccacctgcctcggcctcccaaagtgctgagattacaggcatgagccacttcgcccagccaggaactgcttttctttaagacaagcgtggcccatttctcctgggagggttggctcttaatagctcactagaactgatttttaaattttcaggaattttatgagctgtttatatgaaacagccaatttaaaaaacttaaacctacaattgagttatattaaaaacaaaggtaatagatactcaaaactgatcatttcctagttattttactacatgttactgttatctgtgcccttgaggttatttacatttacctatcagtatggtggaaatactacataatggcatttactatgtaataataacaacggtaaagaacatataatgctactatgtgtctctttccaaccctgtttactggcatcacattggtagtttaaaattggtcacgttgggagtatctacaccacagtaatcagcaaacattacaaatcaaggctattccgcacacccccgcccctcccagacctggttgttaaacatttatttatcatcacatcactggttaaggacagtctgaggctcagacggttaactgtggggtcttggcaaagaccttccagttttgtcaaagatctgggcttccttctgcataaggagatagaatttatttactatcattgggccaattaaccaagtgatttagagcatttgattcagtcctcttgaggtaggaggcggggctcggacatggaaccaaattaaggactagctaaaacaggtaggggggcagaagcagctttccatgacatgcctgccagtgtgccatgtcagtttaccattgccatggcaaaacctaggagttaccatcccttttcgtggcaacgacctgatgacctggaagttactaccctcatcctggaaatctctgcataatccaccccttaatttgcatataattaaaagtagatgtccatatgagtgcagccctgcccctgcgttgctcttctgggcacactgcctctgggtagccctgctccacaaggagcagtacctctgctgctctgtgcactgcggcttgctggctaccaccactgctgcttgctggaattctttctgggtgaagccatgaaccctcctgggctaagccccaattttagggcttgcctgtcctgcatcactcttgtttgtctacccttctatttgtcaggtgctgatatgcaggataaagaacatgagaaggctcagtcttgaactccagaggtacaggaggtggacagtgtctgtggggggccccacccatttcaagtccaggcagatgctcagatgccaaggttcagtttaggttcagtaccaaggaacagaagctgagtgctgaagagggatggtcatggtggactcaggagtcataaaaaatgtgtctgagcctcaaggcaggtgggtttagatcagtggtgaaaaggccttccagacgggagagcacagtttgggcaggagtcaaagttcataaagtcattttctaaaaggtcactccgcttgcctgaaaggtactctcccggccaaatatcccaagagcccttctgcatgaccacaggggacaggtgggaaagcatggctggctccccaccatgcaccattgaaatcttgagttctggtcccagccctgctgctacgtagctgtgtgatctggggcaagtcataccctatacccagcccacacaatggccctcagtttccttcaaaatgaaggtttagacaggacacagtggctcacatctgtaatcctagaattttgggaggccaaggcagaaggatcactaggggccatgagtttgagaccagcctgggcaacataataagatccccatctcttcaaaaaacttaaaaattagccagagtggtggcacacacctgtagtcccagctacccaggaagctgaggcaggaagctctcttgagcccaggtgttccagactgcggtgagccatgattgcaccactgcactccagcctgggtgacagagtgagaccctgtctcaaaaaaaaaatgaagtccgtaggagagcttgtgggcagctgaccccagcccccatcacaagcagcctgggagagatgctgacaccacagtgagcccaagggaaaggctatactggagtttgtcccttccctctcccggttcctctgcccccatcagctgggtgctggatcgagtcaagctatcctcagctcaaagcagaggggaataagattggctggaggaaagttaagtatttcagatttgctcagaatttgaaaggctttttttttttttttttttttttttttttgagacggcgtctctctcactcactctgtcacccagttggagtgcagtggcacaatcttggctcactgcaacttccacctcctgggttcaagcgattctcccacctcagcctcctgagtagctggaactagaggtgtgcgccaacatgcccagctagagacgaggtttcaccatgttggccaggctggtctcagattcctgagctcaagcgttgtgcccaccttggcctcccatagtgttgggattacaggtgtgagccactgtgcttggcctgaaaggcattttgtagactagtgatgaagagataagcaattagcagaagatctgtgtcctctgtggaagtggtgggtgggtttaactgggatggaaaacatcgcaagtttgcaagaatctcacacaatgtcacttgaggactcggggggggtgcgcagcagtgtgtacaagattcacctggatagcctgtaaaatgcagatttccaggccctgctcccagagtgtactcaatgcatgaaagatagggaccagagtctgtgttcttaagtaagtttctcagatgagtctggctcaaggggtctgtgagccacactttgacagatactgacctggtgcatattacatctatctatatctgtttgtctgtctataggttcccatatatcttcatctctttctctctctcactctgccccccaacacacatatgcactctttcattctccaactattgaaccagaacattgaatggcaggaaagtgaaatactaatccttcttcttctttctttctttttctttagagattgggtcttgctctaggatgcagtgcagtggcacgatctcagatcactgcagcctcggcctcctggggtccagcaatcctcccacctcagcctcctgagtagctgagactacaggtatgccaccatgcctgggtaatttttttttttttttttgagacagagtcttgctctgtcgcccacgctggagtacagtggcgcgatctctgctcactgcaagctccgcctcccaggttcacgccattctcctgcctcagcctcccgattagctgggactacaggcgcctgccagcacgcccggctaattttttgtatcattagtagagacagggtttcatcgtgttagccaggatggtctcgatctcctgatcttgtgatctgcctgcctcggcctcccaaagtgctgagattacaggcatgagccaccgcgcccggccaatttttttttaagtgttgtagaaacagggcctcactctgttgcccaggctgctctcgaactcctgggctcaagggatcctcctgcctaggccccccaaagtgctggaattccaggcataagccaccacacttggcctcctgcaggctctttagcaaagtcccagggtaaatggcagatgaaggccaagaccgagttagggaatagtagggaacggtccactgccacctgattaacaaagctctttataaggaagaaggtagtgtcgtaactgaaaaccttgtcttgctccctatagggacgtcttctctctaagacttagctaggcagggtatcagccatgctctgctgacgtccttctgtctagtcagaggggaaggactgggttgttgatgacctgaccctggtctggctggcaccagggagctggggatggggcctctctctaggctaaaagggtcagtttcttccgggatgtctcaggacattcatttgcagactggccaatgaccaaggtttaaatataccagtttccagatataaaggagtcagggcttcattttctagtgaggaagctttgtttttttttttttttttttgagacggagtctcgcactgttgcccaggctggagtgcagtggcgcgatctcagctcactgcaagctccccctcccgggttcatgccattctcctgcctcagcctcccgagtagctaggactataggtgcccgccaccatgcccggctaattttttgtatttttagtagagacggggtttcatcgtgttagccaggacagtctcgatctcctgacctcgtgatctgcccgcctcggcctcccaaagtgctgggattacaggcgtgagccactgcacccagccctagtgaggaagcttttacagacttcctggggtttttgagtggggagaaggaggtggaacccaggcactgctgcagaagacagctgtagaagcccttacctggcagtgtttaccccagggaagggtgaggaaagggggacacaccagtcttggtctttgcagaccaagacagagggatggcaacggcaggtccagtctgtgggtcacatacactcccccaaggtcgaacctgtgaggtaacatgcagtgaagcctatttggatcaaaacaaacaacacttttgccctactttctttttcttttccttttttcttttttttgagacagagtcttgaactgttgcccaggctggagtgcagtggcgcgatctccgctcactgcaagctccgcctccggggttcacgccattctcctgtctcagcctcccgagtagctgggactacaggtgcctgccaccacgcccgggtaattttttgtatttttagtagagacggggttttgccatgttgggcaggctagtctagaactccacacctcaggcgatccacccatctcggactcccaaagtgctggaattacaggcacgagccaccacgcccggcctgccctactttcaaaatataaactcaggccaggctcggtggctcacacctgtagtcctggcactttgggaggctgaggtgggatcacttgaggtcaggagttcgagaccagcctggccaacatggcgaaaccccatctctggtaaaaataaaaaaattatccaggcgcctgtaattccagctacttgggagactgaggcagcagaatcgctcaagggaggtggaggttgtagtgagctgagattgtgccattgcagtccagcctgtgtgaaagagcaagagtctgtctcaaaacacacacacacacacacacacacacacacacacacacacacacaaacaaacagaaaacaaaagataaactcaatcctaccacttctcactgtttccactgctgtggccgtggtttaactcatcaacatctggctttcctggaccagcacaacagcctccttcctaactgttctcctgctcccactcccatcccttagcagaacattctccacacagcaactacggcgatctttcagaaatacaaaccagctgggcacagcggctcatgcctataatccaaacactttgggaggctgaggtgggagaagcgcttgagcttaggagtttgagaccagcctagaaaacacagcaaaaccccatctctacaaaaagtaaaacattagtcaggcctggtgatgtgtgcctgtagtcctagttacttgggatgctgaggtgggaggatcacttgagcctgggaggttgaggctgcagtgagccatgattgtgccactgcaatcagcctggcaacagagtgagaccatgtcactcaaaaaacagaacaaaaaacaacaacaaaaaaacccaaacaaaacaaaacaaaaaacaggctaggcgctgtggctcatgtctataatcccagcactttgggaggccgagatgggtggatcacctgaggtcaggagttcgagaccagcctgaccaacatggcaaaacctcatctctactaaaaatacaaaattagctgggcatggtggcacacgcctgcaatcccagctattttggaggctgaggcaggagaatcacttgaactcaggaggcaggggttgcagtgagccaagatcatgccattgcactccagccagggcaacaagagcgaaactccttctcaaacaaaaacaaaaacaaaaaaacagattgttccacttacatacttaaaatcctccagtgacttcctgtcataattagaataaaacccaacctccctcctggcctcctgtaatcccagctacagtgggaacggaccactatgtccactctgacctcatcagggcccactctccccttcactggccatgctgacctctcccacctggaggcctttttacctgcttctcagcatgcaacacttttcctgaccccttgttcaaagcagccacccactgcctctgccattttctcatcacatcacacaaattgtgattgacttcaaagcacttacgagtctctgaacttattcacttgttagccctcactagaatgtaagcttcagagaccacggagctcgagtgtcctgagaaagtgaatggcacatagtaggtgctcaataaaatcggtgttgaaagaatgagtgagcaaatgaatacataaatgaactactcagggaccttatggaaaaaaaaaaactgtttatgcacatcactggcattgccacaagctgaaaaagaaggcagagtgggttgggagtagggaagaatggcggagaagggtggggggttgtatctctaaatctgtgttgtggggccacatagggtggacaggggctgtgagttacagcctttaggtgctaccctcagcctgggcttccctccaggcctggcgcaccttgatcttcactttgaaagagtcgatcagaaagaccaccttggggatgccttccagggagggcagctgcccatcatctggcacctccaggtcgaacctctgcagcagccaggccatgatgaggaagagctcctggcgggccaggatctcacctatacaggagcgaggtcctgctccgaagggcaaatagcttactgacggtgagatgagctgggtccccgctggattcaagaaacgctctgcaggcaaggagtggcatcagccaggggttagggcaggagggaggagaggcatggttctgccctggttgagggggagacatggccctgcccagggaaccctgatctgaggatgtagccttattatgggggaacccccgcctggggagagatacagccctgctttcaggtagcccttaacgacacagaggaaatgaaatattcaggaaggatggaaaagagatggaattaacctatgaaaatagcaccatccgaggggagaagggacagacttaatggcagacagaggcgtagagggcttcttggagggtgaatttgcagttggttggaagaagagcgtgggaaacccagctgtgaagagtttgggtaagtctatggcaggatgagggtgtcaacaggtccgtatagttggagccaagagttttctagcagcaagcttggcagaggtgaaggggtactggggtggtggagcagagtccaggctcgctgtgtggcccagggcgcaggacaggacagactcaccaggcatgaactgatccggctggtgccactccttctcattgtgatgcagcgcccacagattgatgataacttctgtgcccttgtccacagcaaactcaccgatgctgctccagagtggaagaggaaaagtgggtctgggacttcgtactcccttccttgctcagcctcatgccccctcattcttccgccgtgaggaaaatgccctttactccctcattcccactcactcatgttttcctcagcttctgccagatcaaacctaaatccagcccttctccatcccttccctcctaacaggcgcttctgtctgaacacctgtgtctgtggactttggtgtctggcagtgtatgtgggtgtgcgtttggagctgcagcgcatgttatgtgcgtgctgcagctggttggaacatggagctcccagcctttcatcccagaccacatgtctctgagggcagcaggaagctcctctgggaagtcaggcagatctgtggatgagtcaatgcgtgtctgtaggtggtagagacatggagccacggggctgggggcaggatgatttttatatttaattaattaattatttattttgagacagagtcccgctctgtcacccaggctggagtgcagtggtgcaatcttggctcactgcaacctccgccgccttggttcaagtgattctcctgcctcagcctcctgagtagctgggactacaggcacgcgccacgatgcatggctaatttttgtatttttagtagagacggggtttcaccatattggtcaggctggtcttgaacccctgacctcatgatccacccgcctcgacctcccaaagtgttgggatgacaggtgtgagccaccgtgcccggccggcaggatgatttttagtagttgatggttgactgactttaggttggccagcaggggccgggggtagggggagccaggtgggctggcaagcagtgttgaatgcatcatggggctagatgtcactgggagggcaggcacacctggagtcaacgttggccttgtgggggatgagcataggggccacgggcctgaggcgaagcacctctcggatggtggcctccagcaggaggagacggttacggtcactgatagttggtgtgcggctgaaacccacattctggtcaatctcctcgtagagcttcttcttcacctgaagaccagagtaggttggaggtgactagtgtgtgtaagcccaggagaagcaagggcttagagaagaatccaactgtgacatcgagaagagcctgtccagtcccttcccagtagtggctctggggcccaggcccggcttccagaagatggggcagctctactctggggtcaaagccaactactgcttgggtaaggagcagggcaggcctagtcttcctgcacagaaagcctgagagaattggctctccctttctctggagcccagagattgggctggctggggtctaggatcaatgagggggaagcacacctgaggattgtgcagcaggaaggccagggtccatttaaccacagaggtggtggtctccacgccagccccaaagatgtcccctatggtggtgagaatgtggttatctgaaagcagctctgagtcttgatctgggccagcattgccattatctgagttcatcttggcttgcatcagtgtgtccagcatgttggtgatagagtcactccggaatttctcctgggttgggtgaggttgggagacattaataaggaaggagccccatctgtgacactcctgccatacttctgtccctgactagagataacaaggctccttccacttggaagtagagcaagtctgggcaggacctacgaacttgtggaggtaggaggcagccccgggccctctttaaatttggtggagaggttaggtctcttctaggatcctcttcagttcctcacttttcgatcccaactccttgagtcagttttttttttttttttgagacagaatcttggtgcaatgcccaggctggagtgcaatggcatgatctcagctcactgcaacctctgcttctcgggttcaagtgagtctcctgcctcagcctcccaaatagctgggattataggcatgcgccaccgtgcccggctaattttgtatttttagtagagacagagtttctccatgttggtcaggctggtctcgaactcccaacctcaggtgatctgcccaccttggcctcccaaaatgttgggattacaggtgtgagccatcttgcctggcctagtttttgtatttttagtacagacggggtttcaccatattggccaggctcatctcgaactcctgacctcaattgatctgcccacctcggcctcccaaagtgttgggattacaggcgtgagccaccgcgcccagcccttaagtcagtttttattgtacacctactatgtgccaggttctctgcttggttttgaagcttctacagtgtgtagaatggactccaccctgctcttgtgattacttttagcctaactcatattctcttctgctctatcacctaccttgtaattttcaagtattttattcagcagatcatttcgtattttaacatggctctttaatttttccagggttttgttggggaaaatctgggaaataaaaagaaatgttaaatccacccttcttccattttgcttctccagctgccagagtctctcctggaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaattcagcgatgaatgcgtatagaatgcttagtactggcacatggtaattggaaaagaaatgaaggtcattatctggagtactaaggtgcataattaaaaggctaaatctatctctgcagagaaatggcaaaggttttaagtggcagaggaggtagaggtggcggaggtaatcaggaaaaagatgggtcattgcggctggagcagggaagtaaaaaggaaggaagattggggacaatgtcagggtctactagaacctgaaggcagggctggcagcatctcaccttcaaccaggggactaggtccaccaggctgtctttgctcaggttgtctatgatgccttcattgtaattctgtatgacattcaactcagggtccccattcttgtaggaggtattgaagcagatcaaggagatgacattggttaccgccacgaagacaggaaaggagatgtctatggactgtccgttgtgggtggccagcatatcacacaatgtactgatttcctgacaaactgaagggagagggggcatgagggtgggaaatgaatcagcacccttaccccctctctgtaccagttgcctcttaacaggagcgggggacagatagcagatggccactagatggcagcagtagccaagaaaaggctgcattgcgctctagtcctaacccttacccctgcccaaccctcctctccctccagcagctcctgtgggatccagccccagccccaggggccagcctggcactcactgatcttctccagcttctgatcgccatccttgaacagggcaaaggtggccatcgccagccttcgatgcagctgccagtgtgcgccagagtcagcgaaggcgatacccttacggttgttggacgcgatgtctagagttgcctttagagagcaggcaaggctgtaggaatctcacaccatccaccccactcttgcccttacacctctggtccctgctttccttcctggaggagaaggcaggtacctggcatgctgactcccatgtgggcacagccccactgcactccaccatgactgcaaggacttggtaggacagaccctaaggcctcctactcccaattccttcagaaatacagtagatcaaggagaaagaaagaacccttaattagaatgcagcagcattggggttcttttcgctgacagggtgccctctgggcttctttttgctcatcagtttctgaccacaggaaggcaactctggatgggataaactctctaaactatgcctgtccagagggtagggagcaggtgagcttgtagaggctgaggactgcacagatctctgcttttccctgagcccttagctgagctaaaggcacagctcacctcactcaggtttacccttccattgcaagcctgcatacccagccacaagcccacatttggagagtgcagatgttttgtctacccagtctggacttgggccgagccgcctcctcctagaggtgccccccaaagcaaaagggtccaaagcctcccttttccatttcctgaccctgaagatccacatgactagccttctccatcttctctgcccccgggaggaagccagcagaggtgggagctaggtagttggtcagcagacctggctgattggtccaagaaaaaataaaccaacccttggcttgatcaaagctgagaggctggcagggcacagtggcttacgcctataatcctagcactttgggaggctaaggtgggaggatcacgaggtcaggagatcgagaccatcctggctaacatggtgaaacaccatctctactaaaaatacaaaaaattagcgggcatggtggcatgctcctgtagtcccaggtactcaggaggctgaggcaggagaatcacttgaacccgggaggcagaggttgcagtgagctgagattggccactgcactccaggctgggcgacagagagagactctgtctcaaaaaaaaaaaaaaaaaaaaaaaatgctgagaggctgggggccctgctgagtgggaggctcatcagcaaccctgaaatgtcattgtagaaaactgcccctgtgagcctgagtagctggaaatagcaccaggaaagcagcaatcccagcctgcaatagctaggctaattctccccagcagctttcatggaggacagtagtcactgcccccattttccatgaaaagtaacatgaatcctggctgtataaggggcacttactgtgctgggtgctaggctaagtgctgtacatgcaccttctcagtccattagagaagtctaggctcagagagaggagtggagtgaggattccttgacccctcagaccactgtggtcctcccatcccacctcctgggcagcctggtagaggagacattcctttaattcttcctgcctaatttagaggctgggtgggggtctgaaggttcactcccttcacatcatcccactagtctactttgggaagaattacaggttgttggagctggaagccccattctaggcatggtctgaagacctgaacaatcccagggggtggtgaagggggcagggaggagatgggcaccacttaccatttgaggccgcccagagaagtccttgcccttcttaataagcacctccttggccagctggtggtggccgacaatcactgtagtcttggtgcccatacgaaccgaatagatggggccatattttttctgcagcttgaagaagttgttatgcatatggccgtgtctggggaggaatggcaggctgcccaccaggggcagggacaggaggctcttggggtacttggcaccagggcaccttctcttgggccaaaacaaataagctagggtaagcagcaagagagccacgagctcccacatggtggctgggtgccggcaggcaagatagacagcagtggagtagaagagctgtggcaactctagggcacaaggaggccttttaaagggctaccctgatcttcaccttgactttgtgttatctcttgccttgtggaaagattctcctggagcccagccaggcctgagctcatatccagaagggagagaggcggtgggagtgaaggcctcctcaagggctggctcaactccagggcaaacctccggaggaggagctaggtaagggaggtcagttgatcaccctctgaggagctccccatgcttgaatgactccagagtgcgaatggtatctgggctcaggagtcaaggcttggaactttccatgttgcaaaatcaaaatcactggacagatgacagattcaggagggtcacaagtagcagggactgttaaaggtcttttatgcttctttttttttttttcagagtcttgctccatcaccaggctggtgtgcagtggtgtgactgtccatgcagccctggccctccagcccatgtggttttggcagcgataagggctgtgggttaatggtccccaaaataaaaatgtacatgtgtatgggaacgaaaggggtgctaagctgtggggagcggtggaagggaagggagagataggtcagtactaggaatgccagaggtgggaggccgtttcataacatttcttgttgatcaaaatgccatcaacaccttctttgctcatcagcaggactagcgtactgggggaacccacccccaatatttcaacgtaggttctttctataagtgtcagccggctgagaaataaagagagacagtataaagagaggaattttacagctgggccgccgggggtggcatcacatatcggtaggactgtgatacccacctgagcctcaaaccagcaagtttttattaagggtttcaaaaaggggagggggtgtaagaacagggagtaggtacaaagatcacatgcttcaaagggcgaaaagcagaactactaataagtgtctaacaaagatcacatgcttctgagggaaaggacaaagggcaaaagcagaactaccgataagggtccaacaaagatcacaaggcaaagggcaaaagcagaaccactgataagggtccaacaaagatcacaaggcaaagggcaaaagcagaactacagatgagggtctatgttcagcggtgcacatactgtcttgataaacaccttaaacaacagcaaacagggttcgacagcagagaaccggtctgaccacaaatttaccagggcggagtttttccccaccctagtaagcctgagggtactgcaggagaccagggcgtatctcagtccttatctcaactgcacaagatagacattcccagagcggctgtttatagacctccccccaggaatgcattcctttcccagggtattaataataatactccttgctaggaaaagaatttagtgatatcttccctacttgcatgtccatttatagcctctctcaagaaggaaaatatggctctttctgcccgaccctgcaggcagtcagaccttatggttgttttcccttgttccctaaaaattgctcttattctgttctttttcaaggtgcactaatttcatattgttcaaacacatgtcttacaatcaatttgtacagttaacacaattatcacagtggtcctgaagtgacaaacatcctcagcttacaaagataacaggattaagagattaaagtaaagacaggcataagaaattataaaagtattatttgggaactgataaatgtccatattaaaatgaaatcttcacaatttatgttcctctgccatggctccagccagtccctccattcagggtccctgacttcccgcaacatctctccctttctttttatataaatgtgccgtggcgatgaaggcttgctcgttctctcggttttgatgcaggattctttgactggtctggcacactaaaaacaagccgattaaacagagaaacatgattccaaaatttcctacagtggagcccccagtagacttaatccaagttgtggagtttagtccagaaagactttctgccacctgatctaacgcctcagctccaggcacaatggataaatgagcttgagaggcttcaaaaatttgtttctttaatttagttatgtccaaggataaattatcttccctacccagaaggtgtcctttgaccatttcccatgatcagtctcgttgtaggaatatggtgtgctatagaaatcagaagtgttgcaatcgaactgcatttgcatgtgatgttcgagactcattagctggtccccaagccaaataacagactgtcttaaatcattagctaatttttgatcaatgccttgttgaggattccacatttgggtggaattgccttaccaatcattaacaaaattagccatttgaatagattggtgtaatgccactccggcagtggtggccagtgcagtgactgtaattaggcccatgatcacagtgattaaagtgaaaacaaatctcttgatcttttgagaattcgttgtaacacttcattaattaaatgtactgagggggaagattcccaagttctgggtaaagttactggtatccagattccttctcaagctcgaaccaacattacacttttcctgagtcaaaacgggagttaacacaagtggataaatgacaattaatgcattggacggtttgattgttcatccaaattttgatatttcccactaacagcatgtaaggaggcttaacacaactctgtataatagtcaggctggaggtaaacaaagcagaatgtttgaatctacgttgataccgagggggaggagtggcggtggcaacgcccaatgtttgatgccgtaaagaagcaatccgaggtgcccggggattctgaagaggtagggggacatacctgggtccagaagaattatcataatgccaatcagagtcccataaaggaggactggcatcaaaaagaggaaaatggtccaaaggggatttatcatgggtttcagaatcacggatgtgaggggtggtagtggggacaacagaaagaaaagtttccccttcccatactcgcagtctggacatggcaatagccaatttccaaagttctgggtgttctgggctcagaatgggggatatcataagaggcctcgggtggcagggggtaatgctcttatcttcccattttaagggacagaatgagctgaacctcctatgcaaagtaggatgatgatcctcgtcctcccaataagaaataaaacaagtagcctccaggcattcccttccagcagaagagcaactgcttttcaaatagccctttggtgcccagtctcttactaaaccatatgagtcattttttaatagtactgcatgtgaattaacacaatcttcccaaattaaagatttagatgggccctcaaaaattttaggacatggttttcctacaggtttatattgaaagtagggggtatctcctattactccccctttcatttgtcttaaaggagaaagggagaggctggagaccaaatgtccccgttcccctgtggctgatctctccagaaggtacgcagcccagacttgagtttctagatggatacaacaaggtgcatgtccgaggcacagaggagggtatttataaccgtaggaacattaaatgcagtgccttcttttcctggttgagtggggcaacggtcatctgtagctccaggcatccacacactatcattagtatagatttccgcaggagcatccatccaggtgagaggttgaataagtggaggaaaaggcacataagcccagcaagaataattttgtgtagcaggtaaatcaatgtgaggggaaactggtgagacagaaagtataaggaagagaattattaaataaaacctattgtaagcaagatccagtgctgaaggaggaatagaagaataaggggatgttattttcaggctaatagaaatggtgagatttttaggttcgtaaggagaaaaagaaagggaattaggagaagtgggattagttagaggggtttctgttgccattagggaggattgaaccagacccattttgatttggcgtgccagtttctgaggagttggcacagatctcaccaggtatgagggtggtctctgacgtggacgtctcttccctgtggtttttattgtcagtattcacatgaagtttaagtcttctagtgggcacccagacaggggattgatgatctcctggtgaaacacaagcataccctcttccccatgttataatcgttccaggtttccaggtattggtctgggaattaaaggcaaagaattaggtagtaaatttagaggaatggtactacagagattgaccgcccctccccttactctggagcatagataagcgttgtactgagacagaagaagaggctgggacacatctgggttggctgtaggtaaatttgtttgtgctgggggctgcgttgggaccgattgaagcagaaaggcaacattcgtctgagtctgaggtgtcccatttgaaattggggcctaggactggccccatttcccatttccctggttctgtggcaagggatttccatctatatcagacttagagtggcaagtacttgcccaatgtttacctttacaacaacaagggcaaacagtagcaggagcatttggctgtgttttttgagccggcttggctgcctttaagtttttaactgtgcaattttttcgagtatgaccaagttgaccacaattatagcaggctccaagaaaagaatcagtcgagccagtttgattgccgtccttcatggcccgtgcccacagaatagctttgtgggcacagaatagctttgtgtctgatccaatgccttcatatttaatatactcaggcaacacctcacgatcaggtaaattttgttgttggacggaatgcatggccattttacactcatggttcgcattctcaaaagctaacattcgaagaagaataccttgagcgtgctcatcagagacagatttttcaacagcatcttgtaatttagctaaaaaatcaggatataattcattgtgaccctgtttaacagtagtaaaagaaacaggagcttggcctggggcgcgtaatttatcccaagctctcatacacacctttgttacttgttccacggtgagagcatcaaagcctaattgggcagtagtgtcagagtaattattggagcctgtgagctgagcctgagtaattagaatgccatcagcccgatttagctgagcctgcagatgggcctcccgtgaccaccaggtacagaattgtaaatgttgagatggagttagaacagcttttgccaaaagtcccagtctaaaggaagcaaaatgacctcagtacaaagagtctgtaataccattttaacatatggagaagtaggaccatactgagtacaagcatccttgaattcttttaaaaaggtaagattgagcagcgcctatcgatgcacttgtaccccttgagcattgcaaggttccagcatgaacggataagcccacgcctctaatccacttgtttgttttggcgtaataagcattgcatggaaatttcaacaacaggcacatgagacagagttggcacagaagtgacaggaaaattatgtgtagataagggaaactgaggctgaggaggttggaccagtatgagagcgtgagaaaggggcaccagaggagcagaagaggcagaagcatactggtgattattgcccaatcctgtgcaaccagagtggcaggggtgtccacatgtgaagaagggtacagagaagcaggttgagtggatggcaaagtgaccagttgaggaaccgaaatgacaggagggtgaggggctgtggtggatgggggagggcctgcagaattacaggtaaattgtagtttagttccggagccattagatggctccggaggcaaaggctgcaaaggtttgaagagggaagagttagcatagatacagtcctgggctgtccaagtcggggccgtgggagctacaagtactggctgttcgtgaaaagaaataagatcatcagggggtgacgttaagccaaagtcactggagttagatattgaatcttcaatatcctcaggtggggaaggagtaggcgaagggagaggctgatcaggtaacgaaggccgtgcgggagaggaaggttgaggaagaggtggagggtttccagattcagaaaactgtggtaactgcagggggtgatgggattggtatgtcattaggacggcacataccaaggcccagtcaccccaaacagtgacgggaacataatttcctgttgggaccagttcccggaattttgcaccaacacgatcccatagttccacgtctaatgttcccttttcaggaaacaaaggacaatgttcttccactgccctgaatagggtgaccatattttccatgggtacccaaactcccccctgttttaacaggagtttaatatggcagagataagcataatgtttagactctgagtgacccaaagttagcctggacaatacacagacaacttaccaatcatcagagagctgaacaagcatttctgtggaccagaccaatgaacgtttctccgcacctaccaaagggaatcaggttcccacatgcaattaggagaaagaaaaccacattggtgtgccagatattgggggaaccagcccccaatatttcaacataggttctttctattttccataagtgtcggctggctgagaaataaagagagacagtataaagagaggaattttacagctaggccaccgggggtggcatcacatatcagtaggactgtgatgcccgcctgagcctcaaaccagcaagtttttattaagggtttcaaaaaggggagggggtgtaagaacagggagtaggtacaaagatcacatgcttcaaagggcaaaaagcagaactactaatatgggtctaacaaagatcacatgcttctcagggaacaggacaaagggcaaaagcagaaccactgataagggtccaacaaagatcacaaggcaaagggcaaaagcagaactacagatgagggtctatgttcagcggtgcacatattgtcttgagaaacatcttaaacaacagaaaacagggttcgagagcagagaaccagtctgaccacaaatttaccagggcagagtttttccccaccctagtaagcctgagggtactgcaggagaccagggcatatctcagtccttatctcaactgtacaagacagacattcccagagtggccgtttatagacctccccggaggaatgcattcctttcacagggtattaatattaatattccttgctaggaaaagaatttagcaatatctttcctacttgcacgtccatttatatcctctctgcaagaaagaaaatatggctctttttgcccgaccccacaggcagtcagaccttatggttgtcttcccttgttccctaaaaatcgctattattctgttctttttcaaggtgcactgatttcatattgttcaaacacacatgttttacaatcaatttgtacagttaacacaattatcacagtggtcctgaggtgacatacaccctcagcttatgaagataacaggattaagagattaaagacaggcataagaaattataaaagtattatttgggaactgataaatgtccatattaaaatgaaatcttcacaatttctgttcctctgccatgcctccagcccatccctccatttgggtccctgacttcctacaacactagcatcctagcagtcatggtgacagtgacattgaaggtgggggctccatcggtgctcttggtataaagataggtcagttccccatcctgcagcagtaggtcccagatcacagaacatttctggcccccaagtgtcacctcattcacaaaaaaacttgaccagtctttgccaaccaggacatcaacctcagctggcttgacgttgatgaaggttttcccagggatggtggcctggatggaaggcaagtccttgtagcccacgatggctgcatcctacaggtcccttccaccacgaggttgtcgatgtgggtgttccaccctgccgtgggctgcttgtggcactgctgccacctcgcagacaggcaggggaggcggagagctcagggcatgcactgtggtcgggaccactgctctgctatccgtgcagaagcccttgtactgccacttcctggaagtgatcattttaagcatttatatggcatcaatctttttcactgtattgatccaaatgatttcaagcataagagaatggacagatcggttttgtttgtttacaaaaaggaaaatggggccagtcatggccaaggttaacaaaacaaagggcaaagcttaactggcttagtgtggactccaatcattggaaagactgggaagatggttcagatgaagccatgtctgattttgattatttctctgagatgatgaaccacatgggtggtgaagaggatgtagatttagcagatggagcagatgatcattcacaagacagtgatgatgaaaaaatgccagatctggagtaaggaatattgtcatcatctggattttgagaaagaaaaataacttctctgcaagatttcataattgagagaattcctggccgggcatggtggctcacgcctgtaatcccagcactttgggaggctgacgccagcagatcacaaggtcaggagatcgagaccatcctggctaacacggtgaaactccgtctctactaaaagtacaaaaaattagccgggcgtggtggcgggcacctgtagtcccagctactccggagactgaggcaggagaatggtgtgaacctgggaggcagagcttgtagtgagccgagattgcaccactgcactccagcctgggtgacagagcaagactccatctcaaaaaaaaaaaaaaaaaaaaaaaaattgagagaattcctgagttgatagctctaaagacagatgctgtatttgcctactttaatctatttttcaacctgtttgttttttaaaaggcctcactaagggttgatatgtaccactgtatggggcaattttcagtcagctaaggcaataaccttatgcctgaacatttcccagacttccatgaagctgttgaagtcctaggcaattgatgcagcagttgtgataaatacaaacatctcacctaagtctccttttcttcataacatacatactgacatgatagaaagctctcagcttagggaaagagaactaaattttagattataggacatggattcaaaagtgactggaacaaattggctgacaccttactggtaacctgttattcctcttgtgttattcttcaggattgttccactaaagcttatttcaaaaaatttacctctcgggctgggcgcagtggcccacgcctataatcccagcactttgggaggccaatgcaggtggatcacatgaggccaggagttcaagaccagcctgactgacacgccaaaaccccatctctactaaaaatacacaaattagctggtcatggtggcgtgcatctgcaatcccagctacttgggaggctgaggcaggagaatcgcttgaacccgggaggtacaggttgcagtgagctgagatcatgccactgcactccagcctggatgacagagtgagactctcaaaaaaaaaattttttttatattaccagatgaaatcacagccccaaggtagcagacattcttggtgtcaatcattatagaagagatgggccaaacaggagttgttagttgaggctcacagaggtgggagatggcatctgatggcatctgtcccactctctgggagtggtctgtctgcaagtttagtaaggatggagtgaaggctgctggaattaggcaggaaggcagcaggtagggggcctcatgatgaagaagagctggccaggcctcataagccagactgcctggttgcccattactcagaattttcaaatgttgttcagatttttaaggccatttgcagccagaggtatgggctgggatgaaacctatgagaaaccttcatgcaagaaaggggatttgaggtaggccttgaaggagagctaggactgatgcaggacagacagacaggcaaacctctaaactggggcttagcccaggagggttcttggcttcacccaggaaagaattccagggcaagctggtggtggtagccagcaagcagcagcgcacagagcagaagaggtactgctcctcgtggagcagggctacccaggggcagtgcccccaaagtcacagctcagaggcagagctgcactcacatttacagtcacttttaattatatgcaaattaaggggtggtttatgtagaaatttctaggatgaggtagtaattttcaggccatcaagttattgccatggaaaggggtgttaatatccgggtgttgccaaggcaatggtaaagtgacatggcacactggtgggtgggtcttatggaaagctgcttctgccctggacctggttttttgttttgttttgttttgtttttttttgagatggaacctcactttgttggctcactgcaacctccacctcccatgtgcaagcgattctcatgcctcggcctcccaagcaggtgggactacaggcacccaccaccacactggctaatttttgtattttagtagagatggggtttcaccatgttgactagggtgatcttgaactcctgagctcaggcaatctgcctgcatcagcctcccaaagtgctaggattacaggtgtgagccactgtgcccggcctgccctagatctgtttaactggtcctcaatttggtcaggtgtctgagccctgcctccagagtaaggttcaccttcctgagtccagtcctacctcctacctcagaactgttaggtagagatgtgaaggagtagggagagaagggtgttgctggaagggagagtagcagaggctggaaggagcatggcaggaggggaatggtgatggccttagctgaagagacaaagaggtgtgttgtgggggatccctgagaaagatctgaggggtacattgtgtcaggctctggagccctggaatggaagggtataaagggtatagggaggctgtaggagctattgagagcactgcagcagggagcagcaaggtgacagtggtgttttaggagggtgaaactggtgttggtgcatggggtaggctggatgaggagatcgtgtgtaaagcctgagagctggactgacaagtggagaggcctgaatcctaagatccaggcaggggcctcagtcgggtcaaccagctggtagggaaatatgaatggctactttctactcctacagagactgccaagctgacctgatatttcaccccaatcagaaacaagaaatgggaatttaaaacacacacacacacaaaatgtgttgcttcacactctcatcaccatattataaaagttatacatcataattgcagaaatttggaaaacacaaattactaaaactaaatatttttaaactgtattttttaacctaaatgaggctgtatttttggcatgaatatttttctataactttcctattattatttctctttcttctctcacttttgacaatgtccgtcttatttttttatttttagatggagtctcactctgttacccaggttggagtggaatggcgcgatcttggctcacttcaacgtccgcctcccgggttcgagcgattctcctgcctcaccctcctgtgtagctggaactacagatgcgtgccaccatgcctggctaatttttgtatttttagtagagacggggtttcaccatgttggccaggctggtctcaagctcctgatctcaggcaatccacccacctctgcctgggattgcaggtgtgagccattgcgcccagcctcttttgacaatgtctttctatgttgcccaggcaggactcaaactcctgaatgattgatattcagaagtgaaggggcagatcctgattgtttggtttgcaaaagggggttcactgaggtgagttgtcataaattgattgaacagatttctttttctgtttcttttcttttttttttttttgagacagggtctggttctgtcacttagtctgagcgcagtggtgcaatcacggctcacttcagcctcgacttcctgggttcaggtgatcctcccacctcagcctcccaagtagctgggactacaggcgcacatcttcacgctcagctaatgtttgaatttttcatagggatggggtttcaccatgatccccaggctggtcttgaattcctgagctcaagtgatcctccctacttggcctcccaaagtgctgggattaccagtgtgagccactgcgcccagctgaacagatttcaaatgagttctggtaatatattagttttctactaccacattaccatgaatattaccagaaactttgtggcttaaaacaacacacatgtattatcttacagtcttggtgggttaggaacctaagtatagcttctctgggccatctacttagtgtctcacaggctgcagtaaaggtgtgggccagggttgggttccatctggaggctctactggggaagaatctgcttcctatgtgcctggttgttagcaggattgagttccttttgattgttggactgagagctttttttttttttttccgctggctgtcagctggaggcccagaggtaggtgactagatggtacttgcagttccttgtcacgtggagttctccaacgtggccactcgcttactcacagccggcaagagagagaggctctggcaagagagaggctccagcaagatgaggggaatggtgatgtaacatgtaatcttatgtaacatcatcatgtgtttcctatcacctgtgcatacactatcgattagaagcaaatcaaagatcatgtccacaaggaagagaagaggatcacacaagagcaagaacaccaggaggtggggtcaaaggctaccctgagcggccagtctgtccaccacaggtagctacgtgttaccatggctatagaacattccatcttttcctaagtttgtggatgtggagcaactggagtggcatacactgctatcggaaatgtaaagtgttaaaccactttggaaaatggtttggcagtttcttgaaaactgaaacacttaccatatgatccagccattccactactagatagttacccaagagaaatgaaaacaacccacataaagacttgtgtacaaatgttcatagcagaatattcataatattccaaaagtggaggccaggtgtgatgggcttatgcctgtaatcccagaactttgggagggcaaggcaggaaaatcacttgagcccaggcaacatagggagaccctgtctttacagaaaaaattgtaaaaattagccaggcatggtggcatgaacctgtagttccagctattccggaggttgaggtgggaggattgcttgagcctgggagcttgagctgtggttatgccatacactccagcctggatgacagaggagtgactctgtctcaaaaacaacgacaaaaaccaaaaccaaaaaacaacaaaacaaaacaaaaacccaaaagtggaaacaacccaagtgtccatcaacaagagagtgaataaacacagtgagaactatccatgcagtggaatatttctcagcaataaaaatgaacaggctagttatatgcacaacaacatgtcaaatcatcatgctgcaagaatgaagccagacaaaaaaagacccccctcccctcaaaaaagcctgtatgatgctatttatttgccattctagaaatgcaaattaatctatagttcccaaaagcagggcagtggttgcccgggtgagacagagaaggagagatggactttaaagggcacttggaaacttctgagggtgatgaaatgttttgcatctttttttttttttttttaattgagacaaggggccgggcgtggtggctcatgtctgtaatcccagcactttgggaggccaaggtgggccgatcatgaggtcaggagttcaagaccagcctggccaacatggtgaaaccccacctctactaaaaatacaaaaattagccgggcgcgatggtgcgtacctgtagtcccagctacttgggaggctgaggcaggagaatcgcttgaacccgggaggcggaggttgcagtgagccaagatcacacccgtgtactccagcctgggtgacagggcaagactccgtctcaaaataaagtaaataaataataaaaataaataaataaaatgagacaagttatcgctatgttgcccaggctgctgatattgaactcctggcctcaagcaatctttctgcctcggcctcccaaagtgctgggaatacaggcatgagctactgctcccaccctgttctgtatcttaatagtggtggtggttcacagatgtatacgtctgtcacactcatcaaatcgtacactttaaagaatgtggttattgtgcaggccgggcgtggtggctcaacgcctgtaatcccagcactttgggaggccaaggcaggtggatcacctgaggtcaggagttcaagaccagcctagccaacatggtgaaacccatctctactaaaaatacaaaaattagccaggcgtgatagtgggcacctgtaatcccagctactcgggaggctgaggcaggagaatcgcttgaaccagggaggcaaaggttgcagtgagccaagatcgtgccactgcactccagcctgggtgacaaagcaagactccatctcaaaaaataatgttgttattgtacataaattataacataaattcatgcacataaactcaataaagtttattaaggacaaaaagtaaacagtaaatgagattcaacggagacatatgaatctagacacttggaagaggaagtaatgttgatattgaatacaggtaattttgaacaaaattttcaatacaataacattctcacatcttttattaactaaaaaagaaatggagctacttgaaatattttattttttttttgagacagagtctcactctgtcgcctaggctggaatacagtggcatgatctcggctcactgcaacctctgcctcccgggttcaagaaattctcctgcctcagcctccagagtagctgggactacaggtgcccaccaccacgcccggctaatttttgtatttttagtagagacggggttccaccatgttgggcaggctggtctcgaactcctgacctcaggtgatcctcccgcctcaacttcccaaagtgctgggattacaggcgtgagccacggcacctggcctacttgaaatattttacatattaattcacttacaaggtggttaccatcagtttggtattaatacaataaagaggttatcaataaaaattactagtgatgttgagcatttttcacatttatcagccagttgatttttttttttgaattgcctacttgtgccttttgccaatttttctattagattgtttttccttcttcatttgtttacaggcctatctgcctcatcagcctgggagttccacagagacaagaactgtatttcatttctttctctatccccagcctagtacagtgtctggtatttagttcatgaaatgtttgttaaaattgaatggaatgaggccaggtgcagtggctcacgcctgtaatcccaccattttggaaggccaaggctggtggatcattagatgtcaggaatttgagaccagcctggccaacatggtgaaaccctatctctactaaaaatacaaaaattagccgggcctggtggcaagcacctgtaatcccagctacttgggaggctgaggcaggagaatcacttgaactcaggaggcggatgttgcagtgagctgagatcgagccactgcactccagcctgggcaacaaagcgagactccatctcaaaaaaaaaataaaataaaataaaattaaataaaatgagacaagttatcgctatgttgcccaggctgctgatactgaactcctggccttgagtgacccttctgcctcggcctcccaaagtgctgggactacaggtgtgtcaccatatggataggttggccttgaactcctgacctcaagtgatccaccttggcctttcaaagtgttgggattacaggcgtgagccaccacgcctggccccttgtctcaattaatcaaaaaaaggcctaggcaacagaacaagactctggggaaaaaaaaatatatatgtatatatatatgtgtatatatatgtatatatatgtatatatgtgtatatatgtgtatatatatgtgtatatatatatatgtgtatatatatatgaatggaatgatattctcataaccccttggaaacattattacttctgtttaacagatgaggaatataagacagaagctgagtaatttgcagccacacactgctaaatggtagcattgggactgtaatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgaggtgagctggaagtggactctcccggcctgatagtccggggagtcgcagtctttcgttgctgtgggaaggaggtcgcgttgcatcttgggaattgtaggctgtgaagtacttgctatgagtaggtcttcttcgcggaggcgcgtgttgcattctggggtgtgcagtctctttggttagggacagtgtgtgagggttgggggaagaagcgatgccatgggaacctgtgctttaaaacagctctttgggaggccgaggcgggcggatcacctgaggtcgggagttcgaaactagcctgacaatcatggagaaacccccgtctctactaaaaaataataattaaaaaaatatatagccgagcgtggtggcacatgcctgtaatcccagttacttgggaggctgaggcaggagaattgcttgaacctgggaggcgaattatatatataagtattatatattacgtattatataatatatatacgtatatattatatataatgtgtatgtatatattacatatataatatacatatatattatatataatatatgtaatatatattatatatattttcaactagaggtgtttatagttaaccacctgtaaatattcaacatattcatcataataaacgtacatttatttagcattttatatatgctagacactgttgtcttttatggagtttaattcatgaagtctttagaatgactaattgaaggaagtacttttccttttttttttttttttttgagacggagtctagctctgtcgccaggctggagtgtagtggtgtgatcttggctcactgcaacttccgcctcctgggttcaagtgattctcccgcctcagcctcctgagtagctgggattacaggcacgcaccaccacacctggctatttttgtattcttagtagagatgaggtttcaccatgttggccaggctggtctcgaactcttgacctcatgatctgcctgcatcagccttccaaagtgctgggattacaggcgtgagccaccgctcctggcagcattgcttcttgagcagtctccacatagctattttgtttgattagctgagaatttcatgtgtaaaaaactcattccacagtattcatttaacaaatacttattgggtgtctgctatgtgccaggaactgctctaggtacacggaataaacaaaactaaatccctctacttgggaagtttacattttagtgaagagacagacgataaacaagtgaaacagaaaaaaatcaggtggtggtaaatcctgtgaagcaaaattaatctgggaatagagagtgatgaaagggttaatctttgtttgtttgtttgttttgagacagaggaggagtcccactagctctgtcacccaggctaaagtgcagtggcccgatctcgggctcactgcaacctctgcctcctgggttcaagcgattctcctgcctcagcctcctgagtagctgggattataggcgcctgccaccacacccagctaatttttgtgtttttagtagagatggggtttcaccatgttggccaggctggtctcaaactcctgacctcaagtgatccttcccgctttggccccctaaagtgctgggattacaggcatgagccaccacacccggtcgaaagggttaatcttaaacagatgatcagggaaggggtctctggggagagagcctgtgaggagaaacacactgacatttgcccacagcataatgagtggttatgactcataggcttgtctcttgcatgcctgcgcttctcctcctccatttgagttgtgtgcttagtgagggtccattgtgtttttttctaaacatcatgtgtctgtgggctgggcgcagtggctcatgcctgtaatcctaacactttgggaggccgaggcaggattgcttaagcccaggggttcgagaccagcctgggccacatagtgatatcttgtctctgtaaaaaaaggaaaaaaaaaaagaatgaaaacaattttttaaatgtgtgtatggcacttatgcttacagttgcaactacgtaatttaatgaaataatacgaaaaatgaaatatgagtaccaaaaaagagggttgctattgctatgaaaactaagttgaaaatcagaaacacttgttgaagatgagtagctaagacaaattgttattgagttaattatgaacaagttaatggtaaaagcctaggagaaaaatttatagaaatctaaaaagattctgtagtgaagattgttttacaggtgtattcaagatgttcttccattttaaagaaagcaaaactagaaatctcagatggtatgttatgtgtctggtctgtttatgtaggaaagtgatgcagaatgccaatgaatatatcaaggaaaagccttggctttacattacaacagcccctgccttcaaggcaaccacaactcccattgagtctgttttctaaatgtctcacaaatcctttgtttctttttttcttggctacttctgtgtttcaggccatcctcattccttgcttagagtactgctgtgtcatcctaaccaatctctctgcctcattccccactctagtccacctgcttaccacatttctaaaacagaaaaatggatcatgccatttttctctagaattacacacaaagatgaattctaaaccctaacttttaagtctcagattagaagtcacttcttttagggacctttcctgaacacctacccctgtaatcagttagacactcctgccccactacatgctcccggagcagccaatgcttccccatcagcacttaccataaggtgatgtaagtgcctatgttccctttgtaacccctccagattctgagccccgttatcactcttaaccagagtaagggcatatgttaaacactcaacaaatgtttattaaatgagtaagtgaatgaagtagattgttggaacccttttttttctgccatcggtttgtaagtcaccatctcccatctataggagtttgaagtttacccttaaaagtagccacaggaggaacaggtactctcataattgttggtgggaatgcaaagtggtacagccctaaaggagaggaatttggcaatatgtagcaaaattaaaaccccacagtcacaaatcacagtcctgtgagtccatcccaaacatatgctggcaaaaagatgcaaagataggagatatttgtaacagtaaaagctatgagataagatccaagatttgagaattttttgtaccactacttaccgtggcaaaagactgggaacagcctccaaatccgtcagcagagaactgactgaataatgttatggtcacctgtagagtgtggtactctgcagttgtaaaagagcaatggattcattaggagatagcaattgaataggagattcaatatgtattgctgcagataaccctcagggatctattgcaaagtgaaaacagcaaggtgtaggctgggcacggtggctcatgcttataatcccagcactttgggaggctgaggcaggcaaatcacttgagcccaggagtttgaaaccagcttgggcaacatggcaaaaccccatctctacaaaaaaatacaaaaaactatctgcgcatggtggcatgcacttgtagtcccagctactctggaggctaaggtggaaggatcacctgagtccgggaggttgaggcttcagtgaacagtgatggtgccactgcgctccagcctgggtgacagagtgagaccatgtctcaaaaaaaaaaaaatatatatatatatagagagagagagcgagcgagagagagagagagagagagcaaggtgtaaacaagtacacatagtatgttacattttaagtaggaaagtggtatggaggaaaataaatacatgtgtccattgtttaaaaaggaacaatggaaagaaaaccacaaagctaataaaaatagttatgcatggggctgggtgtaggggctcatgcctgtaatcccagtactttgggaggctgaggcgggtggatcacctgaggatgggagtttgagaccagcctggccaacacagtgaaacctcgtctctactaaaaatataaaaattaggtgagcgtggtggcatgtacctataatcccagctactcaggaggctgctgcaggagaatctcttgaatccaggatgcggaggttgcagtgagccaagatcgcatcactgcactccagcctgggtgacagagtgataccctgtttcaaaaaaatgaaaattaaaaaataaaaaaatagttttgcatatgggggagagaacagggaaagaaagggacagagatggaaaatcctattttattgttttgactttagacatccagaaggggttactaactttaaaactttaaataaagttgccctgtgttggggaagaaatctggcaatcctagttactttgaagtcacgctacccttttcactagagtctccctgacccaagagaacagggaagggccggtaggatacacataacagtagctccttttacttggctgaatttaggtatgccaggagcagggtgcagtattaggccagaaatctctgttggtctctgcttgcctctcagtgctaatgtggtcagctctccttgactgtagaccatccagccaaatccaagctctgcttttctcttttggactcaggacccattaaactcagtaacctcattaaattctgcctgcacatttctcctttcttttcttttcttttttttttttttgagacagagtctcactctgttgccaggctggagtgcaatggtgcgatctcggctcactgcaacctctgcctcccaagttcaagagattctcctgcctcagcctcctgaataactgggattacaggcacgtgccaccacgcctggctaatttttgtaattttggtagaggggttttgccatgttggccaggctggtcttgaactcctgatctcaggtgattgcctgcctcggcctccgaaagtgctgggattacaggtgtgagccaccgcacctggccatctcctttcttttctttttcccagccctgtctggtcatcttttatggggtggttccccattttaagccctgagcttctcctcatggcttccccacaccccccactgtttctcttattccattttttttttctttttttttttttgagacagggtcttgctttgtcgcccaggctggagtacagtggtgagatcttggctcactgcaactttcgcctcctgggttcaagcaattctcccacctcagcctcccaagtagctgggattacaagcgcagccaccatgcccagctaacttgtatttttcggtagagatgcggtttcaccatgttgcccaggctggtcttaaactcctgacctcaagtgatccacccaccttggcctcccgaagtgctgagattacgggcatgagccaccgcacctggccttctcttatttcatttctaaatagctgtattcctctgtccttttcagccccattctaactcttgcatctttactactttcaaacaaccccaaatctcaaatctgcctttaaagaattacgagtcatgttctctcactggacttgtggagccaaagtttttttgcagacttctcttagcacttaatgaatacactgtgccaacagcccagcagttaggaagcacttgatttctcaggcagtggcctttgaaacagatgtcgggtccatgccagaactgccatagtgccaatgaaatgaattttcaacatgaacaaatagaaaattatccttcattacattttgagtgtttgtggttgtatagggtggaggagtgggagaggagagagggtagtagtgtaacagctgcagagagaagattacaggaagtttgggaattttgattattaccattttatttttgtcttccagctgctaggtcaggcagctcgaaacatggtactccaggaagatgccatcttgcactcagaagatgtaagaaacaacttttttttttaatgatttgggtttatgtatatggtttgtgtggccacagggaagtggaaatgttctatttctctctctcttttttatgcagagtttaaggaagatggcaataataacaacacatcttcaataccagtgagtatgccccctccagcaactatttgctgcagaatcattatccctggtctgctttcatggactttgtgcttcagcactttcctgtggaggccagagtgggagtaaaggtgggggtggccaaggatgactttctcgatggcaaagatgcctgagactacagaagaagtgggggtaaaggatgagaatcaggagcagagtccaccctttatgaacctccccatgttaaattgagggctcctcagagagagactataaaccctgtaaaggcagggcccgtgccaggaccatgctagcactgtacttggcacctgtgaggccgttgatcagtatttgatgactgactgtgcccaaggtctcttctgggaagttaagttgggtcctctactagggaatgaagtataacatacctgtatcctacatggtacataggtaagtgtggcacctgctacatataaatcatgtagggaattttgaaatataagaccccctctttctccattataatttgctcttcatcttatttcatgttgttttatattttatgtacttgatattatacttatgtacctcttagaaatatatggttggggctgggcatggtggctcacacctgtaatcccagcactttgggaggccgaggagggcggatcacctgagatcaggggttcaagaccagcctggccaacatggtgaaaccccgtctctactaaagatacaaaaaagtagccgggtgtggtggtgggtgcctgtaatcccagatactcagaaggctgaagcatgagaattgcttgaacctgggaggtggagtttgcagtgagtggagattgcacctctgcactctagccagggtgacaaaagtgaaactctgcctccagaaaaaaaaaaaaagaggctgggcacagtggctcatgcctgtaattccagcactttgggaggctgaggcaggtggatcacctgaggtcaggagttctagattagcctggccaacacggcaaaaccccgtctctactaaaaatacaaaaattagccgggtgtggtggcacacacctgtaatcccagctactcgggaggctgaggcaggagaactgcttgagcccgggagacggaaatggcagtgagctgagatcgggcaccactccactgcatcctggcgacagagtgagactctgtctcaaaaaaaaaacaaaaaaacaaaaacaaaagcaaacaaacaaaatatatatatatggttaggaatttcactcttcgatatttaaatagctaatgtttgtcataatcattagtcattctttgggtatctacatattaggtattaggtatgtgaccatttgattccatatacacagactaattttaagccatgcatgtagtctgttgaaccacatttctcactctgggagaatgttactatctgtttgggtttagattccatcttttcagcagctctgcactcagacaggaatccctgttcaatagcacaatcttaggataggatggacagaaatacaggatgtgacataagctgaaatttcttctgcctatatgtattatctggtcataaatgaaacttattagttcacttatgtgtattttcctctttccttttctgatttaggcaagaagctattcagaagaagtaagtaaccccaaaggtagaggagtagggaaccaactgaagcaggctggggggatttatactgctgggtccagaatcaatacaaaaccctggttgacacctgccctcaaattgaaatatgctctgggatactcacttgggatttaaagatacagcatatttcaaaggtgtgcagtaactcaactcactgctattaatagtaaaactttctaaaagttatggggtatagagaccaaccttaaggagtagaaaaccttttacattggtaatattcattaagcagagtaaatgtgcaaaaaccattaaacagccttgttttctaaaatggattaaatttgtcccttgcaacattgtttacattactaattggctttgcaaacctttcttcagagtttaaacacttctgggacacaactggaccaatataaattttgatttacatgcaacagtatttatgcattaaagtacagatagcttgtacaggacaggtgtagtggctggctcatgcctgtaattgcaggactttggaaggctgaggctggaggattgcttgagcccagagtttgagattgccttgtgcagcatagtgagaccctgtctgtaatggaaaaaaaaaatttgtaaatagttgtacaaagatgtctttattattgctcatttcagataaaccctgtctctattctaattcctagtgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccctgtattagggatagagtggaaatatttttgttttttttaaggggtatatagttagaatttagaaagaatggaaatggaaataataaaactaaacaaattagaaaaaaataacaaattagaaaaaataaaaagtattaagtagttcttgtagattaaatgggtaaagtgtcagctcagccagaaaagtacaaattagtaaattcgtaattgaataggcaatacataaaatcaatgagatttgaaaagagttatcagtttgctgcaaaaaatgtgattaatatatgcccagctccttataaagataaaaaattatgaaactgacacttttaacagagaatattccagattggttatgagaaataacccacaaactaagaataaccaattaaaatggcatttgcttgtgaaagctttcatgagacttttccaaactgtcaaagaacatatactcctggccgggtgtggtggctcacgcctgtaatcccaccactttgggaggccgaggcaggcggatcacagagtcaggagttcgagaccagcctggccaacatggtgaaaccccgtctctacttaaaaaatacaaaaattaaccaggcatggtggcacatgcctgtaatcccagctactcaggaggctgagacaggagaattgcttgaacccaggaggcagaggttgcagtgagccgagatcgagccactgcactccagcctgggtggcagagcaagactccatctcaaaaaacaaaacaaaacaaaacaaaaaacccctatactcccaaaatatagaaaatgatcataagacactaattcatttaatgaagtaaacaggattttcattttaaaaataaaattatgtaagaaagatgatgcaagaggatgtaagataatgtaggtgatttttttatgagtatagatgcaaaaatccgaataaaatcttagaaaactgaatagagaaatattttgaataattgttcatgtaactccagaatttcaaagttgatgtaatagttacaaaacacattacattaataagaaataataaaatcttttgtcactataatatataccaaaaaggcatttaaaatacactttctatttcaaaaaaactaaaagaattttttaaaagggtatgttttaaaacccaacataatatttgatgaagaagagtcgtataaaaccccagaatattagagctgtatggggccttaaaagttattaaattctggccccatgttttacagatgaaaaaaacacagccaggaagatgaaatgacttacccaaggtcactgagcttgatggtaggtcttttgactactagtctggctctattacctgttagtttccttatgcatagaaacaagggtgccaccttcattactagtcttcaacataatactaaagagctcttagaaaaggaaaggatcttgaagtagctgaatccaatccatttgcccctgcttctgcatctcaggtgagccatcatccagtcattcatctgcttctgcttccgatatttggggaatcctttacttaggagtgctgatccttttggaaatctccacttcttgaaagatggttctgtgtaattaaccaaaatctgcctttctggataatcctggaattgtcactccagtagcttccaagatagaatgtgtgacggtgtgcacaggcctctgttaaagggtaggggagaaaatttctatgtatgttagttttttatcttaaaaaaattagcttttgtgaggctgggcgtggtggctcacgcctgtaatcccagcactttgggaggccgaggcgggcagatcacgaggtctggagattgagaccgtcctggctaacacagtgaaaccccgtctctactaaaaatacaaaaaattagctgggcgtggtggcgggcgcctgtagtcccagctattcgggaggtgaggcagtagaatggcatgaacccgggaggcggagcttgcagtgagctgagatcctgccactgcactccagcctgggtgacagagcgagactctgtctcaaaaaaataaaaaagcttttgccaatatttaaaatatgacttgatgtgagagtcttaatttcttctacgcagtatacagatatatagcattcctgtcatttagcaggggtgatagtaaaacaaaaaaacaaaaaaccccacaaaacctgtggtgaggcactgaccaatcagaatgattgatggtcacagtctggtccaaaattagcccccacaccagacaccatggaggaaaagtgagagtaactcaatttaagttgacagtggtttgttttattgcagtttatctgtgtgtgaataggtagatttaaggattgttggccaggtgtggtggctcacacctggaatcccagcacttttaggaggcagaggcaggcggatcacttgagatcaggagttcgagacagcctggccaacatggtgaaaccctgtctctactaaaaatacaaattagccaggcatggtagtgcatgcctgtaattccagctacttgggaggctgaggcaggagaatcgcttgaaccggggaggcagaggttgcagtgagccgagattgcgccattgcgctccagcttgggcaacaagagcgaaactctgtctcaaaaaaaaaaaaaaaaaaaaaggattgtcaaatgattcttgtaagtaaaccataaattaaagataacaaaacaagcacaagagaaaaatgatacagccctttccttgacctctcactaatctgcccttttaagataaagatatcattttaactatgagaaggtaactgcttttctaaaggagctcattttatgaagataatattttgaaaactaatatttaggagtgttttcaccattctatgattgcccaaaaactaagtgatacttataaaaacactaagttttatacatatactagttggaaatattccaagctgtagaaatattccaacaaggattatttccatggggttaatttgttaaaaatataaaagacaccacctttctattaatttgtaacaactaattgacatcagagaagatgaaaatttactagctggatatcaaccagatttttgtattattggcaactgagattgaaaaatgaatgaaagagtctacttcatccatttagatatcctttcacttggatctccctgtttccttactgtcctaatgaatagaaatgatcgttacaagctgggcatggtggcttgcacctgtagtcccagctactggggaggctgaggagggaggatggcttgaggccagagttgaaggatccagagatgattgcgcagtgacgctaagcttgggccacagagttgagaccctgtctctaaaaatttttttttaatttaaattataaaaagagaaatgcttgttacaaccacaaagggaaacaagatatacacatataattgtggaagtaaaaataaataatttaaaaatacttttgggtgctcgcttcggcagcacatatagttggaatgatagagaagatttgcatggcccctgcgcaagatgacatacaaattcgtgaagtgttccatatttaaaaaaacaaaaaatacttttgggcctggcactgtggctcatgcctgtaatccaaacactttgggaggctgaggcgggcggattgcttgaacccaggagttggagaccagcctggacaacatggtgaaatcccgtctctataaaaaaatacaaaaattaaccaggtgtggtggtgcacgcctgtaatccaaggtacttgggaggctgaggcgggaggatcgcttgagccaggaggttgggcctgggtaacagagaccgtctcaaaaaaatttaaaaattaaaaaaaaaactttctgcaagatgaagtgacaatacctggaaaatacatgtgacttgaccaaaaattactataggtgaaaataaatttagcaaagttgctttcctaaatacaacccaaaatagactgggaacagctacatactgttaatggttccctctatgtgacattctagaaaaggcagaactatagggagggaaaacatctgtggttgcccaggagctaggggtgggaagagggaatttactacaaagaggcacgaagaaacttgtgggccagagctattttggtctccgttttggtgatgtatatacgtttgccagagttcacagaactgcacactgaagaaagatggatttcacggaatgtgaattatatctcaacaaacttgacttcaaaaaacagatcgagaaaagatgattctattcccaaaaagggggaggggggaagatcattatataggtgagtgttcatttaaatcagagtacgagatttatccgtgaaaatcgcagtggagcgaacaagggggatgctgataccgacctcctggttggaaagcctgtagagcagcgcggatgacagtggaacagcgggtcaggcggtgggcgcctgagcgaggggctagagcgggatgggcgggcggagcaagcctgccagcctgggcggggcctcggcacaggagctggctgcgggagcccgccgtcctgagtcgcaggccgaggagacagtgagtgcgcgccctgagtcgcaggccgaggagacagtgagtgcgcgccctgagtcgcaggccgaggagacagtgagtgcgcgccctgggcgccccgccccagcccccagccccttccctgggcccccgcaaggcgggaacgcgagcgcctcccccgagctgtgtctcgagacctttgtcctcccctcacccctcggcccgctgcctgccctttactggccccctccctcatgcccgtccctcagcaccctctcctttcaactaactttcccgctcccgacagtggctgcacttcgtgacgctgagatacagaaggacgtgcaggtgagagctgtagggcctggaatggcccaagtggagcctaggctaatggaagtctggcctggcccgcaccctgtcccccgggactcctggagtcggggtagggcagggtctaggcttcgacctttccagggaactgaggtcggccaagtggaggtggaggtggtgacggagccctcgcgctgcagtcacagctcttctccctctctacccctcactccactgtgggacgctgggtcagacctactacgggcaggtgctgaagagatcggcagacctccagaccaacggctgtgtcaccacagccaggccggtccccaagcacatccgggaagccttgcaaaatgtacacgaagaagtagccctaaggtagagtgccctgtgctgtccccaggaagaccccaaacagcagttttcccaaaagataatgatgcaggtcactagggaattaacccgtagccaccaacccatcagcttgccttgtctattgtaaaaatcctaaatctcagcacccatcatcttactgctctaagaacctccgatgagtctgggcgcgccagtgagcctgtagtcccaagtgcttgggaggctgaggcagaggatcgcgtgagcccagaagttacaggctgtagtgtgcgatccgggatgtgaatagccactgcactccagcttggtcaacatagccagatgcatctctaaaataaatgcgtactttaaaaaaattgcctaaaaaaaagaacctccagcgtgaacactctgtagtccctacccatgctcacagaatacagtcacactcactggatctgccattcaagatatgcgcagttcagcacccactaatcaaccttggcccttttgacccttcccttcctcactccatcagcactgcctgcccagccggcagtcaccaatttggaaggtcttcccttttctttttccttcccaaccctgcgcatccagcaccacgctgctgtcccacctactgcatggagccttctctaatccttgagcggcctcttccccaaactgccacagcactctgtcactcggtctgtccgtaaatcacgggaagtgttttctgtgcacgatgttttatctcgcctctcaaatacacctacgcggcggggagcggtggctcacgtccgtcatcccagaacttgggaggccaaggcaggtagatcacttgaggtcagaagttcaagaccgacctggtcaacatagtgaaaccctgtctctactgaaaatacaaaaattagctgggtgtagtggggcacgcctgtagtcccagctacttgggaggctgagggaggagaatcacttgaacgtggaaggcggaggtcgcagtgagcggagattgtgccactgcactccagcctgggcaacagagaaaaactcagtcaaaacaaaacaaaacaaaaaaaaggccgggggtggtggcttatgtctgtaatcccagcactttgggaggccgaggcgggaggatcacgaggccaggagatcgagaccatcctggctatcatggtgaaaccccgtctctactaaaaatacaaaaatattatccgggtgtggcggcacgcgcctgtagttccggctgctggggaggctgaggcaggagaacggcgtgaacccgggaggcggagcttgcagtgagctgagttcgagccactgcactccagcctgggtgacagggcaagactccgtctcaaaaaaaaaaaaaaaaaaaaaaaaaaaaaaaattagccaggagtggtggcaggcgctcgtagtcctagctactcgggaggctgaggtaggagaatggtgtcaacccgggaggcggagcttgcggtgagctgagatcgcgccactgcactccagcctgggcgacagagcgagactccgtctcaaacaaaacaaaacaaaacaaaacaaaacaaatcaaaacaaaaaacgcctatgggacagaaaccttacattttttcctcaataactagcgcagtcctgggcctgaattagaagctcagctaatgattaaatgtatttattcaacacattattttattttatttatttatttttgagacggagtctcactctgtcccttaggctggagtgcagtggcgccatctctgctcactgcaacctctgcctcctgggttcaagccattctcctgcctcagcctcccgaggagctgggattacaggtacctgctaccgtgcccagctgattttttggtatttttagtagagacagggtttcactatgttggccaggctggtctccaactccttgcctcaagcgatccgcctgccttgacctcccaaagtgctgtgattataggcgtgagccaccgcgcccagcctgaacacattattttagatggcttatgaagtcttagtgcctagcacatgcccaacaatactgtggtaaagcagatacagtcccagccttcatgggtgtccagttcagtggagactaaacatcagaagtatgagtgaatgatgcaagaaagaaggaaggaaggaaggaacggagggagggagggaggagggaagtatgtataagatttagtggtttcatgtcttacagtctccagggaaaaaatatgtgttttccatttcccagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtgaggcatgatttggaagacaaggagaaaaagattctcaaaagcattatttgaaaaataaagttgttttcttcgtggctcttcaaggataatttaagaaagcttctagttagcaatgctcatttgtgccactagtgcttcctgtcttggaaactgataacttgaacaattaggggttcttctgggcgaacacaagagtcggaggtttgctctgatatgaatatcgtgacgatagagtggactttgatctttcccttcttgctgccatctatcctgaaagattttgttattgaatgaggagtttattcaagccaaactgcacgggcagcagggagtttatgtcccaggttgtagtatatcctacgtgtccacaggaatcttgtatgtttatccaaaataatctaggggaagtatattctgttagtgataggaaatttttaggaaaaagttgtgtatttttttcaaaatgttatcaaaactatatttttcttactttaggtggaagtggctgaaaagtatcttgactatcacatggaaaaatatggcttccaggcatctaatgtgacttttattcatggctacattgagaagttgggagaggctggaatcaagaatgagagccatgatattgttgtgtaggtctatattcttactgttatgactatagcccattttctttattattattattattattattgagatggactctcgctctgtcacccaggccagagtgcagtggcccaatgtcagctcacgataacctctgcctcccgggttcaactgattctcttgcctcagcctctcaagtagctgggattataggcacacgctaccacatccagctaattttttaaatcttcttttagtagagacagggtttcaccatgttggccaggctggtctcaaactcctgatctcaggtgatccacccgcttccacctcccaaagtgctgggattacaggtgtgaggcactgtgctcagccctcatttccttttgaacacagagatgtcactattactgtttgctgaattgactctcatttagggtgttaaactaaacttagcatggcttactaatgggagagagctggtttgagctgctggagctcaccagcagcagaacacaccagaccaagagggaacttacttgaaacttaaccacaaaccaatgaacccaaaagaccagcaggaccactaagtttgctcctacaatacatgctgacctgtatctttcataatattttcatggtaaattataggattctatttccttttttccctcaagttgttattgtcaaatcatgcccaagtgacagctgcctttgaggaacatagcctgtttacgtgaagcataagaaatgccttgtgccggccaggtgcggtggctcacgcctataatcccagcattttgggaggccgaggcaggtggatcacgaggtcaggaattccagaccagcttgaacaacatggcgaaaccccgtctctactaaaaatacaaaaattagctgggtgtggtggcacatgcctgtaatcccagctatttaggaggctgaggcaggagaatcacttgaacccgggaggcggaggttgcaatgagccgagattgcgccattgtactccagcctgggcaacaggagtgaaacatcctctcgggaaaaaaaaaaaaagaaagaaatgccttgtgcagtaggcatctggtctgaggtttcatcttgttacatggtgaacatcaggacagaaacaagtaagaatcatgcctgatgttattttctgcacattcaaacttgctaacaatttattgagattttaagcactctgtctctgatcttggggaaaagcttagttgaaggcattagaaagagaggagggaggcggtaagaatggggtagctttgacagaacggtgggaaccacctttagggtctgaaaggatttgcagatctctgagtgttgtgaagatttgctcgacatttcatctgttctcttttagatcaaactgtgttattaaccttgtgcctgataaacaacaagtgcttcaggaggcatatcgggtgctgaaggtgaggaggagagtgagataaattatctttgaacatcagtaagagctgatgggttaagtcttgtttgttcccccttgaactaagagctcaaactctcttaatttatccattaaatgaataaggggtggcaaaagggggaaggggcaggaataccccggatatggattactttccctcttaggttgcaaaaggtagtaaatccgaggtgacagttgtcactgaatgtgttaaggtatttgctttcttgactgtctctcctatttgctgctgtacatgatcctagaagagcatctgtggagctataggaatctttgcactgactactaatgattgctttgaatatactctcttctagcatgtacagtgtttctcagggcttctgatttcttatctgtcatgatttcagatctttgggaagttacagaagatggaacttttacattaactacttgctaaaaggaaagcttgcaggagctccacagccttcattgtatcatgagatgtgtatcttcatgatagtagatgaaatattcagccaggtgcggtagctcacacctgtaatcccagtgctgtgggaggccgaggcgggcagatcacctgaggtcaggagtttgagaccagcttggccaacatggagaaactctgtctctactaaaaatacaaaaattagctgggtgtggtggtgcgtgcctgtaatcccagctcctcgggaggctgaggtaggagaatagcttgaacccagaagtcagaggttgcagtgagccaggatcgtgccactgcactccagcctgggagacagagcgagactccatctcaaaaaaaaaaaaaaaaaaaaaagattctagctgggtgggtggtacatgcctgtactcccagctacttggatgctgaggcaagaggattgcttgagctctggagtttgtgtgcagcttgggcaatatagtgtgatcactgcctctaaaaaaatgtttttttttttgagatggagtctcactctgctgtccaggctgtagtgcagtggcaggatttcatctcactgcaacctccgcctcctgggttcaaacaattcttttgcctcagcctccctagtagctgggactacaggcgtgtgccaccatgcccagctaatttttgtacttttagtagagacaagatttcaccatattggtcaggctgatcttgaactcctgatctcatgatctgcctcagcctcccaaagtgctgggattacaggcatgagccgctgtgcctggccaaaatttttttttaaattgacaacagatttttgagatttttggtttacaaagctgtcatagaactcaaatacaaatatctatatagaaatgatttaatgatttagtgatgtctttgttagtatgtcattttacacgccagttcactatctccaccaaaaatgtacttataaaaggtagaaacactattatagaatctagatctccaggtttccaggtttttgaaattagctaaataaaatgttaagttcctgatcactcatttgccttacattttaaggataatattttaaagataaaatgtgttgttataaaagtaaataacaacattacaaaaagttatattttttaatagaaatggggtcttgctgtcacccaggctggaatgcagtgtcactatctgtacccctctaactcctgagttagaggggtccagatagtgacactcactgtaccctctaactcctgggctcaaacaatcctcttgagtagctaggactccaggcacatgccaccatgcccagctagtttttaaatttctatatgggagagagggtcttgctgtgttgccaaggctagtctcaaactgctctcctccagcaagcctcccacttcggcctcctgagtcattgggattagaggcctgagccatcatacctggcaaagttatactattcttaagagataaaagattatgaatactgatgatatcctctgttctacaatgacctggggctgcttttggttcagattggctaaaaatttaaatgtaagtaacctgaaaatctttatttaggagacagacactcttagaatgtgattttattacctgttggataagccactgggaggaaaaaaaaccttggcacttgactattgattgtaactaaagaggcagctgctatttgttcacaaagggtcagcttaaacattgctattgatttttaaatttgattttgttcccctattcctttctttgttatgtggggtcaatgtaatcattaatcatcttgtttggactaatatgcctctgtttcagcatggtggggagttatatttcagtgacgtctatacgagccttgaactgccagaagaaatcaggacacacaaagttttatggggtaggtgattttgtttagtttagtattaaggcagatggttgtacatgtgcagaactcctttctgctaatagccaggatgaggctatatgagatcacatggggttaggccatgaggccaaggttccattcttcctctgccattcaaaagtgatagggctttggatagtttaattcatctctttgagttatcgttttccaaattgtaaaatgtaaataataatacaatctgccttatagggctgttatgaagattaaatgggataaagaatgggaaaaatactttgaaaactctagtgtggaaatgaggacaattgttcccaagctggtgtcctcttagtccccttatgttctcatcattattgtgttctttattcctttattatcattttaatagtctggaagttgagataaatgcatgcttttcatcagtctatgaaatcaaaagttcttattcttaaaataatattaactttattcttactatgtaataataaataggtaccgttaacaagttggaaagtgccaaaaaaaaaaaaaaaaaagaaaaaattactaagctggacacagtggcacacacctgtaaccccagatatttgggaggctgagtcaggaggattgcttgagcctaggagttcaggtacagcctgggtgtcatagtaaaaccctatctcttaaaaaaattacttataatcatataacccagtgataacttcttttttttttttttttttttttgagatggagtctcgctctgtcacccaggctagagtgcagtggcgcaatcttggctcactgcaacctccacttcccgggttcaagtgattctcctgcctcagcctcccaagtagctgggattacaggtgcatgccaccatgcccagctaatttttgtatttttagtagagatggggtttcactgtgttggccaggctggtctccaacacctgacctcatgatctgcccacctcggcctcccaaagtgctgggattacaggcatgagccaccgcgctcggcctatgatttattttttatactactttattcacataacagtgcttttcagaatgtggcgtactgcatacatgaatattatgcttgcagctgagtagaaccaatccaccagtgagtgtcctgaagaatggttcctagagaccatcagctagcacacccagtcttaaccatggctttctagaccttggagggatgctcaagttagcttctactgctaggatctatgttttaactaataccatgtcctaattaattatatagaagaatagttcccttaatactgtattaagtgttggctggtctgtggttttttgttgttgtttgttttttaggtgagtgtctgggtggtgctttatactggaaggaacttgctgtccttgctcaaaaaattgggttctgccctccacgtttggtcactgccaatctcattacaattcaaaacaaggaactggaaagagttatcggtaagatatgacagacagcagggactattataactacagcttgaatgattgaaatgtggtgattagtaagtaacttctgaaggagtctcattgagggatactttctgttatctggaaatagctatcttgcctcctgtacaatggtaaccccccaaaaattttgatatttaataaagcactttgaagtcattcagtaaatagagtgaagtgctcagaaagataactgatgacatgcaaggaagaaaatcatctttataacgtgtttgctccttgtctgctgagcaaggcaacaactgggggagtgctggagatgaaccgtgaataaattctatttttaggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggtaaataaaacaatttccatgacttctggtattctttctgctcttgcccttgctccagctatcttttcttgactttgcattgcctcccatttttctggtgttggtttgtttgtgtgtgtgtttaaatgtatgtgtgtgtttcaagtggagtaaaaaagcattttttccccaatacttatttatttattgacagggtctcgctctgtcacccaggctggagtgcagtagcacaatcatagttcactgcagcctgacctcctgggctcaagcgatcctcccacctcaggcttctgagtagctaggactacagactcatcaccacacctggctaatatttgtattttttgtagagatggggttttgccatgttgcccagactggtcttgaactcctgggctcaagtgatgtgcccacctcagcctcccaaagtgctgggattacaggcgtgaaccaccgtgcccagccctcaatatttattataaaaatgtttttggccaggtgcggtggctcacacctgtaatcctagcactttgggaggctgaggcaggcagattacctgaggtcaggagttcgagaccagcctgacgaacatggcgaaaacccatctctactaataaaaatacaaaaattagccgggcgtggtggtgggtgcctgtaatcccaactactctggaggctgaggcaggagaattgcatgaacccgggaggtggaggttgaggtgagctgagatcatgccattgcactccagcctgggcaacagagtgagactccatctcaaaaaaaaaaaaaaaaaaagaagtttttgaatacagaaaagttaatagtacaatgaatacccacataggcattacctatatttcagcaattgagaacatttttccatgtttgtgtgtttatatgtgtatatatatatatatatttatttgctgagccattgaaaataagttgcagatattatgacattttacccttaaatatttcagcatgcgtcccataggaatgtaatatccctctgcataatcacaataccattacacacctaagaaaactttttacaagaagcctcattcagacattggattaatagggctatagagaagtaggatggaaaagagtaggagtatgtacaatagtatttcaattgtttaattgtgtcaaggaattaagaaattttaatgttggatgatggcactaattggcatttttactgccctgtgcatagtaagatttgttttctcaaaatggaaaagttcaggctttggaatcagatacctgggttcaaattctggctctattattattgttttttatttttttttctgaatgtcactagacaaacttttattgaagcataaattgtggtacagaaatacattttaactgatttaagtccaacaccagtgaaaggagagattatggcaccaaaactttccctttcctatcataccatgatttagattatgatgcaatctacatttctcttttctaggctttgtcccatacaaatttgggcagtttttcaacattagaatttcaacattagaattcttaattctattaggaaaaaaagcaacaaaaaaaccagacctcaagtcaacaaatctattggatattgtttatgaacgaagtccacgttaagcattggtcctcaaaacagagctcctcaaaatattaggtgctgtgctcattacagaatcaaactgatcacactgattgaaaacttcctcaatgaaattttcaatcaacaacatgcttcaaataaaagtcaaacagtgttccaaccacttgacttcaaaccaagtagattttaggtttagaaacactaaaaaaaggtgtttcatttataaatacagaaggaacaaaaacatcactgcatcaatccagaaattatcaaaatatttagaggacaagaaatataaaatttagtcaactttgctgctttctcagttccttaaaatcccagagtatctgcaaatatagctaaaaagtaccaactcttgaaagcctatattactagtcatttcccattgagtattttggaattttatttatgttctacttatttattcatgtattctgctttatgatgtttatctgaataatctggacaaattctcattctgggcagtcattcgtttcatcctatgaatgccatggtgagggaaacagtgtagttagaggaacagatgaagtcagaacactcacatgcatcacggtcacagaactttaagtcacaagacagaaaagaaatcgattctgctttggatcaaagtttatagaacactacttaatggaaactagtggaaatggctgctaaaggaaaagttaaggtgaatgatccaagctgacttgattactgaatccagaacaaaattatgctaaatctctctggtaattaactaaataaaaatcattttatactattatttagtaagttagtaaaggcgtgctactcattagatgctaatctcatttactgaggaacacagaattgtatatgttttctggctctattatttattacttgggtaaacttgaacaagtcaccaaaattcgttgggttacagtttgttctactgtaaaagcagggataataatacttactttgcagaatttctataaggattagcaataatgtagcaaaacactgggtacatactgcaagttcagtgaaaagaagatactgtcattatttgttccaaaagtggaagaacttactattaatatttcatttttctgatttatttatttatctattttagagacaaagtctctctctgtcacccatgctggagtgtagtggcacagtcatagctcactgtaacctcaaactcctgggctcaagcgattctcccatctcagcctcccaagtagctgggactacaggcatgtgtcaccatgcctggctaattttttatttttatttttttgttggtgagacaggttttttttttttttcttttttgagaccaagtctcgctctgtcactcaggctggagtgcagtggcccgatctcggctcactgcaagctccacctcccgggttcacgccattctcctgccttagcctcccaagtagctgggactacaggtgcccgccaccacacccggctaattttttgtatttttagtagagttgggatttcaccgtgttagccaggatggtctcaatctcctggcctcgtgatccacccgcctcggcctcccaaagtgctgggattacaggcgtgagccaccactcccggccaagacaggttcttatattgcccaggctggtcttgaactcctggcctcaagcaattctcccacctcagcctcccaaagttgcaagcatgtgtcactgtgcctggcttcttctgatttttttggtctaaatagcatctccagatttcttttttttttttaatttaaaaaatgtatttatttctttatttagacacagggtcttgctatgttgcccacactggggtacactggctattcacaggtgtaagcatagcccactatagtcttgaactcctggcctcaagggatccttccacctcagccttccaagtctgggactacatctggctaagcatcttcaaatttcttatttatttatttatttatttttgagatggagtcttgctctgttgcctaggctggagtgcagtgactcaatctcagctcactgcaacctctgcctcctgggttcaagccgattctcctgccttagcctctcgagtagcagggattacaggcgtgtgccaccacacccagctaatttttatatttttattagagacagggtttcaccatgttggccaggctggtctcgaactcctgacctcaggtaatctacccgcctcggcctcccaaagtgctgggattacaggcgtgagccactgtgcccggctgcatcttcaaatttcttaaatactccttggtatagtggagcccttaatgcttttcactaatgcactgctccttgatgtgctgcctattccagtagatacacagaatcagagtggtaagggcctttgaaaccattgatttgttctagtggctttcaaaaaccatttttaatacaattattttttaagcaaaatgttttatatatatatatatatggtttttttttttttgagatggagtcttgctctgttgcccaggctagagtgcagtggtgcaatctcggctcactgcaacctcagcctccctggttcaagtgattttcctgcctcagcctccccagtagcttggactacaggtgggtgccaacgcacctggctaatttttgcatttttagtagagacagggtttcaccatgttggccaggctggtcttaaactcctgacctcaggtgatctgcccacctcggcctcccaaagtactaggattatagatgtgagccactgtgcccagccagaaatgcactttaaaaaccaccagtccttgcctgggcatggtggctcacacctgtaatcccagcactttgggaggctgaggcgggtggattacctgaggtcaggagttcgagaccagcctgatcaacatgatgaaaccctgtctctactaaaaatacaaaaattagccgggcgtggtggcgtgtgcctgttatcccagctactcgagaggctaaggcaggagaatcggcttgaacccaggaggcagaggttgcagtgagctgagattgagtcactgcactccagcctgggcaacagagcaagacttcatctcaaaaacaaacaaacaaagaaaaaacccccaatagtccaaagccctaattttccccccattatttatttttttaatgggcaaattttaaaaattgtatatatatttatggtgtacaatgggatgttttgacatatgtatacattatggaatgactaaatcaagataattaaaatgcattacctcacatactcaccatttatttgtgatgagatcaaagtctactcttttagcaattttcttttttcttttcttttctttctttatttcttttttttttttttttgaggcagaatcttgctctgtcgcccaggctggagtgcagtggcacaatctcggctcactgcaacctccacctctcaggttcaagcgattatcctgcctcagccttccaagtagctgggactataggtgtgtgctaccacacccagctaattttttgtatttttagtagagatggagtttcaccatgttggccaggctggtcttgaactcctgacctcaggtgatccccctgcttcagcctcccaaagtgctgggattacaggcgcgaggtgcccagccttttagcaatttccaatacattgttattaactatagtcaccatgttgtataatagatctctttaacttattcctgataactgaaattttgtatcctttaaccaacatctatcctgttccacccctgccctcccaccccctacccccagcccctggtaagagcctctactcttcacctctatgagttcaactttttgaaattccacatataatctagcgaggttatgcagtatttgtttttcagtgcctgcagatatgacatttttgggttcaactttttgtttgtttttgagatggaatctcactcttgtcgcccaggctggagtgcagtggcgtgatcttggctcactgcaatctccgcctcctgggttcaagccattctcctgtctcagcctcctgagtagcagggattacaggcgcctgccaccgtgcccagctaatttttgtatttttagtagagacggggtttcactatgttggccaggctggtctctaactcctgacctcagacgatctgcctgcattggcctccaaaactgctgggattacaggcatgagacactgcgaccggccaaacatttttttaatgcataatagatgtacatactttcagggcacatctgataatttaatatattcatataatttgtacagatcaagtcaatgtaactggtatatccatcgccttaaacatttgtcttttctttattctaggaacccatttgaattattcttttctagctattttgaaatatacaatagattattgtgaactatagtcaccctactgatccatcgaacactaggtcttatttcttcttattaaactggattttgtactcattaatcaagctctcttcatcctccccactctacctggcgtctggtaaccaccaatctactctctattatcatgaggtccacttttttagctcccacatatcagcgagaacatgtaatattcgtctttttgaggttggcttatttctcttaacataatgacctgcagttccatgcatgttgctgcaggtgacaggatttccttcttttattttattttattttatttttttgagacagagtcttactctgtctcccaggttggagtgcagtggcgtgatcttggctcactgaaacctccggctgccaggttcaagtaattctcctgcctcagcctcctgagtagctgggactacaggcgcgtgccaccacacccaactaattttttttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccactaatttttgtatttttagtagagatggggtttcacatgttggcaaggctggtctcgaactcctgacctcaggtgatccgcctgcctcggcctcccaaagtgctgggattacaggcttgggccaccgcaccaggccaggatttccttctttttcaagtctgaatagtattccagtgtgtacatatactactacgttttctttatccgttcatctgtttgagtcttctttttttcttagtttagctaaagatttattttattttttcaaaaaactaatttttcattttgttgatcttctgtatttttttagtctcaatttcatttatttctgctgtgatgttctttctttccttctactaattttgagtttgatttgttcttgcttttatagttccctcatgggcattactaggttgtttatttgaagtctgttccttctttccttcattccttccttcctccctccctccctccctcccttcttccttccttccattctttcttttttttttgagagggaatctcgctctgttgcccaggttggagtgcagtggcgcgatctcagctcactgcaacctccacctcccgggttcaagcaattctcctgtctcagcctcccaagtagctgggattacaggcatgcaccaccacgcctggctaatttttttgtatttttagtagagacggggtttcaccatattggccaggctggtcttgaactcctgactctgcccgcctcagcctcccaaagttctgggattacaggtgttagccattgtgcccggcccttctttcctttcttcttctttctttctcagggtctcactctgtcacctggactggagtgcagtggtgcaatcatggctcacagcagctttgacctcctgggctcaggcaatcctcctaccccagcatcccaagtagctgggactaaggctaccatgcctggctgatttttgtattttctgtagagacaggctttcaccatgttgcccagtctgctcttgaactcctgggctcaagcaatccacctgccttggcctcccaaagtgctgagatcttatttgaaatctttcaacttttttgatataggcattacttgaaatctttctacttttttgatataggcatttattgctataaactttcctcttagtgctgcttctgctgtatcccatagatttttgcatgttgtatttccattttcatctgtttcaagatattttaaatttttctcctaatttcttcatggacccattggctattcaggagcatgttgtttaatttccatgtgtttgtgtattttccaaggttcttgttattgatttctaattttattccatagtggtgagaaagatacttgttatgatgtctacttttctgaatttgttaagacttgttttgtggcctaagatatagtctatgctggagaatgttccatgtgctattgagcagaatgtctattctgcagcagttgagtaaaatgctctgtgaatgtcagctaggcctatttgagctagtatatagtttaatgtttctttattattttctgtctggatgatctgttttactgagagtgaggtgtggtgttagagtcccctactactattgcattacagtatatctcttcttttagatctattaatgtttgctttatatactttggagctccaatgttgagtgcaaagatacttatatcttcttgctgaattgacccctttatcattatatagtaaccttctttgcctctttgacagccttgattcacagtctgttttatctgatgtaagtatagctactcctgttcttttttggtttccagttgcttggaatgtcttttttccaccccttaacttccagtatttttataagtaaagtaggtttcttgtaggcagcatataatttggtcccatttttgtatccattcagccactctattccttttttttggggggggttcccaagttttattcaagaactcataccaaatattccagataaataaatttttatcttcaccttcctcctcttctttttccaggttaatctggaattaacgtcattcataataactctttttgctgttagcaactacacacaacaaatcacatagattattcttcaaatattttttggtgagatatttcaaataccttttggaaaaaggtacctcagaagtcacagtgatcttgctgttgctcctttcgatggttataatgctccaccaagattcccagcttttccattcactttaatcctctcttgcaaaaactgctcaaaattggcagcatctatgattccattttctacaaggtgggtacagtcaagagtgaacatcataacctgcttctttttttgcctctctttgccacaagctttttcacagcactatgcctcttaattggagaattgagtccatttacatttagtgttattattgatacataaagacttaacatttttttaaattgatacataattgatgtagctattttggggcgttcatgtgataatttaatacattcatataatttgtaaagattaaattagtgtaattgggatacctatcaccttcaatatttgtcttttcttttctttttttttctgtgagatggagttttgctttttttgcccaggctggagtgcaatggcgcaatctcggctcactgcaacctccacctcccgggttcaagcaattctcctgcctcagcctcccgagtagctgggattacaggcatgcaccaccatgctcagctaattttgtatttttagtagagacggggttttaccatgttggtcaggctggtctcgaactcctgacctcaggtgatccactcgccctggcctaccaaagtgctgggattataggcatgagccaccacacctggccctgtcttttctttatgttggaaacattcaaattattctcttctagctattttgaaatatacaatatattattgtaaactagtcactttactgatatatcaaacactaggtcttatttctttcatcaaaccctatatatatatatatatatatatatatatatttttttttttttttttgagacggagtctcgctctgtctcgctctgtcgcccaggctagagtgcagtggcacaatctcggcccactgcaagctccgcctcccgggttcatgccattctcctgcctcagcgccccgagtagctgggactacaggtgcctgccaccatgcccggctaattttttgtatttttagtagagacggggttttaccatgttagccaggatggtctcaatctcctgaccttgtgatccacccacctcggcctcccaaagtgctgggattacaggcttgagccaccgtgcccggccaaaccctatatttataaccattaatcaacttctctttatctcccccattctgtaccctttctggcctttggtaactatcaatatactctctatcttaatgagttccactttttttagcttccacatatcagtgagaacatatgatatttgtctttctgtgtttgccttatttctcttaacatgacctgcagttccatgcatcttgctgcaaatgacaggatttccttctgttttaaaatctgaatagtattccattgtgtatatatgccacgttttcctcatccattcatccattgctggatgcttaggttgattccatatcttggttattgtgattaatgctgcagtcaacattaggagtgcagatatttccctgacatactgatttcatttcattcccttcccttcccctgcctgtctgcctgccttccttccttccttccttccttccttcctttcttccttccttccttcccttcctccctccaccccccccgcccctttcagatggaatctggctctgtcgcccaggctggagtgcagtggcgcaatctcagctcactacaacctccgcctcctgggttcaagcaattcttctgcctcagcctcccgagtagctgggattacgggcatgtgccgccatacccagctaatttttttgtatttttagtagaggcagggttttaccatattggccaggctggtctcgaactcctgacctcatgatccacctgcctcagcctcccaaagtgctgggattacataggtgtgagccaccgtacacagccagtttcattttcttttcttttttttttttttttgagacggagtctcgctctgttgcccaggctggagtgctggagtgcagtggcacgatctcggctcactgcaagctccacctcccgggttcacaccattctcctgcctcagcctcccaagtagctgggacaacaggcgcctgccactatgtccggctaattttttgtatttttttagtagagatggggtttcactgtgttagccaggatggtctcgatctcctgaccttgtgatcggcccacctcggcctcccagagtgctgggattacaggtgtgagccaccgcgcctggcccattttctttagatatatacccaagtagggggattgctgggtcatatagtagttctatttttaattttttgaggaatctccatactgtttcccataatggctgtactaatttaaattcccaccaacagtgtgtaaggattagtgctggtgaggatgtggagaaaacgatacttctgggcattttttcttctattgagactaaagttgcaactcttagtatttttttttatactaccctttaggaaggtgaaattgttgaagtggatgaagaaacagcagctatcttgaagaattcaagatttgctcaagattttctgatcagaccaattggagagaagttgccaacatctggaggctgttctgctttggagttaaaggttagtttggctttcactacctgagagaactattttatttatttatttttgagatggagtctctctctgtcacccagactggagtgcagtggtgtgatcttggctcactgcaacctccgcctcctgggttcaagcaattctccctgcctcagcctcccgattagctaagattacaggcacccaccaccacgcccggctaatttttgtgttttttagtagagatggggtttcgccatgttggccaggctggtcttgaactcctgacctcaggtaacccacctgcctcagtctcccaaagtgctgggattacaggcgtgagccactgtgcccggccagtatgcatggtctcttgaggcgcacttctcttgctggtcaaatgttgttagacggttatataccagttaaacgccaccattttgcctcttaatgtgcatgcttgagcccacttgcccaactcccgagatcttatcgggaagctgctgatcaccagtttcaggtgtttctgtttattgggagacttcctttccctggtactgtctgtgactaattatgattttcgagagacagttaacaaccacctgatcatcacctaatgatcgcctgacattcctggtggagtcggcgcggggagccctctcctgccctgctcacgcctgactagctattatacctgctttaacaagttctccaaaattcagagacctttcgtgagtattctgattttataataaaatagttatttgcataagtttagtaagagtcttttctctcaaaacaggacaattggagacacttggttattttaccaaagctttgactggaataacatttgtaggtaaagttccagcaaagccaacttgaaaagagcctatctggccaaactcttgctggacttcatgcaaatgatcaggcaaagtttaataagcctaaaatttattttgcacataaattggccttactataatttgtctttagtataaaaggaggagctgggtgcagaagttcacactcataatcccagcactttgggaggctgagacaggcagatcacttgaggccaggagtttgacaccagcctgggtaacatgttgaaaccctgtctctaccaaaaatacaaaaaaattatctgggtatggtggtgcatgctggtagttccagttactcaagaggctgagatgggaggattgcttgagcccagggaggtggagggcaatgagccaagactgcaccactgcactccagcctgggcaacagagtgagactctgtctcaaaaaaaaaaaaaaaaaaaaaaaaaagaaagaaggctagagagagaaatggtttcaaaggaaaactataacacttgttactagatttccagcctggacttttgtttttgagtgcatattgaatcattaattatttcttggctacaataaccctctaaagataaaccaggttataatttttcttcatgtttttagtttgtgccctaagtggaataggttccttattctgttctgacacacgaatactcttttgactgtcatattattaatgttatttatagctccttgttttacttccaaagaaaccagaatcatgatattctaaggttagagaatcccccgtttggaatcccactggtcctaatctgcttttcactgcaaattccgtgctgctaaaattatataagcactcttctctaggcccagggacctatcacacaaaaggtaggtgtgtgagactgtaagggccagttttgagagaattatttcagactctccaaatcaaaaatgggcacacagatgcataaacagctggtaaaataagggactctgcctcctgggttattatgtgtgtggcaccttttcatccatcccaatcataaagaatttcctgcttctcgtagaatgaaaagaaaattattactgagaggatataaaggtacctcatgtcaaagcctcctaggtttaatactctgagttatgagatttatgcagataacatatatattttttaaaattttagaacaggccaggcacagtggctcaagcctgtaatcctagcactttgggaggccaaggtgggcagattgcctgagctcaggagttcaagaccagcctgggcaacatggtgacaccccatctctactaaaatacaaaaaataaattagatgggcatggtggcgtgcgcctgtagtcccagctacttgggaggctgaggcaggagaattgcttgagcccgggaggcggaggttgcaatgagacgagattgagatggcgccactgcactccagcctggcaacagagtgagactctgtctcaaaataaataaataaataaataaataaataaataaataaataaataattttagaacaaattactgaaagaccacaaaaaaaaaaactgtagcacaacggaagtctctaaattccttagcttaaaaggttttaacagtgcttatgttttgtatagctaattgctgtaagtctgtaactaaaaccaagattacagtagcacaatgcatagaagttaaagataagtcaattttttaacctcacctttggctttttgtttgttggcttttatattaagaaattttaagggtttattaatgcctatccacatccattcccatctggcctagaactttcttttttttggtgggggagggggacggagtcttcctctgtcacccaggctggggtgcagtggcgtgatctcatctcactgcaacctccgcctcacaggttcaagtgattctcctgcctcagcctcctgagtagctgtaattacaggcatgtgccaccatgcctggctaatttttttttcttttttttttttttttccgagatggagtcttgctctgttgcccaggctggagtgcagtggtgcgacctcggctcactgcaacctctgcctcccaagttcaagcgattcttctgcctcagcctccagagtagatgggactacaggtgcgtgccaccatgcctggctaatttttattttatttttttagtagagatggggtttcatcatattggccaggctggtctcgaactccttacctcatgatccacccaccttggcctcccaaagtgctgggattataggcatgagccactgtgcccagccctaattcgtatttttagtagagacagggtttcaccatgttggtcaggctggtctcaaactgctgatcttaggtgaccaacctgtctcggcctcccaaagtgctgagattacaggggtgaaccaccatgcctggtctggcctagaactttcaaattcgctatgtgtcttttggctctaagccccttgaccataggggtcccaccaaggcacaagatggacccagggaaggcagctgtgccaccccagcaacacagtgagataaaataaaagtttggtgaccattgatgttgcctctgacaaatctaggccagaatgcggagaaagtaaatcaaaaataaaattctaggccgggcgcggtggctcacacctgtaatcccagcactttgggaggccgaggcgggtggatcacaaggtcaggagttcgagaccagcctggccaacatagtgaaaccccgtctctactaaaaataaaaaatcagccaggcgtgggggcaggcacctgtagtcccagctacttgggaggctgaggcaggagaattccttgaacctgggaggtggaggttgcagtgagccgagatcatgccactgcactctaacctgggcgacagagcgagactccatctcaaaaaataaaaaaaaataaaaaaataaaaaaataaaataaaattataaaccctcaaccatctgaacggacccctcctgtcgggcaaaggcattgcaaagttatcctaaaaaactagttcaggtcacgaagggaaggagaagtttggacatgcctcattattccctcctcccttttggaattcagacactgctgaccagcattaccattaaaacagatcttaagactgatagaacagactctttaaatctggtaagaaacatttacaatctattctctctgtagcctgctgcctagaggcttcatctgcatgataaaaccttggtctccacaatctcttatcataacctagacactcccttctattgatcccaggtctttggattataactcaaccaattgccaatcacaaaatctttgaatctgcctgtgacctggaaatccccacttccagttgtcccacgtttctggtctgaaccaatgtacatattatatgtattgattgatgtcttatgtctctctaaaatgtataaaaccaagttatagggtgaccactttgggcacatgtttgcagatctcctgagggctgtgtcacaggccattggtcacttatttggctcagaataaatctttttaagtattttagagtttgaccctttttgttgacaatgtttaacatcctacagttatgacaccctaatttgaatttatacagcttaacttcaataacatactaaaattctgctcctttaaagcttgttctcaactattttagttcttttttttttttttccattgacagagtttcactctatcacccaggctggagtgcagtggcacgatcttggctcactgcagcctctgcctcctgggttcaagtgattctcctgccccagcctcacaagtagctgggattacaggtgcgccagccaccatgcctggctaattttttgtatttttagtagaggcggggtctcatcatgttggccagcctggtctcgaactcctgacatcagatgatccaccagcctcggcctcccaaagtgctgggattacaggtgtgaactaccacgcccgggtctttctagttcttgatatcacaaaattatgtctttattcattttgtgcccccaaaacgtaaactaataattattttaaatgcattggtctcttaaatcatgtggaaaacaaaaagtagagttacaaaccattgttacaataatactagctttgccgggtgtggtggcttacgccaccaggtgatccacccacctaggttgcccagcctgggcaacaagagcacaactccatctcaaaaaaacaaaaacaaataaacaaaaaaccccaataataccagcttttttttttttttgagacagagcttcgctcttgttgcccaggctagagtgcaatggtgcggtcttggctcaccgcaacctccgcctcctgggttcaagcggttctcctgcctcagcttcccaagtagctgggattacaggtgcgcaccatcacagccggctaatttttgtatttttagtagagacggggttttaccatgttggtcaagctggtctcaaactcctgacctcaggtaatccacctgccttggcctcccaaagtgctgggattacaggcatgagccaccgtgcccggccaatcccagcactttgggaggctgaggctggcagaccacttgaggtcaggaggtcaagaccagcctggccaacatgctgaaaccgtgtctgtactaaaaatacaaaaattagctgggcacggtggcaaatgcctataatcccagttacttggggggctgaggcaggaggatcgttttgagcccgggatgtggaggctgtagtgagccgtgatcacaacactgtaccccagcctgggcgacagagcaagaccctgcctcaaaaaaaaaaaaaaaaaagcacaaagctttttgagaaatcactttcaaaaatggtacatttgtagttggggaaggttaatcgaacctaaaatataagaatcctggaccccaaaacctggagccagtattaccagcatgaatctaacccaagctcagtatacaagccacctgtagagctaaagagtgatttactaggccgggcacggtggcttacgcctgtaatcccagcactttgggagccgaggcgggtggatcacgaggtcaggagttcaagaccagcctggccaagatggtgaaaccccgtctctactaaaaatacaaaaaaaattagccgggcgtggtggcatgcgcctgtaatcccagctactccagaggctgaggcagagaattgcttaaacctggaggggcggaggttgcagtgagccgagatcgcgccactgcactccagctggggtgacagagtgagactccatctcaaaaaaaaaaaaaaagagtgatttactttctttgctttattaaattcttcagcactctgctattctgactcttctgttgttcgaagaaggtgatactttggaaagtagacagatttggcttttgagtattcaatccattaaacatttcaaaaatatgtcactgatattttgaaactcctgagagttcattgataaggaaagctgctggtgagaatcaatatttattttaaaaggcttttatcattctaattcttctaaaacctggtttcctaaatactgattataaaagctatcagaaggcgtggtggctcacgcctgtaatcccagcactttggggaggccgaggcgggtggatcacgaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccgggaggcggagcttgcagtgagcagagatcatgccactgcactccagcctgggcgacagagtgaggctccgtctcaagaaaaaaaaaaaatgctatcagaagataatggttacaagtaaagagggtctttcctcgagctacagtattttcagtgtactctggctttttttttttcctttgagacagagtctcgctctgtcacccaggctggagtgcagtggcacgatcttggcttactcctccgcctcctgggttcaaacaattctcctgcctcagcttcccgagtagctgggactacaggcacacgccaccacgcccggctcattttttgtattttaatagagacggggtttcaccgggttgcccaggctggtggtgaactcctgagctcaggcaatccgcccgcctcggcctcccaaagtgctgggatgacaggtgtgagccactgtgcccagccactctggctattttttttaaaaaaggagttaaatgagtttgcttctgcagatgaccattttctttctgcgtagctgtccttgttctccctcccagtgtgcgtgcaacacatgtacaggaggttcttgaccttagatataaattgtaaaattccacatatttgaactggtttatcccaacataaggtctcctttctgctttatttcagcctgcagatgtgccaatgtctttaggtcagtttcaagtttttgaaatgggaataagtgacactgaaggaagattttaataaatgaaacagttgtgtgacctaggaatataaccttgtgctcttagggaaggacattcttatcttttttttttttttcttaacggaagacctttatgataaacgctggagtacagacagtacacgcagctggcatgcagggtattgcatatacttaacatcttgagagtccttctgctttttcttcatcttctttttaatcctgatatgcaaaatgtattttgccattaaaacaattgtactattaaaacactgcagcatctggctgggcgtggtggctcacacctgtaatcccagcattttgggaggctgaggcgggtggatcacttgaggtcaggagttcaacagcagcctgtctaacatggtgaaaccccctctctactaaaaatacaaaaattagctgggtgtggtggcgggtgcctgtaatcccagctttttggaagactgaggcaggaggatcacctgggaggcagaggttgcagtgagccaagatcgtgccactgcactccagcctcggcgacaaagggagactccctctcaaaaacaaaaaaacaacaaaacactgcagcatctgaaatgatgcaaacaggattagggctatggactgtcttaatagtaatggtagtaatagcattaacaaccatagcagtaatatagaggaattaacttttattgaatagttaatatgtttaaggcaccctgtcatttagtcctcacaatcacccctattatcttcatttgacagatggagagactgaggctctgaaagattcatttacaaatccaaagtcatacagctagaaagtggtgaatttgcacccacatctgattctggagctggcactctaaaccagtgtgctgctccatctctccatagttgtacttctcatagaatcacaggatgttggtgcaggaaaggactgcttatatctgggtaccccacctttcatttccttcaagtcttgagatctttttgaactagaagcatgcatttagaagtgatattgatatcaccatctcctgttggtagatagatcattgagtggaaagaagagggttcaagggattctcccacctcagcctcatagtagccaccacgcccaactaatttttatattttcagtagagacggggtttcatcatgttggccaggctggtctcgaactcctgacctcaggtgatccactgccttggcctcccagagtgctgggattactcccagagtacatgagccaccgcaccaggccagggcaaaccctttcaagcaggagttccagtatactgagagatggaaatgcaattgatgtgaagtcctagcagtagcaaccagcagagctggccttcttccaggcttggagatcctctgccagatgctcatcttaccagatgcaggcagacctcttcatttcagaaaggtagacactgagggacagagagaccaaggccagcaggaagtcagtcactttagtaaagggtccaccagtctatcagtttcatgaatgtagagtctgtgcctgccttgtacacccctctatttgcagtgaccagaataagtagtaggactgtaaatttatgttataatgaattcattaccattatttaaagtggcatgttcatgcttttttttttttttttgagatggagtctcgctctgtcacccaggttggagtgcagtggtgtgatctcagctcactgcaacctccacctcctaggttcaagtgattctcttgcctcagcctcccgagtagctgagactacagacgtgccaccacacccagctaattttttgtatttttagtagagatgggattttgccatattgcccaggcttgtctcaaactcctggcctcaggtgatccattggcctcggcctctcaaagtgctgggattacaggcgtgagccaccgtgcccagaccctgtgctcttgatttcctatctttgtacttggcttttctctggccccactggtactattgttagaggtatctcatttggaggtgaaaggaggggaaataaatacagcagtcttgtcttttaaataaatacagcagtcttatgttactctactctgagatctgtctggccattgttggcaatttcatctgagcatcagcaattgctagtgacagccctacatctgggactcactttcctgtttggtataaatgtttctggagattagaataagggaagagaagtcgttttagcatttccgtatctcagttccaaagaggtttaaaaggcacgtgcaaatgacaaccccacaaaacaaaatcaactgagcaaaaatcaatgctctgcccaagagggaccatctttaagaagctttaagtgaagtttaccttgaaagttgtaattagaagcttcaggaagcaagtgcctttatggcagaatgactgatgttactcccaggatctcatggaattgtaaaattttatctctgttctgtgtaagtcaacctaaatcaaacagaaatattagtgtttgggtacatcaaaacacctttaacttgtcctttcattttggtttgccttttgacaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatggggccgggcacagtggctcatgcctataatcccagcactttgggaggccgaggcaggcagatcacctgaggtcaggagtttgataccagcctggccaacatggtgaaatcctgtctctaccaaaaatacaaaaaaaattagctgggcatggtggtgcacacctatagtctcagctactcgggaggctgaggcaggagaattgcttgaacccaggaagtagaggctgcagtgagtaagcatcacgccactgtactccagcctgggcaacagagcaagactctgtctcaaaagcaaaaaaaaaaaaaaaaaaagaaagaaagaaaaagaaaacaacaaatggcagagagccaccatattccaaatcactgaaaaaaataaatgaattatttttatttatttatttatttttttgagatggagtctcggtctgttgcccaggctgaagtgcagtggccccatctcaactcactgcaagctccacctcctgggttcacgccattctcctgcctcagactcccaagtagctgggactacaggcacctaccaccatgcccagctaattttttgtatttttagtagagacggggtttcaccatgttagccaggatggtcttgatctcctgacctcgtgatccgcccgcctcggcctcccaaagtgctgggattacaagcatgagccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaacatctttgaatcaagtatctcaagaaaacaaatgaatcataagtatctcaccctaatgactgatgacatagtgattatttattgtaaattatcctaactgggtcaggaatagagttcgatcgttttttaaaaagagagctaaaagatgtaaaaatgaccaggcatggtggtatgtacctgtagtcccagctactggagaggctgaggcaagaggatcgcttgagcccaggagttccaggctgcagtgagctatgattgcaccactgcactccagctgggtgacagagcaagaccctgtctctaaaaaacaataaataaataggctgggtgcgatggctcacgcctgtaatcccagcaccttgggaggtcaaggtgggtggatcacttgaggtcaggagttcgagaccagcctgaccaacatggtgagacccccatctctactaaaaattcaaaactcagccgggtgtggtggcatgtgcatgtaatcccagctactcgagaggttgaggcacaagaattgcttgaatctgggaggtggaggttgtagtgagccaagatcgcaccactgcactccagcctgagtgacagagtgagaccctgtcaaagaaagaaagagagagagagaggaagggaaggagagaggaagggaggggagggaggaaagagatgtaaaaatggtaggttttctttttctttataaggtgtcctggttaaacttttagcaaaatgatagattcagtttttccatagttaaagaagaatattaagaacattaaagaaaggttcaaggatggtaaataatttgaattccagctgtacttgaagactttattggaggacacagaaaggtataagtgatggtcattatcatcaggagctggataattcagtttttaaataacagccttcaggctgggcgcggtggctcacacctgtaatcccagcactttgggtggccgaggtgggtgtattgcttgagttcaggagttcgagaccagcctggacaacatggtgaaaccctatcgctactaaaaattcaaaaaattagctgggtgtggtggtgcacgcctgcaatcccagctactcgaggctgaggcacgagaattgcttgaacccaggggatggaggttccagtgacccgagattgcgccactgcactccaggctgggtaatagggcgagactccgtctcaaaaacaataaatacaaataaataaataaatagccttcaaccaatcaagggttttgataagatgtcaaccagttgccctgggctcagtacaaaaacaaccaggggcatggcatggtccaggggatttcggactaggggtttgagaattttaaggcatgtaaaacattggaatggattccgtaggatagacttctgttttaagaaagctgtttaatatggagaaattctcaaatttttgagtaggttcagctatagagcctaacttactattacagacagaggaaagaactaggtagtatttttttaagccctattcacctccatgaccttaattttaaacatgcttgcttggttctagggtgccgtatctatctagtcgtaacctactttaatgtgaaaatggtacattacagcattagctacaatggtacagctggaataagcatactttgctcttcatgagcacaagatggccctgcttggggggaattgattgaagggtgttctgttggctgggtgtggtggctcatgcctgtaatcccagtactttgggaggctgaggcgagtggatcacttgaggccaggagttcaagaccagcctggccaacatggcaaaactctgtctctactaaaaatacaaaaattagacaggcatggtggccaaggcctataatctcagctactcaggtggctgaggcacaagactcggctgagcctgggaagtggaggttgcagtgagcctgggaagtggaggttgcagtgagccgagatcacaccactgcactccaacttgggtggcagagcgagactctgtctcagaaaaaaaaaagggggggggtgttttgtttatttggtttattgggctttttggcatttacaaggagagggtattagctttttacttgtccttctgaactctcagttccccaaaaagatgttgagtaatgggattgggctgggcaacttagcaagaccccatctctaaaaaataaaaattttatatttttttatttttattttttttcaagacggagtcttgctctgtcgctcaggctggagtgcagtggcatgatcttggctcactgcaacctccgcctcccaggttcaagtgattctcctgcctcagcctcccgagtagctgagattacaggcacacaccaccacacctggctaatttttgtatttttagtagagacgaggtttcaccatgttagccagggtggtctcaaactcctgacctcatgatccacctgccttggcctcccaaagttctgggattacaggtgtgagccactgtgcccagcctaaaaaaaaaaaattaaaaaaaaaaaaaaagaatcatggaaggctgcagaaacttttcagcttaccaactcagggaggcccagcagtagcctcaacaggcccccacccccacatccagccatgcatagctgaaaagggcatggctttgtgccaagacagccccagagcctgctcctcctatttattcttggcctttacttggatggctccagggaagcagctgaggtagtcactcattctgccatgttaagatgggaattgtattaaatgagtctggcaaggtatgggaactgtctatcctttctttcattcattcactaaatagtattatctcctgtgtaccaggcactgtcctaggcactggttgctaaaatggaatattatgaaccccatgggccaagaggacaaaaactgctgagtgtattttctaaactttgttggtacctgtcctgacttctgtgatttgccaattttcttcaaccacacaccacaatttgggtccaaacaaaggttcttctgtaggccctgccctgagagtcagtagagggagatctcactagagtaaaaatgaactctttttgaggttacagtaagctatgatcatgctactgcactccaacctgggtgacagagcaagaccttgtctcccaaaaaaaaaaaaaaattcttttgcaaatatgaagctgaaattatacaatcctaacaacaacctatgatgagctttactgcttcattccagtttctgttcaactgctgaccctgcaattcctgaaagcacaactcccactgaggttaataggagtgttatgcgaatgtaagttttgtacttaatttcctcctgctgagtgagccttggttgtgttggactcacaattgtaacaattcctttccgcagtgggaacatggtggccccaccttccatgtggcagggccatgctgcagtgcaatgctccaggtgaggggggagatcaatttagaaccaaaatattctggcttaatactacttcattgcctcatatagtagcatgatgcctcataagccagagagagtaaaaatgtagactggccagtcaatgatgttctaggcacactgtaatccagacttgggtctgataactttttttttttttagaaatgaggtcttgctatcttgtctgggccagacttgaacttctgggctcaagtgatcctcccatctcagcctcccaggtagctgggactgcaggcacatgccagtgagctcatctctaacttttaaactaggcctaaagccactaacctttttctcattggtggagtgaaaagtgatgcaggagacaggaagcaagtattcttttagatccggctctgccgctgaactagttatttggccataggaacatcatttgtccactttgggattcactttctccatctgtcaagtgaaggcattgaacttggaagactctcaagttctcttccatatgtaaaaacagatttatgggtccagattctgtggaggtcacagtgttttttccaattttttacaatcagttgcccacatttataaatcagaaaattctgtataaaatatgaatttgggctgggcgcagtggctcatgcctgtaatcccaacactttgggaagccgaggtgggcggatcaggagttcgaaactagcctggccaacatggtgaaacccgtctctactaaagatacaaaaattagccaggcgtggtggtgcatgcctggagtctcagctactcgggaggctgaggcaggagaatcgcttgaacccaggaggcagaggttgcagtgacctgagatcacaccactgcactccagcctgggtgacagagcaagactccgtctcaaaaaaaaaaaaaaaaaaaaaaaaaaaaaaatatatatatatatatatatatatatgaatgaatttggggcttcttgaaaaattgaaaatgctggcaacagcagccctacatttctgcatagttgtgatggccatggctgagtaatgggttccccttcagacagggcatgtcactttagacagtgtgccaccatccccacctcaagtcaacttcactcacccctgtaggcctttgagtttgtgacccttttttaagtattagaattagtacagtttcatcaatgttacaagtgaggtttttttctatcatacctcagatgatggaagtcagtgacctaatctatgacactaacatatatttaattcattacaagcagtagccaagaagggcacatggagctttgcagggacgctcgcaggaggacaccagagagtgctagagctgcttatggtaatgtgacctacaactcagagcctaattgtgtcaggtgaagtggcctggacagtttactctctgttctcagagttaacaagctcccatcacataactttctttgtgaatattaaataagcctacgctggaaagcaaatgtcaagttgccagggaggagaggtttgcacagcaagtgcagaatgattcgtgtggcttctaggctttgtagttaatcttttattaactgtccttattttctttttaaaattaaccttattattcctttcaactggatctaactaaggaaatgctatgaaggaggtatttttatttttgcttttaaataatgtagcaggagcccatgaagccagtgcaaccctttaaagatggtgatttctcatggttatgaggaagattcattggtttgtgtgagataaaaaccagacaaataccccacgttgtttctttactaaactcccttatgcctccctcacaatgctgatttttctaattttacagaaaactgaggctgagtatattcaaatggtttaaatgatgggatcactttttttgtttgtttttgagacagggtcttgttctgtcaccgaggctggagtgcagtggggcgatctgggcttactgcaacctctgcctcttgggctcaagtgatcctcccatctcagccttccgagtagcagggactacaagcatgcgccaccatcacagagctaatttttgtattttttgtggagatagggtcttcctgtggtgcgcaggctggtctagaactcttgggctcaagcgatccacctgcctcggcctcccaaagtgtggggattacaggcatgagccaccgtgcctggccgggatcacattctaataaatgttagaacaaaggccagaacttgttctgactcttataccattgtattaaatggtttgtccttgttttcctttagggaattttcccaaatttaagaatatagcaactaaaaagggaaatgattactataaaagtaaggatagtggccaggggtgtggtggctcacacctgtaatcccagaactttgggagactgaggcaggcagatcacttgagattaggagtttgagactagcctgtctaacatggcgaaaccccatctctactaaaaatacaaaaattagctgggcgtggtggtgtgcacctgtaattccagttactcaggaggctgaggtgggagaattgcttgaacccgggaggtggaggttgcagtgagtcaagattgcaccactgccctccagcctaggcaacagagcaggaatctgtctcaaaaaaaaaaaaaaaaaaaaagtaaggatagtagatacatctggattagagggagaggtgtgtagtctagtggtctagaagggatatataggggttttcttgactagggggtggtcacctttaccatgataattatcaagtgaacatagtctgcctggggctgtcccagtttaagcctcaaaccaggttaaatttttttttttttttgacacggagtcttgctctgtcactgaggctggactgcagcggcgtgatctcagctcactgcaacctctgcctcccggattccagctattctcctgcctctgcctcccaagtagctgagattacaggcgcccaccaccacacccaactaatttttatatttttagtagagacatggtttcgccatattggccagactggtctcgaactcctgacctcaggtaatccacctgccttggcctcccaaagtgctgggattacaggcgtgagccaccatgcccagccaggttaaatattaatagtagccttttttcattttcaaaggggttctgttttagatgatatgttatgtgttcagctattatactgtacatttatgttttatgcacttttatgtatttattatatgtcaaaaatgtttttaagttaaaaaaattagtatcaggaagtctggcctatgatcaggagtccaggccaacctgggaaaccttgcatttgctttaagattcaagattactacagagaccacagcagtagtattgccaatccaggtgtggacttcctgaacagaggctgtgatgccccaccttggttttcttctggctcctgtgacatgagatagttagctttggttctttgtcctgcatatggctggagaagtggcatagctcttagttctaattgtgaaggtcagtccaagataatatatgagaaagtgcattgtaaacagtttaggttttttctactttgagtggcaggagtttcctaaattcctagatcggcaggacctcaacatcattgcagtgctacctgtcaggttaatcttcctgtaatacagcctttctacttgaaactttttactataactcctggatacctacagaatgaaatctaaagtcctaaacttggcattcaacgcaccacaaactgacatccaaccaagtttccaacactatttctgctgttcctcttcattggctattgaaccacattcaaccatgtggtgttccaaaaatgctgttccctttccaacctcacctcatacttttctctccagtagaatgccttgttctttcttattttatttttattttttttgacggagtcttgctcttttgcccaggctggagtgcagtggcatgatcttggctcactgcaaacttctgcctcctgggattgattctcctgcctcagcctcccaagtagctgggattacaggcacccgccaccacgcctggctaatttttgtatttttattagagatggggtttcaccatgttggccaggctggtcttgaactcttgacctcatgacccacccacctcagcctctcaaagtgctgggattgcaggcgtgagccaccgtgcctggcttctttcttatctttcaatccctttggtggggaccgaatgtccgtgtctccccaaaattcatacattgaagcccacaaggtgactgtatttgaagatggaacctctaaggaagtacttaaggttaacataggtcatcagggtggggccctgatccaggcgcctagtgtccttacaagaagagacacctaggccgggcacaatggctcacgcctgtaatcccagcactttgggaggccgaggcgggcggatcacgaggtcaggagatcgagaccatcttggctaacacggtgaaaccctgtctctactaaaaaaaaatacaaaaaattagccgggcgtggtggcgggcgcctgtaatcccagctacttgggaggctgaggcaggagaatggcgtgaacccgggaggtggagcttgcagtgagccaagatcgcgccactgcagtccagcctgggcgacagagcaagactccgtctcaaaaaaaaaaaaaaaaaaaaaaaaaaaaaaaaagaagagacaccagagagctggctctctctgtgcacatatagaggaaagtccatatgaggacaaagtggctgtctgcaagccaggaagagaggcttccctggaaactcaccctgttggaccttgatctggaacttttagcctccagaacagtgtccattgtataggccaacccgtctgttatggtttgtttgtttttgttttttttttttgagagacggagtctcactctgtcgcccaagctggaatgcagtggcacaatctcggctcactgcaatctccgctcactgcaatctccgcctcctggttctagcaattctcctgcctcagcctcccaagtagctgggactacaggtgcacaccgccacgcctggctaattttttgtattttagtagagactgggtttcactgtgttgcccagtctggtctctaactcctgagctcaggcaatccacctgcctcggcctcccaaagtgctaggattacacgcgtgagccaccacacccagccctgttatcgttaatactgagtgtcaacttgattgaaggatgcaaagtattgttcctgggtgggtctgtgagggtgttgccaaaggagattaacatttgagtcagcgggctggggaaggcagacccacccttaatctggtggccacaatctaatcagttgccagcgaatataaagcaggcagaaaaacgtgaaaatgtgagactggcctagcctcccagcctacctctttctcctgtgctggatacttcctgccctccaacattggactccaagttcttcaatttggagattcagattgggtctcctcgcttctcaagcttgcagacagccaattgtgggacctcgtgatcgtttaagttaatacttaataaactcatttatatatatatatatatataaaggctatatatatatataaaggctatatatatataggctatatatataaaggctatatatatataaaggctatatatatataaaggctctctctctatataaaggctatatatatataaaggctctctctatatataaaggatatatatataaaaaggatatatctataaaaaggatatatctatataaaggatatatatctatataaaggatatatatctatataaaggatatatatctatatataggatatatatatatataaagttctgtccctctagggaaccctgagtgatacactgtctacagtattttgttatggcaccgtgagcacactaagacaccctttttggaatagctctgacatggcatatacctaaaacttctattcctcaaagttcttcaatccttcccctttattttacttcttaagacatttgatgctctatcttgtattatgtagttatttatgtaaacatttgctaacttccttgctagtaagtttttagggtaacccctgattccatattgcagctctgcagtgcctagtacacggtttggaagttattaaatatacaatatatattagttgataaatttacaaataaaaggggaaaactaaatgaggtgagaaaacacaaactttttatttaaaatttaaagaggacatagaaaattgaggcaatgtattactaaatgggaacaaataagttaaatcttcagtttagtgatatttaaaataaataggttcctgccagcagaggtgttaaaatatatatataaaaaaaataggtatctcagaggaactaaaaataggggcggttttgttttgttttgtttctcccactgacatgttgttttgtctttgcatggggggatttgacttattggagtagaattttagcccagcttcagaggctgtggagaaaagaccatgggaatgagcttagctggtatgggaaagctgatattttatgactagggtcataaatggaagctctggtgtcagcaccctgcaggtctgagtcttatgggagggctcagaattggacattcaggacctatttgttttcctggcatcttattcctagttaccatcctcctgtcagagtcttctttatttcccacctgtttctcacttcccaaatgtaattttaaattagtcttttgaataggtaagattcatatggttcaacattttaaaacttctatatagaagtgaactgcttccctaaaagcatggcctgggttgagtgttttagtcacagtgataaggataaccaagctcagagccttgcttacacccttgtccacacctgagcaggaggctggaagaaacaggcataaagagcgttctagaagattctagaaaatctcacagtggcagggcttggcagtcagagagcaggggtgctggagtagggcaaacagtggacttttagcagcagaactgttctctgagtggcccagtagggtcaagggggcagtggagaaaaggagggagtgccagctcagagcacagaagacctcccatgtgggcacctgacagccccattcccaggaacagcggcacccaaggagcgtgggggcccttctcaaagaaggatgcttttcccacaactccatcaaaaagccacatttttctctcctacctagtaacaatgttcagaaaatatttagcaaaaggaggaaaatgggaaagccctaaataagaggcctgaaaactcttcttgaaatggtaaatggtgttgtagattttatgttacttttttttttaactgttgtgaaaaagtcttagctaaaagggttctatgtatttgagcaagtggatagtgttgcttcagagaaatccctctcagggtgaacagatttgatacagatttgactctatggaaagtgtggttaactccagcattttcctagttcctgtttttcctcagatcttgtggggttgtttgtttcagacagtcttactgtcacccaggctggagtacagtggcgccatctcggctcactacaatctccacctcccgggttcaagcgattctcctgcctcagcctcccgagtagctgggattacaggcgcccactaccacacccggctaattttagtatttttagtagagaaagggtttcaccatgttggccagactgttcttgaactcctgacctcaggtgatctgcctgcctcagcttcccaaagtgctgggattacaggcatgcaccatcatgcccagccctttttttttttttttttttttctgagatagggtctcattctgtcacccaggctggagtgcagtggcacgatcacagctcactgtagccttgaactcctgggctcaagtgatcctcccacgtcagcctcctgagtagttgggactacaggaacatgccaccatgcccagctaacatttcattttatttttggtagacagtgtctatgttgcccaggctagtcttgaactcctgggctcaagttatccttctgcctcagcctcccaaagtcgtgggattacaggcatgagccaccatggccagccaagatcttgtgttttggtgtgattaaaatgtcattgttggagcctggtgcattagcttgtgcctatagcttcagctactcaggaggctgaggaaggaagattgcttgagtttgagcccaggagtttgaggctgcggtgagctatgattgtgccactgcactccagtctgggcaacagagtgagaccctgttccctaaaaagaaaaaagaaatgataccgttgaagcaataaatacgaatactttttataagtaggcaatttttggaaaaaagaaaagcttctctataaaatcagctttatgttcagcaacaaaatgtgtagaatgacatttagtgttttacttgccatctttaagaaaatcaaacttatcaaactttaaaagacttttaggtctggatgcaatgccttctaaatccctgaacctacagacttgggagcttatcttttgcagatgagaaaattgaagtcacctttcccttttagtatatagtgaaggattctggaaagagagggttagttagggaaggtatgtggttctagctttatctaaatgacttgcccaaggtcagaccgtcagaactttaaataggattgggcagcagcagcaaccatttagcaatcttgggccttttgtccccctttatggaggtgaaatatcataattcaagagcctcatttttgtttttcttccagatttcagaagagatccctagaggcaggtgttgaccttgccctccatttaaacaaatggacgggctgggaagtccctggaagtcaccataagcctgctctatagcaggtactcactaaagagggtaacggccgagcatggtagttcacgcctgtaatcccagcactttgggaagccgaggcaggcagatcacctgaggtcaggagttcgagaccagcctgcccaacatggcaaaaccccgtctctactaaaaatacaaaaaattagccgggcgtggtggcaggctcctgtaatctcagctacttgggaggctaaggcaggagaattgcttgaacctgggaagcagagcttgcagtgagctgagatcatgctgctgcactgcactttagcctgggcgacgagcaaaactccttccccaccacaaaaaaaaaaaaaaaaaaaaaaaaaaagaagagaaactactgaagccaaaaagcctccaaacttgaagatccctcttgctaaggaacaattacttgacttaggcatctagattgctctgtgtgtcttgagtatacatgaagagtataaacccccaccaaccatccaggatcattcagcaaccctctgtgtgaatttgagtttttttttttttttaatattgtaagttgtctgggtgtcctttctgaccttttcttctatgaagtcctgaatttctaacttgcttctaaattgctgaatgtcacattgtcctgttgtagctttctctgaaatgcacaggaaatgtctgtagggttggcaagctcctcctcccccgacttcactcctattccacacatgtactttcagcatttgagagcctgtcttctctcttagctcccttaaaaacatttgtagtatttccactttttatgaagttaaaatggtttattttcaatccactgagttagaaggatcatgtctatccttaacctttgccaaatatccttaaaaatcatttttttcttgggaaacttccataatgccattcttataaatgcatgccaagcctgagcctgtgggtggttttcttcatctgaacttacttttcaaatatagcagtatgagacttgaggtaggggaagcagcatcagaaatggaagggctggaaactagactcaggacattgtttaaaataatcagaataaatactttcatttatttaacattctacatatattgttttgaatatctatcattggccaggcctggtggctcatacatgtaatcccagcactttgggaggccaagtaaggaggatctcttgaggcaagaagtttgagaccagcctgggaacatggcgaaaccctgtctctactaaaaattaaaaaaaaaattaggcagatgtggtggcatgtgccggtagtcccagctacttgggaggctgagcccaggaagtggagactgcagtgagccatgattgtgccactgcactccagcctggatgacagagcgagaccctgttttgtttgtttgttttaaaaaaagaataaagaatatctagggccaggtgtggtggctcatgcctgtaatccaggcactttgggaggcccaaatgggtggatcacctgaggtccggagtttgagaccagcctagccaacatatagtgaaatctcgtctctactaaaaatacaaaaattagctgggcgaagtggtgcatgcctgtagtcccagctacttgggaagctgaggcaagagagaatcctttgaacctaggaggcagaggttgcagtgagccgagatcgcaccactgcactccagcctgggtgccagaatgagactccatctctctctctcaaaaaaaaaaaagaaatatatatatatatatatatatatatatatataaaatatatatgtatataatatacatctatctatctatatatctactattcttctaggcccctgtgatacagcagtgaacaaacagacacactttctgccctcagggagcttaagttctagtggaagaagacagataacaaaccaaatcaataatttacatagtgtattagaaagtgatctttgctttcaagaaaaataaagtagacgcggcatagagggagtgttttccgcaagtttaaaatcagatggcttttgagcaaagcactaaaggaggtgaacaacaaggctatgctgacatctgggggaagaaagtcccaagcccaggaaacaaacagtaagtgcaaaggctcgcaagggaaaatccctggagtgatggagaaacagtttggagagaaattaatttggcttattatcagtctccttccactaggagagcagcaggtaatgaggtccgagaagtaacgggaggtagcagaccttcgagcctagtaggatgttgtaggtcctttggctttctctaggatgagatgggaagccaatggaggcgtttcagccaagggagcaacagaatctcatggacaagatcacttgctgctgggttgagaagggaaaggaacaggtatcgaagaggaaagatcagttaggaggccactgcaatcattccagaaattactcataccagaaattaatcagagacgtttgatgcatttacaaaagcggtggtaggggggcgcgggatgtgcttgtagaatacaaaagaggtagagaaacattaaacattttgaatgttttaagtttcttttttttctttttttttttttgatacggagtctccctgtgtcacccaggctggagtgcagtggcgcgatctcggctcactgcaagctccgcctcccgggttcacgccattctcctgcctcagcctctccgagtagctgggactacaggcgcccgccaccatgcccggttaattttttgtatttttagtagagacggggtttcaccgtggtctacgatctcctgacctcatgctccgcccgcctcggcctcccaaagtactgggattacaagcgtgagccaccaacgcccggcctgaatgttttaagtttcaaggaaaagaccaatttggcagctactctgctacctcgtcacctccaggtgacgttgggagtactggggagctaggtttccagaactttttgctcttgagtgacctaagaccctagcagagtttggtcagtgtgattaagaatgagcctctgtgggtctgtttaggatgcttgccccctcccatttccttaacttgcctgaattcctgctgggaatacagattcggggcccttcccactctgtaaatatgggaaaaggtctaggaagtatatactcctagcaataatatgtaggggttctatgactaggaaatttggggaactgtccccctgaccgctccatccgtaacttctgcacaccttttggggtacgccgccgacctggaaagcgttgcagggcgctcatgctgcccgcaggtggcgccacgtgatcgcgagccgcagagagcccgtaccctaggagtctcgaggcgcgaggactgctggtccgcagctgtgccggggccaccgacgccgcttaccccggcggagcgccgcgcaggtggagttggggacagcggccggtgccccggctttttaggctgtgtgcatcccaagccgcctctagttggcttctcgggcttccggggcaggagggcgcgcggctttgtgcctacgaattgagaactggagagccagtaaccggtgcaccgggaacctgccgccttgcgccgcagggctttagtccaaacctggccggtccaggctccgggatctactacaggggcccctggggagcgcgggccccagggacggctccttcccattggcagcaggacggatgccacgcccctttttcttcagctctcatctttgactggctctcgagtcccagatggccacgccccctcccctcgcacatacacaagagtcacgcgcctttcagttggaaacttggcgtgcagacggggacggtggctctcgtcgccccacccacttaccttgccattggtccgcggagcggcacacggtcacgcccccattccagccccctggctgggagggcgggcacccgcttgtgattggctggtcggcctgcctctcgcgggagcagccggcgctcctctccctccctctttccctcccgcgagcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtgggaaattttggtctctttcattggcttgctctttctctctccatcctcctccctacttgagtcctctaccctcagaccaaccccccaaggcgagttgaccgggatttctccttctccctcttaattgcaaagttgaaagggtggcgtggatttggggatggattgaactagtaagtgctactaggttattttaaagcacaagactgccatcacttactttttcccattatcaaaaagcaggctgtgtaatttctgtgcatgacacttatttatttttttttttttggtcccgtgtgtgggcctctgttcttgaggggtctgccgccttcattgtctgggttctcagtgagtaggtgaaggtaggggctggctgatgccatgccatttggtggactttaatcacaggcatttggaaaacatgtaactagcttttgtaaacccagtgcagtcctttttctcctccttaaacatccacactggcctttcaaagatcgaagtacattttctatagcttctgttcctgcttgcctggcaacttgtggggaagattgaggtctgcctttgagggtaaggggtggggtaaactaagtatcgccaaaaaaaatcacccattttggatgtgacttctcttagctagaaaagagttgttgttgttgttttaaattaaagttattaatatgtaacttggaaagattagaggttagccagccttttgtgaagaggctgtatgtcccgtagccttcttcactatttgtttacatttatctgacaacagttacagttgcccaaaccaagtgtgattttggcagaaagcttgaacctttaacagtgggatgaatccctctattggggcttatttatttcttgactctttcagtttaacgtgttctttttttccaccttgatcatccgatacattaagttgaagtatgtctccgtcaactctcaccgttccaagatgcttatacagtacatcatttatatttgttcgtttgaccatataatgaacaggtaaatagcaacttgtactattattattgaagttctgaatgtttccagtaaatagtgttatttgaaaaccaagggatgctgagtttttgaattattaagatgctagggcatgtgcaggtattgaaatgtgtatgtaacctttcgtgacctgatagtcctcaaaaccaagtttcccttcttcaaatagaattttgatcactggtagtagtctctcctctgaaaaaggtgatatgtacctggtgacagctcactggatgtgatgatctgaacatactcaaagagtgtatggttgtcctaatgccatttttctggttgaatgatgtcctctctagaacaggatcacattgtagtaagttttatgtaaaggaacagggcagaatgtgctttgaagattggtaaatttgcatttaaaagcagaaggaggttcttctggtttcttaaatagtaaaaagaaaatgtccagtatctctaggtgacatagcttcttttgggggtgtcattctttcaccactaagttgttaattagagcatctaacttctttcattttgcagtaatatctgtaatacagaaagatatattgggatgtttggaaatgcccctgaaagtctttctattgctaaatttcccaatattgatacagatgatctattgcatgagttttttattacttagaattttgcacatttactcatgaattgataacactagtttgtacttcttgctgaagtcttttcttcacttctatatctttttaccttgagaatttagtttttcacctcacagctccttaatgccgcccttactcaaaatttcaaaattcgtattattttgaaatttgtgcttgattgaccttgaacaatttttctatgatggatttattttcatgaggagctgtttttccttcagaattaccactcagtatttttttgaaatgtattctttaaatgatggaattactaatatttccctatgaattctagaaaaataataatgcacaagatttaatttttgtctttaactagaatgatgtatttggttaagaagatagtccaagttaaaggcatacattcaagctagtggcatattcggaagagcaggcaaagatagttggttgcaaatgggaaatttaagccatgatcttaaaaggacagaatggatatttgttacttaaactatgggaataattgattttttcaccttccctttcttggattttttttttattatcagtttggttactttaaccttactgtcagttatattggttcttttttttatgtctgagttaaaacattttacctgattttcatgtcttcattttctaaatcaattatgacagtgttaacaatcaaccttttatttttctctactgaataacggcgtattaaatggtttgaagactttttcttcctctacctctctcctaaattcctcatttacaaaagaaaacccaaaacaaaacaaacaaccccaacaataccaattgtaactccccagaccagttagatcatagatccagatctcattgaaaattatccttttggctaggcatggtggctcatgcccgtaatcccagcactttgggaggccaaggtgggcagatggcttgagcccaagagtttgagactagcctgggctacctggtgacaccccgtgcctacaaaaaatacaaaaattagctgggcgtggtggtgtgtgcctgtggtcccagctccttgggaggcctgaggtgggaggattccttgagcctgggaggcggagattgcaatgagctgagatggtgccattgcactacagccttggggacaaagaccctgtctcaaaaaaaaaaaaaaaaaagaaacaaaattgtccttcctagttaagaacttctgtattgaagactttcctgtatatagctgtagagaattagtctgagttgttctttattaaagaggaggaaatagaatgttctgaatgtgggaagaaaagccacctttatattagtatatgtgaatgtcttctttcttcttccttttttttttccccaagagacaaggtctcactgtgttgcccaggctggattcgaactgtgattgtcttttttctctggctaccaggaaactcttggctttatttgagacagtaattgtgctgattttacagtttgatcatgatgatggtgatgattattacttacctatgtattctgtgccaggtacaggggctggggctttatatgaatcaccttgtttaaatctcaaatggctgaatgaagtattatctccattttacaaatgaggaaattgacttgggtgaaatgatttgttcaaggtcacacagtaatttgtgccttggggttttaacttaggtctttgtgacaccagaacctgctctcttaacctctctcttatgctgctctccttgatcctggtttgacatttctattttactgagtgtgaggtttagtcttttgtctcaacactgcctcagagcctgttgggcaatagaaaagaaatgtgtttaaacatatatatggctttaaacccagtgcttctgtggtgttgtgcataacaactggtgtccccttttttgccattaaaacagttttttggcctgtgtgatcctaagtctaaagaattgtgttgacagcatttgcatatccagcatcaagattcattttggaaagttttgtactaacaatgtgctgtactaatgtgcttcttccatgggctgctctacagctgtttttcccatagctaaattatgtaatcatgtttcactattggtttcttatctgtttctgttgcaagggtcacatagtaattggtcaaactcagttttgtgttttaatcttggtttttatttacatttttgaatctatctgtataactggttgctaatgagcatcctttacacaactctgctctctgtattccatgcaaggaacctttctctttttttgtgtgtgttagttttgtagttacttacaagtctaaataagagaataaattcagtaaataccgctagaggattatgagaattttagaaaaactagagcaatgtagtgtaggggaaggaaaagcaaaatgaaaggctgccacctttgtgtgtggaaagcatgttagaggctctccattcacctgacaaaaccgtcctcacaaaagattgggccaccaagttgtctatgctgaggtgcatttgaagaatttgtaaccagttactgtttcattgtttttcttttagctttataacagttgcattccagtattgcagagcatgctatttacagctgctagggacttagccagcctcttttctagctttttcttagtaacaggtgggatcaccagataatgttgttcttcaaggaaagaatgcactgtacagttttcacctaagatattaggtaatttctttctataactcagcaaatctctccatattaatatactgagagcttaatattaaacacatttttttctcaccaaattaagtgttgtatttgccttgaatctaggaagttgtttttttttttttaattattttatacgtatttgttagggtcttgctatgttgcccaggcctggtcttgaactcctggcctcaagcaatcctcccatctgagccttccaaggtgctgggattacaggtgcatgccaccatgcctggccagaagatgtttttattagtgtttaaaggtatgaatggtgtcaccgggagctgatatatttgttttcatgatgttgtacatttatttttgtgcagtaacatacattaaatgattgtaattttgtgtgtttttagaacactattatgaaatatccagataatacagaatcagagctggaaggcaggcagcttgaggattatctagtccagtgtttgccagatttacctgatgataagatttacttggggctgggtgcggtggctcacgcctgtaatccaggcactttgggaggctgagacgggtggatcacctgaggaagggaattcaagaccagcctgaccaacatggagagaccttgtctctgctgaaaatacaaaattagccgggcatggtggcacatgcctgtaatcccaactactcgggaggctgaggcaggaggattgcttgaacccgggaggcggaggctgtggtgaactgagatcgcaccattgcattccagcctgggcaacaagagcgaaactccatctcaaaaaaaaaaaaaaaaaaaaaaaaaaaaaagatttacttgggtcacttaataagagtaaggtcttaggcctcacccagagacctctgaattgggaaagagcttttggaatccatgtcgtttacagtttccctggggtacttcttatggttaggtgagtttaggaaaaactggtctagtcagccccttgattaaggaaagtaaaccctgagaaagagaaaaaacaaagtaaatgacctatttagggccacctacctagctagtagcatcaactgaactagatcccatgtccctgacttctagattggagttcttcctgctccagcaggctggtcttctggtcccaagttattcagagatgaaggtagcagcatcattgaaaaaacaaatagtgagtgttaccgttggtttttattggtctcgtgattttcctgtcaatatgttagatgccctggattcaagcaatttttgacaagcattttattatatagaaaataagtccaagtgtgtgagctcatttttatttaattttatgttttatttttatcttagtttaactgagttttttactttgttgtggttagactaggagggtattttaggaaatgagtgttgatacctaggttatttgaagcctcaggtaattaaatataagatgttttatttgacttagcttattttggatatcctttaatgatttgttttctcattgattatttcttctgtgagagtaatgatgattggatttggttaggactgtgggggtgaagcttccttgacttttcatttctgttcacagtacatacagatctgtaaaatttccatggaaatgttcatcaaagcatttgaagcccatgtcctattcgtgcatttgtgtaccctctgtaccacacacctcccaagttttaacaaataatataagtgaaattctcacagagaatcatgctgatttgtagaagttattgcgttactaggatcaccgaagtctgagcatagacatttaggtgaggagagaccctagttaaataccagccctgactaagtaggagctggatgaagcgggaaaggaacttgtctgcgttttctcttggtttttatggggattacacactatctttcctgaagcattcttaaccattgtgaggggctggttaattttaattattagcaaatctaaacacaatttaaaatatcatcaaccaagaaaacccacaaaacagactgaactgttctgtgggttttcctgcttttacttatttattttcaaaacagggtcttgctctgttacccaggctggaatgcagtggtgctagctagcatagctcactgcagcctcgacctcccaggttcgagtgatcctcccatctcagcctccagagtacctgggaccacaggcgtgtgccaccacacccagctaatttttttttttttttttttttgagatggagtctcgcactgttgcccaggctggagtgcagtggcacgatatcggctcactgcaagctccacctcctgggctcatgccattctcatgcctcagcttcccgagaagctgggattacaggcacccgctgccatgcccggctaattttttttgtatttttagtagaaacgaggtcatgccatgttgtccaggctgatcttgaactcctgggctcaagtgatctgccttcctcggcctcctgaagtgctgggattacaagcatgagacaccatgcctgacccctgcttttattttcaatataaaattttatgtttacaagcgtgagccaccacacccagccttacataaacttttaagagcaaacctgtagagtgtaattagatgcgtagttacttataaagtggtatatatttttcaaatgagcccttttctctaaatatatatatatgtgtgtatgtatatgttattgacagtaaactttcaattcattaagatttgcttgacatataaagagtactattaaactcaaacatgtggaagtggatcactaggattgaatacagttttttaaagtattgtcttttcatctctttttgtttttctcagaacacacaaacaagaaacccaaatcataccaacactgaaaagaagagacaataagaagcattctttctttcaacatcacagacattggcaactctaggatgtctatacagagggataaaaaggggtggcagttggctgggcgtggtggctcatgcctgtaatcccggcactttgggaggcccagggaggtggatcacttgaggtcaggagttccagactgacagtctggccaccatggtgaaaccccgtttctaataaaaatacagaaaaattagctgtgcgtggtggtgggtgcttgaattcccagcttcttgggaggctgagacaggagaatcacttgaacttaggtggcggaggttgccgtgagctgagatcacgtcactggacgacaaagtgagactctgtctcaaaaaaaaaggagggggtggtggcaggctttcgaaggaggaactagaggtttgtggtctagcttagatgttgatggataatggggatgccaaaccctctccctgtgttacattagtgctatgactgaacataaacactgctgtaatggacggtgagatcttcgtgtcatcctatttaaccctcccttgctgtcattcggaggtgggagtgcttctttttgaattcacatgctgtggggaggatagcatctgttaatgcaaaggttaagaacaatgtgctcttcctggatctgttttggacaagtaacttatcctctttaaccctaagtttttttcaaagtaaaatggggatattttctaactcatatggtacttagtaagaattattgtactaataaatatataaatgtttctaacagtacctggcactttgtgcttaaccagtatttttattataacaattctttctgtaggctcttggttgttatcttagtctgtttgtgctgctgtaacaaaataccacagactgggtaacttaaaaataatagaaggtggccgggcattgtggctcatgcttgtaatccctgcactttgggaggccgaggcgggtggatcacctgaggtaagatcaccagcctggccaacatgatgaaaccctgtctctactaaaaacacaaaaaattagccagctgtggtggtgggcgcctgtaattccagctactcaggaggctgagggaggagaatctcttgaacccatgaggtggaggttgcagtgagccgggattgcgccactgcactccagcctgggcaacaagagtgaaactctgtctcaaaaaaaaaaaaaaaaagaaatttatttctcagttctagaggctgggaagtccaagatcaagacactggcactggcgtctggtgagagccttcatatggcatcctcacatagcagagaaatggaaggtgaaaagggcctaagctagttccctccagcacttgtatgaggcgctggttcagagtccccatggcttaatcacttcccccaaaggccccacctcttaatatcactactgtggggattaagtgtcaacatgaaattttgagaggacgcattcaaaccatagcaattgttcttggtcattctcttgactggagcctgatagtcaagagagacattttagcgtgtgtccttataattattattggtgttgaaatctaaaagtggctaggctcgctgggcgtggtggctcatgcctgtaatcccagcactttgggaggcctaggtgggtggatcacttgaggtcaggagttcaagaccagcatggccaacatggtgaaacccagtctccactaaaaatacaaaaattagccgggcgtggtggcatgtgcctgtagtcccagctacttaggaggctgaggtgggagaattgcttgaacccagggggctgaggttgcagtgagccgagatcatgccactgtactccgcctgtgcgacagagcgagactctgtctcaaaacaagaaaaaaaagagtggctaggctgggtgcagtggctcatgtctgtaatcccagcactttaggaagcttttaggaaagctgaggcagaaggattgcttgaatctaggagtttgaggctgcaatgagctgtgattgtactactgcattccagcctgggtgacagagcaagagcatgtcttttttaaaaaaaaaaaaaaaaagtgactagttattgtaggttttttcttttcctttttgttgtgattgaatcctaagctttgttattttcctagcagttgacaaggtgactacatgcatatatatttttaaggaaaacagaacaatttattataggttctactttccttagagtaagaatactgtgttttaaaataattcttcattctctttaatcataaacaactgaaaaagacaacaagtcttttgagttgtttatccgctcatccgttgatagacatttagacagtttccactttttggccattatgattggttattatgaataatgctgctgtgaacattggcatgcattttaaaagcaagtgcttgtggattttggaagcccttgaataaccaaagacttttaagactaaaggaagatcaaaaaagataaaatattttaacactgattgcataaaaagtataaaaaatggtaatgcctaatatagcaagtttgtattgcttatagcagtgtaaatttataatgattttggaaggcaactgggtgtcataaaaatgatttagtatttttttcccctggaaatcttaattcagtgatccaagagaagaaaagagctatgttagctttttatgttgtatgtgtgttgcagcgttatctagaaacagtgaaaaattggaagtaaatatctaacacttcaaggcaaggagtggaggagaaagagttaagaaaattataaatgtgaactatttccaaccattcagtgataatcttgaaagccacatagcaatatgggaaaatttgcactgattatttgcacggaatatagacatgcaaaaaaatatatatatgtatacactggaaggtaacgtggaaaaaatgaaaatagttgatgtattagggtggggtgatcatagccagtctttgtgaaaatctccttgttaactttgtacatgatatacctggaaaaaattcaaatctgctaagaacattatgaatcctgatcttgtgaaaactaaccattgctcgtattaaggaactcattccatttctcttgaggaacattttactgctgaaacagttggttcttttttaaaattttaaaaattgagatataattcacatatcttaaaactcacccttttaaagtatgtgatttgatgctttttggtatgttcacaaggttgtgcagtcattactactgtctacttacagaacattttcatcaccccgaaagaaactccatacctctttgcagtcacttctcattttctgttccccctagtcactggcaactaatttactgtctgtatggattagcttattctggacatttcatataacatgtaaatgaaatgtggccttttgtggctggcttctttcatttaacatgttttcaaggttcatccatgttgtagcatgtatcagtatttcattcctttttacggccaaatattcagttttatagatataccacatgttgtttatccactcatcagttgatgggcatttcgattgtttccactttttgcctattaataatgattctatgaacattggtgtgcatgttgcattcttgacaaatcccattctagtctgaagatagttcagtggtctcatagagtaggactgtgatttagtttgggcatgttattggggtgagttctgagcaacttaaaagtgtgtgagtcacaactaccttccttccattggtctgtactgggcttctgcctcagtgcccctgcttggtatgtcttcatgaaggatgttttaaataatgagcaatactaaaggcacagaaaaccaacctattgcaagttggccatagagctggagcagggtctcagaagcccttctgttaggccagatgttaatcttttagtgttaagagtgtggacatgtatttccttctttcttttttttttttttttttcgagacagtttcactcttgttgcccaggctgtagtgcaatggtgcgatctcacctcaccgcaacctccgccttcccgggttcaagtgattctcctgcctcagcctcccaggtagctgggattacaggcacgcaccaccacggccggctaattttgtatttttagtagagacggggtttctccatgttggtcaggctggtcttgaattttcttcctcaggtgatccatccgccttggcctcccaaagtgctgggattccaggcgtgagtcacagcgcccggccatggacatttatttctaattctcttggatatatacacgggaatagaattgctggatcatatggtaattctattaactttttgagaaactgccaaactgtttttcaaagtggctgcaccatttgacattcccatgaataatgtatgaaggttctaatttctccagcatcctcaccagcacttgttattgttaaaaaaaaaaaaaaaaaaaagaatgccatcctagtgagaagtggtatctcatcgtggttttgatttgcatttccttaatgactaatgaagttgggcatctcttcacgtgcttactggccatttctataactttggagaaatgtctatgcagttcttttgcccatttttaacttgggttatttgtctttttattgttgagttgtaagagttctttttatattctggatactagtcacttgtcagatatatgatttgcaaatatttttctcccatgctatatgtcgtctttttactttcttggtagtgacctttgaagcagaaaaaggttttaattttgattgagtccaacttgtctttttttcctttttttttttaactcattttttgagcaacggggttttgctatgtgcctagggtggtcttgaattcctggcctcaaccgatcctccagccttggcctcccaaagtgctgggattacaggtgtgagccactgcaaccagctctattttttttcttttgttgcttatgcttttggtgtcatagctaagaaaccattgcctaatccaaggtcacaaagatttatgcctatgttttcttctaagagttttatagttttagctctttcatttaagtcattaatccattttgagtttttatatatggtgtgagggatgggtccaactttattgttttgcatgtggctattcagttgtcccagtactgtctgttgaaaatactattctttctccattgaattgtcttgacatacttgtcaaaaatcaattggtaaccaggcacggtggctcacgcctgtaatcccggaaccttgggaggctgaggcaggtggatcacttgaggtcaggagttcaagaccagcctggccaacatggtgaaaccccgtctctactaaaaatacaaaaattagccagcgtggtggtgcatgcctgtagtcccagctgatgaggaggctgaggcaggagaatcgctttaacccaagaggtcaaggttgcaatgagctgagattgcaccactgcactccaggctgggtgacagagcaagactctgtctcaaaaaaaaaaaaaaaaaaaaaattggccatacatttgagagtttacttctgaaccttaagatctgttccactgatctttaattttatgtcagtactacactgttttgattactgcagctttgtaataagttttgaaattagaaagtttgaatcctccaacttcattcttccttgtcaagattgttttggctgtcaggattccttgcatttccatgtgaatttttcagggatcaacttgcccatttctgcaaaaaaaggcagttggaatttacataggggcattgcatctgtagatcaatttaggagtattgcaatgttaacagtacaaagtcttccatccatgaacggggatgtcatatcatttatttaggtcctctttaatttccttcaacaacgttttgtagttttcagtgtgcttgcaatccttttgttaaacttattcctaagtattttattttttgatgctattataaatggaattgttttattaatgttatcttcagattgttcattgcttgtatatagatatacaagtgatttttgtatgttgatcttctatcctgcaaccttgcagaacttgttaggtgacaaatggttcttaagatagaaaaatgcttttaaaaaacatgagtttgttgaggttatcttacatttacttctttaatttgcttgtagtggattttgtttttttaaaaaatgtagggatttttacttgccacttttatatgtagatattgaaatatccacaattggttattgacagtcatttaggaaatttgataggaaagactaaatttttttttaagacagggtctcattagcacataaatacgtattaactgtctgacacaaaatcaagtattagtccaggaagaaacggatatggaattgggaagatatacaccatcaggcacttctgtgtttttgtttgtatttgtgacagggtctccctccattgcccaggccagattgcagtggtacagtcataactcactgcagcctcaaaccctgggcacaagcgatccttccacctcagcctcccaagtagctaggactataggttcctgccactgtgcccagcttattttaactttttttttttttttttggagagacagagtctggctatgttgcccaggctgatcttgaactcctggccttaagcaatcctactgcctcagcctcccaaaacactgggattacggatgagtcaccatgcctgccataaaagagtaagttttctgtcccagattagataggaaaagaagaaataggttgtataaaatgtcagtcaagacaaaaaatatgcctggctggagcttaggagtttaaaagcaagtctatttctttctttctttctttctttttttttttttgagacagagccttgctctgtcgcccaggctggagtgcaagtgctgtggtgcgatctctgctcactgcaaactctgcctcctgggttcaagcgattctcctgcctcagcctcccaagtagctgggactacaggcgcctgccaccacacctggctaatttttgtatttttagtagaggtgaggtttcaccatgttggcgaggctggtcttgaacttctgacctcaaatgatccacccacctcggcctcccaaagtgctgggattacaggcatgagccaccgcgcccagcctgagccaccggccaaatctatttctttctactatttagagtggctttttatcagtctagggacttgggattggagataagcacagaaagactagctaatatctaaatgttttcgtaaaccaggtgttgtggcacgcacctgtagtcctggctacttgggaggctgaggtgggaggatcacttgtgcctgggagttcaaggctgcagtgagcaagctatgattgtgtcactgtacaccagccaggtgacagagtaagactcctgtatctaaaaataaaaagtttaaaaatgattttgggctgggcatggtggctcatgcctgtaatcccagcactttgggaggctgaggagggccaatcacctgaggtcaggagttcgagaccagcctgaccaagatggtgaaaccccgactctaccaaaaatacaaaaattagctgggcatggtggcgggcacctgtaatcccagctacttgggaggctaaggcaggagaattgcttgaacccaggaggtggaggttgcagtgagccgagaccgcgccattgcattccagcctgggcgacagagcgagactccatctcaaaaaaaaaaaaaaaaaaaaaaaagactttgggccagacatggtggcctgtaatcctagcgctaactttgggaggtgggaggattgcttgagtccaggaattcaagaccagcctagacaatattgggagaccctgcctctacagaaaataaaaagaaaatgggtgtggtggtgcacacctgtggtcttagctacttggggggttgaggtgggaggatcacttgagccaggaggtcaaggctacagtgagctgtgatcacacctctgcaatccagtctgagcaacagaggagacctcatctcaaaaaaaacttttgtagtatctttcttctccacatcaatttatcaagggtcttctttggttttatttgcaaagactagaagaaaccctgacttctgttactctgcatttcttactgctatgagcagtatggtcctttaaaaaaaaatttttttttttttttttttgagacagggtcttgctctattgcccaggatggagtgcagtgacacaatcacagctcactgcagccctggttgactagcagcgctcaagtgatcctcccgcctcagcctgccaaatagctgtgatcacaggcacactccactgcacctggcttttttttttttttttttttttttgtagaaggcaaagtgtcgctatgttgcccaggctggtctttaactcctggcctcaagcagtccttccaccttggactcctaaagtgttgggattacgatatgaaatgccacgcccggcctagcactataatccttgaggtttttgggttccaggtgaccagaagagacaaaatgaaactctatggtgtttttttttgtttgtttttttggttttttttttggtgctgtgggggtagggggctggtaatctgagagggagaatgttttcccatgctagcaaagacagattgagggcatcatctgatctttatgggagtgtgcaaagcctcagtttttccatttgcccatctgcaatcatagaaacaatgtgctgactcaactcggagcctctgcggagtggcgtttgggtttagacagtcctcagaatcattcaagagatggaaatatttgagcaggtcttcagaggtaaaattaaaactaaaaacaactagaacaagatagcatgctttcttatctctttcaagattatttcctttagtcactagtgtacctccttgatgtaaggtttggcaggaataatttcatctctgtagagttgataactaagcagagaaaaaaccctaccttttagtcattgcttttcatcttgctatcatcagtctgatccttgagggtttggggttccaggtaaacagaagagacaaaatgaaactctttgcttttttttttttttttggtgcaatgggggtgggggagattgggtgtggagaggggtgagattctgctggaaacaagtcaattggctaaaatactcttttaatcatattttgtggaccatcttctgcttagttttgctcttttatgtttttatttgcttgttcatatatacatacattaacctgcaacaactagaagaacatttaccaaaatattaaccaacagtgactatcttttgatgtggtgggtttaggggaggaagtatgtttttctgtgttgctccaagtttttctgtttaaagcatgtattttgtaatgtttgggggaaaccaaatccatcaaaataaagtgcaagttttgtaacctgaaccactcattgaggtacagaattgaaatgtatttagatgaaactcacaggtattttttcttggagaatgtggaatattttatctatagtgcagctgtgctgtcatttatgccattttttcctcctcattgtgattcttactgtttggggtgaaagatgagtagtattttaaagcccgtaatgtgtgtgagtacacacgtgacatcttagtaagattcattttgtgtgagaaataagggaatttaggcttttgggttacatttgttttcaaaacatgttaataggtgacaaaaatccagtttgtttagatttgtatgtagtctgcctggaatgaaacttttttatacttacatgatagccctgattaaataaaagtttggtgaaagccagcagggtggcatgtgccccatgatcccagctactcttgaggctgaggtaggaagatagcaagttcaagcccagcctgggcaaaatagcgagaccccatctcaaaaaaaaaaaaatgttttgttaagtagttgagttccaactagatctgtacttttaacataaagctataatcccaagatacctcttatttggggacatgatggttttggaaactggtgcttccttttgtctaaataaataatcactgtaaatctagtcttgattattaaaaggagacaaaaagataaaaggagtgttctgaaccacctgtgcttgaagctcagttaatagtttccagactattaagcctacaaaatgtatatcttacacattttgctaaaataaaaagaccttttagctttgatcaagacaagatcaaatatttggtttgattatactcctaaaacgtacatattctcagacagataaacagatgtgattttctttcgttctttttctggatgtatacagaaaccttttttttttctttttttggtagagacaggctctccctatgttgcccaggctggtctcaaactattgggctcaaacaatcctcccaccttggcttcccaaagtgttgggagtataggcatgagccactgcacccaaccccagaaacgtttaatttaactataggataagttagctatcatttaggtgcctttactaaagtctgttaaaatgacataaaataatgacaatgtgtggggcgcagtgactcacgcctataatccaagcactttgggaggcccagttgggaggatggcttgagcccaggagtttgagaccagcctgggcaacatagtgagacctcatctctacaaaaaaattaaaaaattaggccgggtgcggtggcacgtacctgtaatcccagcactctgggaggccgaggcaggtggattgctcaagatcaggagttcgagaccagcctggccaacatggtgaaaccccatctcttctaaaaaaaaaaaaatacaaaaattagctgggcatggtggtgggcacctgtaatcccagctactcgagaggctgaggcaggggaattgcttgaacccaggaggcggcgcttgcagtgagccaagattgtgccactgcactccagcctgggtgacagagcaacgctctgtctcaaaaaatggaaaaaaaaaaagaaaaaattagctgagcatggtggcacacacctgtcatgctggctactcaggaggctgaagtagggggattgcttgagcctgggaagtagaggctgcagttagatgggattgcgccactgcactcctgcctgggtgacagagtgagaccctgtctcaaaaaaaaaaaaaaaaaaaaaaaaagacaacgcctctactcctttagccaactttctaaaaaaattaaacattttagggagagaaatcgatgtttcctttacttacagatggcattgctcttaaatagtcctatgcctattagacagttaaatttaatttttactgagttccttgatattaaaaatataccagcgttttgacctgattactgtagagtgaagatcatcagttgacacagaacttccagccagcattttaatgctttcctctgaaatatgaatggacagcgatagatctctgaatatttgaggagagcctctaataggagttatggagactaaaataaacaagcagacaaaggcccttagttgatttaagctgatttatctcacattacctaaatatccaaaaagtcagcagttattactttatctgtgacctcccaaagccacttaccaaaccaggtatgagtagcaaattcgaagatttgttgcctttttcagacatggtgtaggtaggatctttcctgtattcattcaacctgcctagttgtttgaggatcccagccaggttgaaggttgtaaatatttccttaaggcttacttagcttcagtgcaggatcagaggctaatttctggcagagttctatgtcttaggggatcattagctgtctatttttcctttctctttttactgcaagatttcttcaagaatagctagttacttccttttccttgccatctttaatcctctacaatcttgtttcaaacagttacaacccatgacttcttttattgccacatctacatcttggttgttacctttcctctcttgcttggcccctttactgtttttagctgtaggtgaggaccactcttcaggttggctcctgctgtttctctgactgcttcctttttctttttaggttcttgattttcccttccatttctaattgagcagtccccaagattttgtccttatgtctccttccatgttctttttccatcttgagaagactttctttgactcatctttaatccataagcatgtatttagcatcataataaagaactggcggccaggcgcagtggctcacgcctgtaatcccagcactttggtatggacgaatcacctgaggtcaggagttcaagatcagcatgaccaacatggtgaaacaccgtctctactaaaaatacaaaaatcagctgggcgtggcgcacacctgtaatcccagctactcgggaggctgaggcaggagaatcgcttgaatccgggaggtggaggctgcagtgatctgagatcgcgccactgcactccagcctgggcgacagggtgagtctccatctcaaaaaacaaacaaacaacaacaacaacaacaacaaaaaaaaaaccgccatgtaggagacggccaaagaggaattagacagatttcctgctctcaggtaacttgaagtacatatgaatttatactcttttccattctgtatcttcttttttaaaaatttttatttttagtagatgtggggttttaccatgttggccaggctggtctcaaactcctgacctcaagtgatctgcctgccttggccttccaaggtgttgggattacaggtgtgagccactgcgcctggcctcccctctgtatattgttatcaaacataattgatctgttttgaaaacgcatcttttactttttgttttctctccattcccactgctacagtgccagcccttagcccctcttatttgtgcttattatgttttgggtgctccagaaatacattttgttttattttattttatttatttattttttgagatggagtctcactctgtcacccaggctggagtgcactggcgcaatctcggctcactgcaagctccgcctcccgggttcacaccattctcctgtctcagcctcccaagtagctgggactacaggtgcctgccaccatgcctggctaattttttgtatttttagtagagacagggtttcaccgtgttagccaggatggtcttgatctcctgacctcgtgatccgccctccttggcctcctaaagtgctgggattacaggtgtgagccaccgcgcctggtccttattttattattatttttttgagatggagtctcgttctgtcacccaggctggagtgcagtggcactatcttggctcactgaaacctccacctccagggttcaagtgattttcctgcctcagcctcccaggtagttgggattacaggtgcctgccatcacgcctggccaaatttttatatttttagtagagatggggtttcacactatgttgtccaggctggtcacaaactcctgacctcaagtgatccacctgccttggcctcccaaagggttgggattacatatgaatttgtactcttttccattctgtatctgggtgatacagaatgtgtgagccattgcgcccagcctagaaatacattttaaattaatgcatgaatcagtctattttgattatcattaaacttccaagatggctttctttattgtctgtttcatcaagcatacctctgccaggctgatcttccttaaacataactttcatcttaccagtttgttaaaaacctcttataattacagtaatatgatattgtctttattttattttttattttataaaaaattacgtagtagagatggggtctcgctatgttgcccaggctggtcttaaacaactgggctcaagtgatctgcccgccttggcctaccaaagtgctgggattacaggcgtgagccactgtgcccagttgatattgtcttttaacaagtcaaaatagccagcataaaaaaaaatgatcatatacaactggcaaggtcccatgggatatggccccttctttggctgcatctcctactcctccagcagctacagtgacctctggctgtttcctgagtgccacaggtactctaggcatgcccctgccttggagcctgtgttgttgctgctccttctccctggaatgtcctttcgccagatagctttgcagcttgctccctccttccttcagatctgtactcagatatccccgctgtggccaggctgtccatggcagtcttacgattccagcccctctcctgcaactttttctccttagccctctactgtactatatcttattcatcttttttctttttttttcacctgcctctcctactagaacgtaagctccataagggcagggacttgtctgtcttgttcactgctgcgttgccagggcccacagcagggcctggcacataggtgcttaatagatattgttgaatgattgaactgaatattgttgagaatgtgttgtgatactagtactcttttatgctactgatggtagtgttaatttgtataatcttcctaggaagccatttggctctatatttaagaacctgatactttttgtatatcttttcacctagtagctccacttccagaatgtgatcttaggaactaatcagaaatacatgtaaaacttaaaacacagaggtgctcatttaaatttctatttatttttaaacatttctgtaaaatataacataaaaattaccattttaaccatctcaagtatacgattcagtagtattaagtacattcacatggtgtgccaccattccagaacgcttttcatcttgcaaaactgaatctctatacctattaaacaaaacttcctattccccaattcccagcccatggcaaccaatgttctactttctgtctctatgattgtgacttctccaggtacctcatataaatggaattatatggtatttatctttttgtgactgacttattttactttatgtaatgttctcaaggttcatccatgttgtagcatgtgtcagaaattccttctttcttaaggctgaattatgttccgttgtgtatatgtgccacattttgtttatccattcgtctgttgatggacatttgagttgccttttggctattgtgaataatgctgctatgaacatgggtgtgaaaacatctgttggagtccctgctttgagttcttttggatatataaccagaagtggaattgctaggtcatatagtaattctattcttaattttttgagaaactaaatagtttttaaaaatagcaaaacattataacagtctaaaagtccagcattgaagaatagttaaccaagtctagctatatacatatgatgttgccagtagagttacatttataaagtttttaataacatgggggagattattattttaagtgaaaagagcaacatggtttcaactgtgttttaaaaactgcattgcagtccaggcgcgcctggatcacaggctggttcacgcctgtgatcccagcactttgggaagctgatgggggtggatcacctgaggtcaggagttcaaaaccagcctggccaacatagtgaaaccccatctctactaaaaatacaaaaagtagccaggcgtggtggcacactcctgtaatcccagctacttgggaggctgaggcaggagaattgcttgaacccgggaggtggaggttgcagtgagctgagatcgtgccactgcacttcagcctgggtgacaaagcaagactctgtctcaaaaaaacaaacaaaaaccaaaaaaacccaccaaaaacaaaaaaagaaagctgcattgctgggcatggtggcatgcacctgtagtcccagctccttgggaggctgaggcgggaggatggcttaagcccaggagttcaaggctgtgtagtacattatgatctcacctctgaatagccactgcactccagcctgggcaacatagcaaaaccccatctctaaaacaaaaaacaaaaaaaaattacatacaaaactggtaggagatacactgaaatgttaataaaaatgaggtgatatctatatgcatctaattttcttctgtactttctaaattgagcaggcattacttttattatttaggaaaaaaacgcacaaaaaaagtcaagagtactcattaccaactactactgtatggaatccagagccttccagagtttgtagagctcttcatactctggctctagcccttgtttttattttctgtctaaaatggctaatctcataactgcatgtcatatatgtgtataatatatgtatattcatatgtatgtctgtatgtctgtgtgttgtatatatatgtgtttatgtctgtacacattgtctgtagttaacacacctctgctcatgttctcatcctaaagagtacttagttctgttcgtctaaaactctgctcagcctttaatacctagttacaattccattgttttcttgaaatctatgctgacttctgaacttctataccccttatacctaagggatccgtaagtttacatatatgtaagattggcagaaaattaacctacaattaaaacctcacatttcttaattctctttaatctttaagttgctactttcataattctttttttttttttttttgagatggagtcttgctttgtcgcccaggcaagactggtgcgatctcggctcactgcagtctccgcctcctgggttcaagcaattctcctgtctcagccccccgagtagctaggattacaggcacccaccaccacgcccagctagtttttgtatttttaataaagatggggtttcaccatattggccaggctggcctcgaactcctgaattcaggtgatcgcctgccttgacctcccaaagtgctgggattacaggcgtgagccatcgtgcctggcctgctttcgtaactcttatagtacctgtctggaaaatgccctggcttttctctgcttatctaattctcattcatcctactcccctgcaattttttattttgaaaataattccagcacagaaaagtttaattggtacaatgaattcccttatactcttcatctacattcaccagttgttaatattttgccatatttgtatcttttcgtgtgtgtgtgtgtgtgtgtgtgtgtgtgtgtgtgtacatcttttcttcctggaccattggtcatttgaaagtaggttgcagacatcatgatacttcactcctaaacacttcagcatgtatctcttaagtatgttctcccaaataagcacagtaccatgatcacacccacgaaatttaatgtcagtacaaacatattatctaatattcagtccacattcattcacttggcatgtctctttgatgtccttttatccagaatagctcctttgcctttttttctttcatgacattgacatttttggagtccgggctagttgtagaatgttctgcaatctggatttatcttatcttctcataattagaagcagggttaaatatggttttgttttgttttttgtttttttttttggcaagaataccacatagtaaaaagtaccttcttcccttaataattaacaaggaatctatgaggtgatatttttagattgtgtacatatcctgtatcccccacaaactcacccaaggattttggcatctcactcctccctttaaaaagtatgactctgcaaagccttctttgtccatccttgtctatagtaacctgtttcttttcccattcaagcatcgaaataggcgtttaaataagaaggggaagaagtgaatgtagttcaaagcaccttattttccagaggagtgtttagtgttttgcccaagagcaactgtgtagttggtaacaactgttttaggactagaacctgggtttcctgattcttatctagtgctatttccagctgcctcttagtgacccctaaccaataagacaaaacaaatacagtataatctcaaatagagtataacttttttgcaagtagaaagaaagcatatattatgttttcttttgcgtacattcctttattcatttattcaaaagaggcagatcagcctcctctcctgctccccccactccatccccctgcgccccacagtgtcctttaccctccagccacactgaagcagagctccaggctctctcctctctctgcctgcttctgtgcttccctttggcttgttccattctcccttcccttgttgttttctcctaagcattacatgagcttagctagttgctcagaggaggcctttacctacctgcaggctatgttaggtaccctcttctgtgttattgtaagactctatgtatccatgtttatcttttctttttttccctttgggtaattgttgtttacaatttcttctcgcaggatgatgagctccttgaggtcaggaattttgtttagtttgccttgggcctgccacttggaggtgctcagtcgatatttgctttacctgtaaagctacttcatctctgtggtcattgattactttaccataaaggcagggttgagactcagacctccacgtctctccagttttgacagcttccataaatatttgatctataatgtgcaaggcagtgtggaaaatgcaaagccattttacgtgttgagcaagtccttcaggaacatgggggaaagtcctggctgtagttataaaaagacagaatgagttcattggtgctgcagggaatgttacaaagtgctttagcaatgggaagatgaaggtgttcttagggcagtctcaaaggaggccagaggctgggggagggtcagaacattttagttgcagggaccaatactgggaaaggcacagaggcagaaaggttgtgtttgggagaattgtgagcagttgatttgactggctcttaggattctttgccctacatttaatgtacatattgattattcttgtgatatattgattgttgtccggaatcttttccattttgcttttagggatacctaaaagcaattagtgatactaattgaacttgtatattgacagaaaagtctctcacgggggtaatttctatcatgcaggacttttttaaagcacttgtgctagctgttgtttgaatcaaagtattgtttttttaaagatctattcttccctgcttgtgcaactcctttgagcccaaattcttcactcctaggttaaacagggtaagcttcaggggaagtacattaataattgaacacccgtgaggtgttactgcttctgttctgcacttttagtgttttctgtagcctgaaagagttacttcactattttgatttgcaaccgggatagaacttgaagcaccgttaagaaaggattggagactttgtcatggtacttattttccagatgtttactttttaaataaggaaaaactacaacatgttaataaccaacttggaaaaaacaatattgtgatctgagaaagaacaaaacacatgccatacttaatatgttagtatccattttttccccttcaaatacaattctgcatgtatctgagtagctcttcaccaaatgccagaactttttactcagagtaaatgttgatgagataggacatgtgaaccattgaagaactgattttttttctcataaatactaacttactctgaactagtttatagttactaaccccactgccataaattctccagtcatatgttttgtaatcccttccctggcatacattttaatcattttcctactgcttcataggtactataatccttttatagttccctgggttttaaaataaccctataaagggttcagttttatatttaatagtcatgtttcacactgttctaaagctgtgaataagttcaggcaagcagaagtttctaatttgaaacgactttgtttctgttttagaaagatgtatgcgtcttctagtgtttttcattgtgatgatgttatatattggctagaattttaaaaatatttggaaatacttataaagtgaagaaaaatgaagaaaaaaaaccactgactgctgagcacagtggctcgcgcctgtaattccaacactttgggaggccgaggtgggcagatcacatgaggtcaggagtttgagattagcctggccaatggtgaaaccctgtctctactaaaaatacaaaaattagctgggcgtagtggtgcacgcctgtaatcccagctacttgggaggctgaggcaggagaatcacttgagtctgggagatggaggttgcagtgagctgagtttgcgccactgcactccatccagcctggttgacagactgagactctgtctcaaaaacaaacaaacaggccaggcgcggtggctcatgcctgtaatcctagcactttgggaggccaaggcgggcaaatcacgaggtcaggagatcgagaccatctggctaacacggtgaaaccctgtctttactaaaaatacaaaaaaaaattagccgggcgtggtggcaggcacctgtagtcccagctactcaggaggctggggcaggagaatggcgtgaacccgggaggtggagcttgcagtgagccgagattgcaccactacactccagcctggggatagagcgagactccctctcaaaaaacaaaaaaacaaacacaaacaaaaaccccacacaggtaaaaacattcatcttgtaattttctattatcaggtttcaaaagatcacttctttcttgaaacatacattgtatgtcttttggtgaacaagattgttgttgtcttcctggtgctgacagtttggtgggggagatagacatgaagcaaatcatcacacgaataaactcatctgcatgtgctgtgggggagaagtacttagtgccctgagaatattggcaggtgggacgggagggaagaaagtagcttttgggtgacttgagatctgacagataagtaggcgtcaactagaggaaatttgggtgtggaaaagagactattgcagggagacatgataaggtgggaggtaacattgtacactcaaggagctgaaagatgattagtgtggctggaacacaaataatttgtgtgtgtgcatgttgaggggtaggttgggtggtacaagatgctattggcgaagtcagcagaagcaagcagggactccagcaggcagaccttgcaggccacactaagggttccaggatttcttctaagagcaacaatatgtccttgaagtattgggggtacatgagcatgacattattagagttgcattttcaaaaggtcttctgtgtggaaaatcttttgatgaggagagagaaaagatgtggagagacagagactggcatttggaggcctttgcagaagtctggtaagaaatgatgacagctgggtggttgggatggggagaggatgattgatttgaagatgccaaaaaggacaaggctttaccaacccccctttcaatgatagagagagagaggcaaaatatagatattatcttcataaccggggcccgaaaagtcaaagatcatgcagttagtaagcagaagtagacctggcactggaagctgtctgacctcacatacgctgctctcttttatggcactctgcctttttaggagagaaccttgagtttggagaacttaggtattctctgactgacacagcaccaactacagtgtccagctcttgtgcattaaagctaaatttaggcaatggactcatatctgacaatgagcattgctttgtcaggttcactagataccatttatttatttatttgaggtggagtcttgctgtgttgcccaggctggagtgcagtggtgtgatctcggctcaccgcaacctccgcctccccgattcaagcaattctcctgcctcagcctcctgaggagctgggattacaggcacatgccaccacgcctggctaattttgtatttttagtagagaaggggtttctccatgttggtcaggctgatcttgaactcccgacctcaggtaatccgcctgcctcagcctcccaaagtgctgggattacaggcatgagccaccacacctggcggtagtagtgatttaaatggtatctagtggccgggcacagtggctcatgcctgtaattctagcactttgggaggccgagacaggcagatcacttgaggtcagaagttcgagaccagcctggccaatatggagaaaccccatctctactgagaaaatactaaaaatacgcgcgtggtggcgcgtgcctgtaatcccagctactagggaagctgaggcaggaatctggaaggtgcttgaatctggagggcggaggttgcagtgagccgagattgcgccactgtactccagcttgggcaacaagagtgaaactccatctcaaataataataataacaataataataataacaacaacaacaaataaatcactactaccttctgatgaggagacacactccatcctaactattgggttgtgaataagcttatcagtaaagtcacagtttaccaatctgtttgataatactggtttattgagtccatgatatgttcctagcactctattagttataaaagatacctaaagcacgaccactatagaacttactatctaataggggagaaaagactcaaatacatgattccagcatgacagctcctgtcgtggagatacatgcaggatgctatgggcacccagaggaaggactttgggccgagagttagtcacaggcagatattggtattaatcattatgtggtaatatttcctgaacaagagcataggcgttgtcaggcaaaaatgtctagaaaatactcagttgattaatttgatggaggaaaaataacttctaaggtaaaaatgaaatgtttgtaagttatgaaggttacagtttcaggctgataaggagtttagcaaaattgccttaaacattaattcacttgtggaaataatatgagaaacagagtcttaccatatttttcaactgtgcatgtattttttaatatgtagttatttagtatgatattaatattttgtcagttattatttttctttgaaggtgatttaggcctgggtgaggtggctcacatctgtaatcttagcactttgggaggcttgaggcgggaggattgcttggagctaagagttctagaccagcctggacaataaagctgagaccccatctttacaaaaattagccgggtgtggtgatgcgcacctgcactcccagctactcatgacactgaggctggaggatcgcttaagcccaggaattcaaggttgtatagagctatgattaaaccagtacactccagcctggacaacgtgagaccctgtctcaaaaaaaagaaaaagaaaataatttgggaaaactcactgtaattttaattttaaggggatgctttataataaagcaagaattgcaagataaaagtcacttttcagcaatttgttttacagaagctacattaggacatatctctatctttaagtgaggtgtactcatatatatatttttccctttctgtaatattagttcctcctgggggcaataggaattctttctttctcttttttttttttttttttttttttgagatggagtctcattctgtcacccaggcttgagtgcagtggtgtgatctcagctcactgcaacctctgcctcttggattcaagcaattctcctgcctcaacctcccaagtagctgggactacaggcgcctgccaccatagctggctaatttttgtatttttttagtagagacagagttttactatattggccaggctgggttttttttgaggcggagtctcactctgtcacccaggctggagtgtagtggcgcagtcttggcttactgcaacctccacctcctgtgttcaagtgatcctcctgcctcagcctcctgagtatctgggattacaagcgtgtgccaccatgccctgataatttttgtatttttagtagagacagggtttcaccatgttggccaggctggtttcgaattcttgatctcaagtgatctgcctgctttggcctcccaaagtgctgggattatggggatgagccaccatgcctggctgaaagtatttcttttaagcctgagtcattctgtgggctttgagcacgcttgcatgcttttaaggataacttgccaaactgaatctacctttattttgctgtgtgttttatggttgtctaaaaattttagaaacttttttttttctttttttttttttttacagacaaggtctcactttgttgcccaggctggggtgcagtggtctgatcctagctcaccgcaatattgaccttctgggctctagcagtcctcccacctcagcctcttgagtagctggcactataggtgtgtgccgccatgcctggctaattttttttttttttgagacaggaatttcgctcttgttgcccaggctggagtgcaatggcacaatctcggctcactgcaacctctgcctcctaggttcaagctattctcctgcctcagcctcccgaggagctgggatcacaggcatgcgccaccacacccggctaattttgtatttttagtagagacagggtttctccatgttggtcaggctggtctcgagctcccgacctcagttgatccacccacctcggcctcccaaagttctgggatcacaggcgtgagccaccacgcccggccaattttttaaattttttgggagagtcagagtctttgctataatgtccaggcttgtcttgaactcctgggctcaaacagtcgtcctgccttggcctcccaaagggctgggattataggcgtgagccaccacgctggccagaaactgattttaataatattttaaaaatgttaaatgatgggggccgggcgcagtggctcacgcctgtaatcccagcactttaggaggccaagactggcggatcatgaggtcaggaaatcgagaccatcctggttaacatggtgaaaccccgtctctactaacaatatgaaaaattggctgggcgtggtggcgggtgcctgtagtcccagctactcgggaagctgagccaggagaatggcatgaacctgggaggcggagcttgcagtgagccgagattgcaccactgcactccagcctgggtgacagagtgagactccgtctcaaaaacaaaaacaaacaaacaaaagttaaatgatgacatagtgagaccctgtctctaccaaaaaaaaaaaaaaaaagttaaatggataccctttcacataagtctgtttaaattcattagttggggcactggggaacattggagcttgttttcctgaggaacccgagtgttgggggcaacctagtattccaccccatctggtagaagctctataggatgtgttacgtaggtctcttaaatatatcaatgcaactgtgactaaaaagtagttctgcttcagtacttgaatagaagtccttgatggttctgggctggaaacatatagggtgtgctaataaggttggtaagaactctgtatgttggtgatgtcattgtgaagtcagttggtatatttattgcagggaaacttggaattatttcctactgatgagtgtaaaggagaaaatataatttggcatttgttgaactacttaaccattctcttaagccagttttactaagctttaaaatgtcagtattgcacctgttatattatgaaactttatggacatgacttgagatttctcagtgaagaattacaggaaataaaattttaaaaaatcaaaagtgctggtttcagtttttatttagattgttacttaaaacttataatctagcacaatgggagagttttcaggtgataataattgtagcttcatttatttatttattgagatggagtctcactctgtcgcccaggctggagtgcagtgatgcgacctcggcttgctgcaacctctgcctcctgggttcaagcagttctcctgcctcagcctcctgagtagctgggattacaggtgcccgccactacacctggctaatttttttgtatttttagtagagacacggtttcaccatgtaggctaggctggttttgaactcctgaagacctcaagtgatccacctgcctcggcctcccaaagtgctaggattacaggcatgagccactgtgcccggcctatttatttatttttaaagatgagatctcattctgtcatccaggctggagtgcactggcttgatctcagctcactacagtgtccaccttcagggctcaagcgatcctcccacctcagcctgctgagtagctgcgaccacaggcacgtgccaccatgtctggctaattttctgtatttctggtagagactgggttttgtcatgctggctaggctggtctctagctcctaaactcaggcaatccacctgccttgacctcccaaaatgctgggattacaggcatgagccactgtgcctggcctaattgtagctctatgtattattgactatatgcgaggtactgtgctatttaattttacctaacaacagcccagtgaagcccaatgagtaaattattagttccaatttataagtcaggaaaccaaagctcagaaaggccaaatcacttgctcaaggttactttgtgagtaagtggcatagtaagaattgaaccccagactgctcaaagacaccaaaccactgtgctattttctatgtaacattgtatttttcttttcttttcttttctttttttttttttttttgagacagggtttccctctgtcatcaggaggctggagtgcagtggtgtgattatagctcactttagcctcgacctcctgggctcaagcaatcctcctgcctcagcttcctgagtagctgggaccacaggcacacagcaccatgcctggctcattctttgtatttttggggtctcactatgtggcttgggctgtatcgaacttctggactcaactgattctcccactttggtctcccaaaatgctgggaatacaggcatgagacaccgtgcctggcctgtatttttcaatagtcatatttaataaaatttttaaaggcataattcaattaataaatgtaagatgatgagggacctgatacagtttcacctttcatgtttcctatgacatctcttcagaagcgtttgttgagccactgtatgcagtgcacaatgctgctaggcatttgtggacaatgcaaagatgatgacatcttggcctcctgggtgatccaggaatttacagcaatgcaatccaggtccaggaatttacaatccaggaattttcggggagaaagacattgccagtaatttttggataagctggttcttctggatagataaaaggacattgttaagaaccacttgctggctggaggtggggacttcaaggggacttcattttttgagaaggaccttaaaaggtggtaagattgggatctcttcaaggaaaactacaaaccactgctcaatgaaataaaagaggacacaaatagaagaacattccatgctcatggataggaagaatcaatatcgtgaaaatggcgatactgcccaaggtaatttatagattcgatgccatccccatcaagctaccaatgactttcttcacagaattgaaaaaactactttaaagttcatatggaaccaaaaaagggcccgtgttgccaagacagtcctaagcaaaaagaacaaagctggaggcgtcacactacctgacttcaaactatgctacaaggctacagtaaccaaaacagcatggtactggtgccaaaacagaggtatagaccaatggaacagaacagaggcctcagaaataacaccacacatctacaaccatctgatctttgacaaacctgacaaaagcaagaaatggggaagggattccctatttaataaatggtgctgggaaaactggctagccatatgtagaaagctgaaactggatcccttacaccttatacaaaaattaattcaaggtggattaaagacttaaatgttagacctaaaaccataaaaaccctagaagaaaacctacgcagtaccattcaggatataggcatgggcaagaacttcatgactaaaacaccaaaagcaatggcaacaaaagccaaaactgacaaatgggatctaattaaactaaagagcttctgcacagccaaagaaactaccatcagagtgaacaggcaacctacagaatgggagaaaatttttgcaatctacccatctgacaaagggctaatatccagaatctacaaagaacttaaacaaatttacaagaaaaaaacaaacaaccccatcaaaaagtgggcaaaggatatgaacagacacttctcaaaagaagacatttatgcagccaacagacacatgaaaaaatgctcatcatcactggtcatcagagaaatgcaaatcaaaaccacaatgagataccatctcaaaccagttagaatggtgatcattaaaaagtcaggaaacaggccaggagcgttggctcacgcctgtaatcccagcactttgggaggctggggcaggtggatcacgaggtcagttcaagaccagcctgaccaacatggtgaaaccccatctctattaaaaatacagaagttaggccaggcatggtggctcacgcctgtaatcccagcactttgggaggctgaggcgggcggatcaccaggtcaggagatcgagaccatcctggctaacacggtgaaactccgtctctactaaaaatagaaaaaaattagccgggcgtggtggcgggcgcctgtagtcccagctgctcgggaggctgaggcaggagaatggcgtgaacccaggaggcggagcctgcagtgagctgaaatcgcgccacttcactccagcctgggcaataagagcaagattccatctcaaaaaaaaaaaaaaaaaaaagtcaggaaacaacagatgctggagaggatgtggagaaataggaacgcttttacactgttggtgcgagtgtaaactagttcaactattgtggaagacagtgtggtgattcctcaaggatctgtaactagaaataccgtttgacccagcaatcccattactggatatatacccaaaggattataaatcatgctactataaagacacgtgcacacgtatgtttattgtggcactattcacaatagcaaagacttggaaccaacccaaatgttcatcaatgatagaccggataaagaaaatgtggcacatatacaccatcgaatactgtgcagccataaaaaaggatgagtgcatgtcctttgcagggacgtggatgaagctggaaaccatcattctgagcaaactatcacaagcacagaaaaccaaacactgcatgttctcactcataggtgggaattgaacaatgagaacacttggacacagggcggggaacaacacacactggggcctgtcatgtggtggggggcagggggagggatagcattgggagaaatacctaatgtaaatacctaatgtaaacgacgagttaatgggtgtagcaaaccaacatggcacatgtatacctatgtaacaaacctgcacgttgtgcacgtgtaccctagaacttaaaagtatagtaataataataatttttttaaaaaagatggtaagattggctgggcacggtggctcatgcctgtaatcccagcactttgggaggctgaggcaggcagatcacttgaggtcaggagttcgaaaccagcctggccaacatggtgaaaccccgtctctactaaaaataccaaaaaaattagccaggcatggtggcaggtgcctgtaatcccagctacttgggaggctgaggcaggagaatcgccttgtacctgggaggcggaggttgcagtgagccgagattgcaccactgcactccagcctgggcaacagagcgagactccgtctcaaaaaaataataataaataaaaaagatgataagatttcagctggtggagataggactaggagaggccatttctccttgaggggatgggaaagcaaaggtgaagatgagagaacaatgggagtggggctggaaacgtaaattggtttagaagggaaagtttttgagtgctaggataagtgatttgaactctatgcactaggtaattacattttcattaacatttatcaagaatctattaagctaagtcactgtttttaatgttaagaaatcaaagaattgtttttatagttgtccgacttttcaccaaagacagcacctttcataacctttatctcaggattccttccacgtccaaggtcctgacttttgtccttggaattaagccctaataggagagaaccatctttttaagacattgactgatttctctgtttaattttgatgcagtttaacaccatctaatataatctgccattttgagctatgttaggctggtagatcgcttacctgggcattacttgtttgcttctctggaatccttaaaaggatcacaatatagaatatagtactaaagggcagttgctgtgggagagttggaagtgctgagttgtgggatatttcagaagctctactttttcttttttctttgagatggagttttgctcttgtcgcccaggctggagtgcagtggcacgatcttggctcactgcaacctccgcctcctgggttcaagcgattttcctgcctcagcatcctgagtagctgggattacaggcatgtgccaccacacccggctaattttgtatttttagtagagacggggtttctccatgttggtcaggctgatctcgaactcccgacctcaggtgatccgcccgccttagcctcccaaagtgctgggattacaggtgtgagccactgcgcccggcctgagccactgcacctggcctgttttttctaactgtgttgaataatttgggattcctctctacccttagtttcaaaaagcaatattgtgcagaaagcaaatgaagtcaagtgaatatgatttgaagttggacggtttttggtatgtcttcatcttttaaaaccatcctcttttccaatataaactgttgagtctgaattgacttgttctgaattcaagcaacttgttttttttttttttttttttttttttttttgagatggagtctcatctgtcacccaggctggagtgcagtggcgtgatcttggcttgctgcaacctccgcctcccaggttcaggcgattctcctgcctcagcctcctgagtagctgggattacaggtgcatgccaccacgcccagctaatttttgtatttttaatagagacggggtttcactatattgccaggctgatctcaaactcctgatctcaggtgatctacatgccttggcctcccaaagtgctgggattataggtgtgagccactgtgcctggccttgtatttgtttttaatcaactaggactttgtgctttggtttgtgatagctatttcagtttggtgctttaaaaaaccctcttttaaatgatggccagaagttagtgggtgctttcagattgtgaggcaggatagttatccaggttttggcagtttcaagtgagatcattttattttatttattattcttattttttgagacagggtcttgctgtgtcacccaggctggagttaagtggcacagtcatggctcactgcagcctcaacctcctgggctcaagtggtccttctgcctcagcctcacgactagctgggatcaccacacctggctaatttttgtattttttgtagagatgaggttttaccatgttgcctaggctggtctcaaactcctgggctcaagcgatcacccgccttagtctcccaaagtgctgattacaggcctcggccactgtgcctggctcattttatttattatatgccacatttacccatataactacacgtgaaaagtgaaccgagtacttctattcaggagggattctcaagctttttgtagaagagtaaatggtgttgtgcttgtaacccaggaagctgcagtctgtatctggtctatatctggaatatttgctgtagttaacactctcagtctggttgttattgaagacaatgcaaatgtcccattctcagtaaaagtgtgagccttgatatcagacatctggctttgaattctggctcctttgcttaatagctgcataacaccaggaaagttactttagcttatctgtaagcctcagcttcctcatctttttgtttgtttgctttagagacagggtcttgctctgtcacccaagctggggtgcagtgatgtgaacatggctgactgcagccttgaacttctgggctcaaggaatcctcctgcagtggcttcccagtgtgctaggattacaggcatgcgccactgcagctggccagcttcctcatctttaaaatgagaatagtggctgggtgtggtggctcacacctgtaatcccagcactttgggaggccaaggagggtggattacgaggtcaggagatcgaaaccatcctggctaacatggtgaaaccccgtctctactaaaaatacaaaaaattagccgggcatggtggcaggcacctgtagtcccagctactcaggagactgaggcaggaaaatggtgtgaacccgggaggtggagcttgcagtgagccgagatcacaccaccccactccaacctgggcgacagagcaagactctgtctcaaaaaaataaaaaataaataaataaataaataaataaaatgagaatagtaataatctctcctagggtcatgaaagggcgaaatgaaataatccatgtgaagagctcagcacagtgcctgacgcatgctacgtgcccaggaaaagtagtttttgaaaaacgctgattttctatttgcactttattgaaaacttggtggatgctttgaatactgagaatttcattaccactttttcagttctaatgtgcatactgttgtacactggtacctactgtgcagatcatgactgaaaggtgtttgaaaggacagtattgtgaaatcttttgtcattacgttaatgttattgcaataaaataacaaatttttaactattaaaagtaatgccatctgtttttcttcatctgtgttttcaccacaaagagataaaactactgttgacattttgacatatcttttttcctccagtgcgtatttatttatctttttaaaatttatttttaacataattgagattacaccgggttgtaatttttgttatgtcttaaattcaacagaattttattttattactttactttgttttttgagacaagacctcactttgttgcctatgctggagtgcagtggcgtgtgatcatggctcactgtggccttgacctcccaggctcaagctatcctcccgcctcagcctcccgagtagctgagactgtaggtatgtgccaccatacctggctttttttttttttttttttttgagatggagtcctgctccgtcgcccaggtggagcgcagtggcatgatcttggcttactacaacctccgcctcctgagttcaagtgattctctgtttttttttttttgagacagagtttcgctcttgttgtccaggctggagtgcaatggtgagatcttggctcactccaacctccggtttctcttgcctcagcctcccaagtagctgggattacaggcacgcaccaccacacctagctaatttttgtatcttcagtagatacggggtttcaccgtgttggccaggctggtcttgaactcctgacctcaagtgatccagccgcctcagcctcccaaagtgctgggattacaggtgtgagccaccatacctggttcaacagaattttaaataaggctgcacagaaatatcccatcagatggatcttacctctgcgttgtcattctccatcaaataatgtaacctaaaccagataacaccatgctctggtaatgtatcgttgagtaatttgattctgctgtcttaactgatacttaagccttcatcatgagccaagagatagctctcatttatgagatgaagctgagaatatgaaaagaaagaggatttacttatgctcaaaaatttactctatttttggcaatgctcaggctatttctctagtaattcacttgaagcacatgtcttatagaaataaatatttacatttttacagaggaagaaattaatgaaatgcttttcctgtaaaatggggaattttacattgtttttggctactagatttaatatagtgtgactagcttagcattttaattataaaatttcaaaattaggttaaattatgtgaaactcttgttttgaaaatatcactctttctttgcagtagttaatctgagaatagtcaaatggattttgtcatggtgtaggataaggtcacttagaaccagctgaaaattttacaaagttttaaaaaaggaggctgggtgcagtggctcacacctgtaatcccagcagtttgagaggctgaggcaggaggatcacatgagcccagaagtttgagaccagcctgggcaacaaagcgatactccaatctctaaaaacattaaattaaatattaaaaaaaaataagaaaggttgtctaacgatacttataaaaaacaaacttatgacttgaaataaggcacttactttttttaaaatgaagaaaaattctaccttggtaataagagaagtgcaaattaaaacagcaagataccagcttttgtgtaacaaattagcaaaaaaaaaattttaatggtaaaattcagtgttgaaatgaggacacatggacaaagggtggggaacaacacacactggggcctgtcccggggggtggtggggtagggagagcatcaggatacatagctaatgcatgcggggcttaatatctaaggtgatgggttgatttgtgcagcaaaccaccatggcacaagtttacctgtgtaaccaacctgcacatcctgcacatatatcctggaaacgtaaaataaaattaaatttaaaaaatgattaaagaaacattcagcattgacctgggtatgaggaggtgggtgctatcactgtgagtgggaattgacacaccctttctggtaaatgcttttgtttgggattcttgtgattatactcctagtagtcaactttcctgagggcatggtctaactcagacacagagacatttatcaaagcattattcatactagaaaaatagcagaaacaattcaaatgttcaacaaaaggagaatagttaagtcaatttcaacatatccaaataatgaaatattacatagctattaaataatgctttcaaagcataattaacaacttgggagaattctcacaatatgatatactgtgtgtgtgtgtgtgtgtgtgtgtgtgtgtgtgtgtgtgtattgtagtatacctattttaccatcaatatctttgcatagaataatttttaaaagactaaggagaaacaaaatgtgctttcagatttttccaaaatttcttccgtgagcatttatcctataatcagaaagaagtgaataaacattagtgtaaaataatgattttaaacaaatggccatggtagttcacttcaaatggctggagttttactgtatggatcacaacatattgtacttaatggaaaaactattactaggagccattcattttttaaaatgacacattatgtgtaggtacattttcacatttagatgggcaaaattaagtcctgagagcttgcatctgaaatcatatggccaatcagtttaagcgaactctaaacttctttgatgagaactttggcacaatttcatcaattctaggaaaacacttctgcagtacttaataagtgatatgagtaagtaaaatgggaagaggactaagtaagtagttccaaaaagagaaaccttttaaaaatggaaaaaggacaaacttccctgtccttgacttcttccccttcaccaccaccccctttccttggcctaactggaacgcacagtcacattaagtgatgccttgccctttgactgactctctcagtaaaagttcagatagccatctagtggaaagaagactctttaagaatgactttcctccagacacccaatatcatgtttgttcagttggcttgtccaaacaatttttctgtgttttcaccagagtagtatcaacttagcatgaagattaaagctgttctccatctgctttatctgccgttcttaattagaacctgatgacagaaatcaactttgattcaaggctgattgttcccggagaatctcattattattgtaaacagtttttatttttctttctttttttttattaaacacattgattctgagcatctatatggcagaagtgagggtaaaaaaataattttcttcatttaatcgtgtattcagcatctgctctgctagatgccgtggggcatattgaagttgcttaaagtctggtagagaagataaagcatgcacagaaatagtttttaatacaaacttgaggtgataagtgcccaaagggacaggcacaatgtatgtggaaattcagaggagcagttatttctcgttaaggaatcgtgttttctgagttttcttttagaaattaaacagatgtgcattgttctgatggactgaaaaaaagagaaacaaatggtcccttgctttcacactttattttactttatgagaaattaagaggcaaatgtttgtatatcaatcccttaggcaagtaatggactttagagtgccttaatggttttcaaaaaatagtctacaaatattaagtctacactcagagtctgcagtctaccaactttaatgaaatgtaattttatgcataacataaagtaatattaaaaattacttgtagaaatagttaattgggctaattagatattctttttttttttttctttgagatggagtcttgctgagtcacccaggctggagtgcagtggcaccatctcggctcactgcagcctccacctcccaggttcaagtgattctcctgtctcaggctcccgagtagctgggactacaggtgtgtgccaccacatctagcttatttttgtatttttagtggagacagggtttcactgtgttggccaggctgatcttaaactcctgaccttaagtgattcacccgcttcggcctccgaaagagctggggtcacactcatgagccactgcgcctggctagatattcttaatgggcaaattgggagcctagtcttggcatcaggtgtcctgtatttaatcagttggcagagctagttacctggaccacctactcagcctaggaggtgctgtgatacagcagagaagacataaacttgggctctgctacttggtagctttgggccttggtaagttttactttgtctttctattccttggtcttctcatctttaaaacacctcctaggattcttgttaggattaaatgaaatactatatgttgctttgatttgagtggatcccctccaaaattaacctgttgaaacttaatggctaacgtgatagtgttaagcgagggggttgcctttaagagggagttaaggccatgagggcttctccctcatgaaagtgattgaagccctcataaaagaggcttcactcagcacttggccctcctactcttctgccctctgcggtgtgaagacacagcgttcctcccctccagaggatgcaaggcgccatcttggaggcagagaccgtgcccctcaccagacactcagcctgcccgcgccttgatcttagacttcccagcctccagaactgtgagaaataaatttctcttctttacaaattacccattctgtggtattctgctatagcagtacaaactgaccaagacatatatgaagcacctgacacacagctctctataaataatgcttcttccctgctctgtcttgacttgtttgaaggatcagcagttaacaatgaacagtttaaaatgatctcagtattctttctttttcctcttgagggtgaacctcttaaattgggctggcttatagttcctaaaatcacagctgtttgatatagacgggggattatttgaaagtctgagtcaaagacgagaagtaggaaatcagtttttccccggctgtcgttgtgcgcctccttccaggggagtaatcagctcagactatctcaatagttaatacttgctgttctactcaaaattgaactcactaaaatctcagtgatttcttcattgaagattgccagtagatggcttttaattccctgtagtgtctgctttactgttttcatgcttgtttttctaaagtcttgagtcagcgtctttatccttatcagtgtttggcctttgtctactctatctctgtaaatcatttgtaggagggttaaattccatctgacgcaaattgtgattttaaaaataaattgctttgtcctaccatctctgaaaataaaagcagataattttcctaagtcacttatttaagaagtagcacaagctaaatgccaaccacttgaagttgtagacttgctagacttttttaagcttcaaggtctctgtgttttctgtttcaggtaaaaatggtcaggactaaacagttcttcaggggaaaaaaaaaatagggtctttgtcacagctgagtcttcatcttaaccaagatttttgccagaaagcctttccttctcttggaattttatgctggttgaaatttgggtttagttgaagtataaggagctgtatttccttatgtctggttaagttccactgtcttttccacttgcagattttatattcagttgtcaaatttgcttgtgctcagcattgaacgtgatttctgtacttgtatgattaaactggaaaaatctggaataaataaactggaataaataaactagaactgttttctgaaattggaagggatttagataatggtttgatggatggaggaggagtgaaaggtgggttagtatgaattttaaaagtttagatttttgccactgttcatgctaatgtaaaaaaggatcttgttggcctggcgtgtggctcatgcctgtaatcccagcactttgggaggctgaggtgggcagacatctgaggtcaggagtttgaggccagcctggccaacatggcgaaaccccatctctactaaatatacaaaacagccgggctgggtggcaggcacctgtaatcctagctactcaggaggcttaggcaggagaattgcttgaacctgggagacggaggctgcagtgagtcgagatcgcaccattgcactccagcctgggcaacagagcgtggactccatcccaacctaaaaggatcttgtttaaatggtgcctattccctgtagattttgtagcttggtattacaaatatttatttagtgcctgctatatgtaggatgtaatataaaatagattaataacatggtcctttcctcaaggaattgtcatggaattaggaggtgggaataaaggagacgaagatacatgtgctgagtgcaaagctcagggaagattgaaaatatgcagtctccttgggagtgaggtgggatgaggagtggggcaggatataaatgaagtttctaggaggaggtacttaattaaggcacagaatcatggaagtgtctggaagaatgcagagagctatgagcaatctggtaggtccatggggctacctggggtctggtgtgatccagctcactttagcctcgaatttctgggctcagaggatcctcccatgtcagcctccccagtatctgggattacaggtgcatgccaacatacttcgctacgttttttaaaaaatttcttttagagataggggtcttgctgtgttgcccaggatggtcttgaactcctggccacaaacagtcctcccacctcagcctcctgagtagctgggattataggtgggagccactgtgcctggcctcctttctcctcctaaactggttttattgaggtataatttacataccataaaacccacccatgtaagcatacaatccagtgatttgtaaaagtaaatttatagagttgggaattgccacctcaacccagttttagaacactgctttgtccctggaagtttcctttcttctgggtcaatccctgctttcatctccagcctctggcaaacactgttatgctttctgtctctatagatttgacttttctagaaatttcctataaaaggaatcataggtagtcttttttgtttggctactttcacttagcaaaatgtttttgaggctcagccatggtgtagcatgtataagttgtttgttcctttatgccgattaattgtatttgattgcatggatataccacattctgttacccatttgctagttgatgggcatttgtattgtgtccaggtttaggctgttattaataacgctccaaggctgggcgcgggagctcatgcctgtaatcccagcactttggggggccgaggcgggcggatcacctgaggtcaggagttcctgcccagactggccaacatggtgaaaccccgtctctactaaaaatacaaagttagccaggcatggtggcaagtgcctgtaatcccagctacgtgggaggctgaggcaggagaatcgcttgaacctgggaggcggaggtggcaatgagctgagattgtgtcactgtgctccagcctgagcgacacagtgagactctgtctcaaaataataattccctgtgggcacttgcatgaagtctttgtgtggacatgttttcatttctcttgtggagatacttaagagtgaagtttctgggtcatatagtaagaatatatatatattttacttttcaagaagctgccaaactgttctccaacttggctgtatgtaccattttacaaccagcaatgtctgagggttttggtttttccacatctttttgttgttgttgttgttgttgttttgttttgtttttgtttgagacggagtctggctctgtcacctaggctggagtgcaatggcgcaatctcggctgactgtaacctctgcctcctgggttcaagtgattctcctgccttagcctcccaagtagctgggactacaggtgcccagcaccaagcccggctaatttttgtatttttagtagagacagggtttcaccatattgaccaggcttgtctcgaactcctaaccttgtgatctgcccgccttggcctcccaaagtgctgggattacagatgtgagccacccaacctggttattttccacatctttgtcaacacttggcatgtgagttataaccatgctactgggagtgtagtgcttttttttttttttctttgagacagggtcttgctctgcctcaggctggtcagtggtgcgattatagctcattgcaaccttgacctctgtggctcaagtgatccttccgcctcattgcactgagtagctgggactacatacaggtgcacgccaccatgccaggctaatttttttgtagagacagcatctgactatgttgcctagtctggtctcaaactcctgggctcaagcaatattcttgccttggcttctcaaagtgctggggttacaggcatgagccacttgtgcccagccagtgctgtctttttttttttttttttttttgagacagggtctcactctgtcacccaggctagaatgcagtggaatgatcttggcttactgcagtctccacctcctgggctcaagtaatcctcccacttaaactttccgagtagctgggattacaggtgtgcaccaccatgcctggctaattttttctattttttgtagagacagggatttgccatgttgtccaggctagttttgaactcctgggctcaagtgatatgcccacctcagcctcccaaagtgctgggactacaggcatgagccactgcactgcgcctagtagtgcttttttttgaggcggagtctcgccctgtcgcccaggttggagtgcaatggggcaatctcaactcactgaaatctccgcctctggggttcaaacgattctcctgcctcagcctcccgagtagctagaattacaggtgcctgccaccacgcctagctaatttttgtatttttagtagggacggggtttcaccatgttggccaggctggtctcgaactcgtgaccttgtgatttgcccgcctcggcctcccaaagtgctgggattacaggcgtgagccaccatgcccagccagtagtgctatcttagttgtagttttgctttgtatttctccaccgactggcagtcttttaatattgtaaattatttcggctatttcagaaaacactactctataatagcggcaattggtgttgtggttcactgttttgtttgttttcttgaggcggagttttgctctttgttgcccaggctggagtgcagtgttgcgatctcagctcaccgcaacctctgcctctgggttcaagtgattctcctgcctcagcctcccgagtagctgggattacaggcgtgcaccaccacgcctggctaattttgtatttttagtggagacggggtttctccatgttggtcaggctggtctcaagctcctgacctcaggtgatccgcccacctcggcctcccaaagtgctgggattacaggtatgagccaccgtgcctgccttattaactgtatttttttctaaagctcttgaaagaatttttgtatgtgaagaatccagacactattttattagagactctttgcttacttatttttactctttctttttgagatttgtaaaattatcctctgatataaactacctgtggcctgccacctgcttttgtatgccccaggagtaaagaattttatttttaaatggtcgaaagtaaaagaatactattttagccaggtgtggtggtgcatacttatggtcccagctacttgggaggttgaggtgggaggattgtttgagctgaggagtttgaggctgcagtagccatgattgtgcccctgcactccagtctgggcaacagcatgaaatgctgtcttgaaaataattgtgatatgtgaaaattacatgaaattcaaatttcagtgtcataaataaattttgattggaatacagccatgcctattcatttatgtgttacccatgtctgcttttgtgctataagggcaagagtagggtagtttcagtagagactgtacagcctgcgtagcctaaaatacttactgcctggctctttacagaaagtttgcccaccctggctctcacccattccagatgttgcctattctcagaaaaaaatttgctattgacttgtccttttggttcagttccttttttagagatagggtctcacaatgttgcccaggctgaagtagagtggctgttcacaggcacagtaccagtactgatcagcatgggaattttgacctgctctgtttcctccctgggccagttcaccccccttcttcaggcattggttcagttcttgtgttggttctccagtttgttgttactgggaaacctgaattcatttctcaagtgtcaccctggaagggaagagacttattgaaagattcctgttttgtaatgtgttctttcctggcttggtgactctagttaaagttagtctctggggcttggtgtggtggctcatgcctataatcccaacactttgggaggccaaggtaggataatcatgtgagcccaggagtttgagaccagcctggacaagatggtgagaccctgtctctacaaaaaaaaaaaaaatctaaaaattagctggtcctggtggcacttgcctctagtcctggttactcagtaggctgaggtgggaggatcccttgagcccaggagttcaaggctgcagtgagctatgattgtgccatttacacaatccagcctgggtgacagagtgagaccccatcctttttttttttctgcaaacactatggtgacttagagacctcgtccctaaaaaaaaaaaaaagaaaaaaaaaaaagtctctgggaccttttaagaaagtcacccagtaaacaaaggggaaagaatggtgcttttgtagatgaaggtatcacgttaactatttgtgtttggaaagtgatgctgtgtaacatagataattttgtttattggtttttttaagtgcccattataaaatttaagataatacagaggtataggaagtcacttaccccctcattctactcttacttgtcgccattattaggaatttatttccttttatacctttttctatgcagatataaacatagccagttgggttttgtggctgtttttttcagaaatgaaactgcagtgtacattttgttttaaaatgaaggtttttcagaacttggcccagggtatggtggctgtgcatacctgtagatttgctgtcttcattttagcagctgcatggcctttttttgtatgactctaccataatctacttaactgttgatgaagtttaaggtttttgcttatgtaagtaatgtccgtgtgtttcagttggccttactaacactggttatattcatctttaacatatttttctttttttggcctatttggtaagtgaaaaatagctcattgtcataacttgcacttcttcagtgagactgaacattttccttattttagccacttgtacttctatgaattatctattgcttatttttctttgggttgtttgtgtcttttaattggttgcagatctttatatattataaaccctaactcttaatttgcaaatatttcttacaattgatcgtttcttatttatggtggcgtttttccttacagaagtcttagttttgtatgttgtcagatctgtcaaacatttatagctcttggatttggaggtatgcttgcaacgtgtttccatgttttaatattctaagtgtaactatcttaattcagtgattcctaatcatgactgcatcagaataatttaggggaatttttttcagcatatatgctgtgatttccaactaagatattctttcttcgtagataaaatgtggggtccaaatctgtggagtttggtttgttttgttttggagagaggaagaagcttcctggccaggcacggtggctcatacctgtaatcccagcactttgggaggccgaggcaggcgaatcacgaggtcaggagatcaagaccatcctggctaacatggtgaaaccctgtctctactaaaaatacaaaaaaattagacgggcgtggtggcgggcgcctgtagtcccagctactcgggaggctgaggcaggagaaggcgtgaacccgggcggcggagcttgcagtgagctgagatcgcgcctctgcactccagcctgggagacagagcgagactgtctcaaaataaaaaaagctccctgattctgatgtgaaaccctagttaaaaaatcacagtatgtaaaacagatttcattgcctctttccagttgagttgtgtttttttctttgagagtgtgaagggggtggtgctgcttggttccttttacttaacattcattgagttcctgtgacacacttggagaattagtaaggagagaattcatgcaactgataaggagagaaactgctgtacattgtaccctttgctgtgcactgtaactgtacaatcaagtttctttatcttgacaattgtgttaaaccacaagctattggctatatttcattggttgaaagatgcactttttttccccacgttttaacatccatgaaactgggatgacagcatgacatagtttatttggcagcattttaaattttgtagtataatggttcatcttagtcaacttggagaagttggataattttttatctttcatttttgtatctaaagtacatcagtacggtttttttttttccatactggccttcatgttcctgagtggtctcttctcttctagtgtttctttccttctaattaagttttatatactgctgccagattaatcttcccagaccatgattctgattaaatcactgctatatgcaataactttttttttttgagctagggtctcgctctgttgcccagactggaatacagtggtgcaattatggctcattggagcctcagcctcccaggctcaagtgatctcctacttctcagcctccagagtagctggaactactacaggcaaatgccaccacactcagctaatgtgtgcaatgtgagcctaaaatacactaaaacatgcatgcttgtgctaattttctgtgtgtgtgtgtgtgttttttttttttttggtagagacaaggtcttactatgttgtgcccccaggctggtcttaaactcctgggctcaagagatccacccaccttggcttcccagagtactgggattacaggcatgagccactgtgcctggccttatgcagtgacttttaataagaaacaactgtaacagaaagttcaaacattttaatatttcattttagaccctttgaatgaaatatttacctcttcaaccttttattcttcacatactccaattttgcattgataagctaacagcatcttttcatgtattcccccccccccttttttaaaacaacatcatcttgtatttacttattgaatccttatgcgggattgctccctaccctctccccagacctctggctgtttgaaacccacctatcctttctgctcagcttctgtcattcatccatctccatgcaattgctgctggtataacaggggtgaaagataactattgacaaagaacagggaagtttttttggaactctggggttttaagaaaggcattgacgtccttgggaactaggtaatacagtttcctctccttttcctatttttgattttggctttggctttgtatttgaaattctcttcttcacttcagatggaggtgtgggaggggatgtgtggggtgtagtatgtgtggccccacaggtagatcacctgatcagtcttttaccctaaacataagagagggaaaagcacaaaaaacaacagctctaagatggggcatgtacatgtccaaatttgaactcagtcatgtttttgtcaaactaagatgatgaactagttataagatgaagtttgactggacgaatgtagatcctattttgaccataaagctagttgcataagtaagcacaggatgatgttgaggggtttgtggcttaggagtagcacttaaggacatctgcggagggccaaatgtgagtccgtagtgagatgtggcaacaacaaaaataaaatctcagatgcattattgaaagaaaaaaagaatatctagaattgggggagatgataatcctatttatttttttttttgagacagggtcttgccctgtagcccaggctggagtgcagtggtatgatcacagctcacttcagccctgccagtagctgggactgtgggtacacactactgtgcctggccaacttttaaaatttttttcatacaggcagggtctcaccatcgagcccaggctggtcttgaactcctgggctcaagcagtcctcccgccttggcctcccaaagtgctgggattataggtatgagccagcatgcccatgaatcctattttattctgtattggggtggacacaactatcaagtcttggtcaattctggggcacacattttgaaattagaagccacatacagaagaacaattgaagaaagatctgctttggagacatgagaacttggggcatgggaagcccataattagccatcaggatatgtaaaggaagaggatttgtaccttgtggttctagggaatagaactaaggccagtggatggaagccacagatagaaagacatggctcaatttaaagactaatttgcagtgagagctgtttaatgatggagtagaagatggtaaacttcctgtttgtaggaggttgaacaatcatttggcagctgtgttttagaggatataaaaatgttgaatcactaacaagtgttcacttttcctcattataaatggaaaaggcaagaaacactcaaaatttaaattggcactcataatatactatcatgacataacatgttatcaaatttattattttgcaactgacagtaatcacttagccagcagatgtacttcagccttagcattgaattaagcagagtggtgacagtgaactggatggtgaatttgctctagcaagtttacctgagtggattctgtgggatggaattagaaaaaaaaaaaaaaaaaaacaaacctccacagagttaaacagccttttctcatcagtgatacagtggtaagaacctgcaaatacatgtatgtacactgagagggcaggaggaactttatgccaaggtcttcataagcccaaattaacaaattgccaagtatgtcaaaacttgtgtctgtgttggcaggacctgtgaagcactcctctggaacatagtctgcaaaccacaacactaagtgattgatctctaaggcctccttccaattgtaaaattctttggtaaatgaccttgtaatatatgcttggcagtagtttagggttatggagtaacagaagcatagccaattaaaactatgagaaaacttaggtgtattataattggcccctctggaatttggccccagctttgaggatcataattacaacgaagtcagcagtttgaaataagttttcaccataggggagaagagactcagtggcactacggcttgctttcagtcttaagtgaaattctacttccttgtcttaaaagaacctcactggttctttcaattgagaaaccttgatggtttgaaagagatacttggaagagagtgattaatgaaaataatattggtgtgtataaagtcattgagcagctgaggggcttagaagctgagaagatctgaaagcaatgtgagcctaaaatacactaaaacatgcatgcttgtgctaattttctgtcaaatttacaaaatctttggagggagagtggaatttagaagagaaagcaaagtgaataacattttatgattaatgaaagaagaatttagtagagtagtgcagaattgaagccctaggcagattctgaattatcctttgtttcagggttctctgaaccctcaaggctgggttaggtgcccaccttggtactgtgtaacattatgtctgttacagtatcagttccaattcttgccttttttttttttttttttttttttttgagatggaatcttgctctgtcacccaggctggagtgcaggggtgtgattgcagcttagattgcagcttactgcaacctccgccttctgggttcaagcagttcccttgcctcaccctcatgagtagctggaattacaggtgtgcgccacacgcccaggtaattttttttttttttttttttttttttttgtatttttagtagagacagggttttaccatgttgaccaggctggtcttgaactcctgacctgaagtgatttgtccaccttggcctcccaaagtgctgggattacaggcgtgagccactgcgcttgccctgtccactactttctaattggttgttttcaaactctctgagcttcaggaagacaaggaccatgtttggactctcagggttggatgtacgttaagggtttaataaatgtttgttgaatgaataaacaggaacccctttacctttctttcatttatgctacttccttgttttggcatttctgagatattgctgttaacatcatgcagcttgactattaacactttacctttatgtgctgataattggtcaagttgggtattgggtacagggaggctcacagtattattcttcccataataaaaagagttttagaaaagacattaacatctgtaaaactgattgtcctaaagagctattcccatctgactgcagagtggaaagcatctgatggcccaattgtgacaagctcttattatttactctcatggatgtttgtacaggttgcgtattccttgtatgtatgtttgggaacaagcattttggatttttttttaaaggttttggtatatttgcattatgtttactggctgagcatctgaaatccaaaaatccaaaatctgaaatgctccagtgaacatttcttctgagcatcatgtcagtgctcaaaaagttttggattttggagtatttcagattttggatttgggatactcaacctgtatttcaactgggaatagtttgtttctcaaattgtagttcccttatgatttgaggacatactctaaggatccttaagtttccttgtgaaaaaatttttaaaaattgtgttattggctgggcgcagtggctcatgcctataatcccagcactttgggaggccaaggtgggtggatcacctgaggtcaggagttcaagaccagcctgaccaacataatgaaattctgtctctactaaaaatgcaaaaattagccgagtgtggtggcacaaacctgtagtcccagctactggggtggctgaggcaggagaatcacttgaactctggaggcggaggttgcagtaagccaagagcgagactctgtctacttttttttgtttttaaaagaggaagtgaggaaagtaggtgaacaggaggaatgatgaatgatgctgttagacagaatctccagaccattccttggtctttgagttcctcctgggacctattttgttgttgttgtcgtcgagacagagtcttgctctgttgcccaggctggagtgcaatggtgtgatctctgctcaccacaacctccacctcctgggttcaagcgattctcctgcctcagcttcccaagtagctgggattacaggcatgcaccaccacgcctggctaactttttgtatttttagtagagacagcgtttcaccatgttggccaggctggtctcaaactcctgacctcgtgatccacccgcctcggcctcccaaagtgctgggatgacggacgtaagccaccatgcctggacttttttttttttttttaagctccacttagagccatctcaaacatacgattttcaaaactggactcgattttttttttcctcttctccccgccctctgcaaatctatacttgctgccatcatccttattttaattaatggccgtcctgtctttccagttgtcagggtaaaatctgaatgttatcctttatgacttcgattctcttaaccttaggtgtaatctgttaggaaatcttactgactctagcttcagaatatttccagaatgtggccactccataccatctctacctctaccacccaagcccctgtcattttatagcatattatggctgtaccattagcctccttgctggtctccttgctgttttatctttgcctccttataattattttccacacagcagtcagtgatctttcaaacaaaaaactttactgatgtttataagcacacacaaaaatgcacatgttatgagtttgcagtgaattttcgcaaactggtcatacctgtgtgtgaccagcgcccagagcaagaaacggaatgtgaccagcaactcatgctgccttccagtccctgtcccaagggtaatcatcaccttgacttgtagaacataggtcagttttgttgtttttgtactttatctataataaatggaatcgtacaatatgtactgtattgagtctggcttcttttatgcagccttatgtgtgtgtgaatcatccatgatgttttatgaaattgtaaatggtttcttctcattgctgtgtgctatcacattgtgttaatataccacgatttatttatccattcttccattctgctaatgggcattcagatagttcccggctttaggctattttgaatcatgctgcttggacattctagtacgagtcttttggcaaatatatgtatgtgtttatgttgggtatatacctaggagtaggatctgtggttcatgaggtatgtgtgggttcgggctttgtattaccaaataattttccaaaatggttgtaccccagcgagtgatcttttaaaatatttgttaaatcctattatttgttgtttgaaagcttgtcagtggtttatcaactcactcaataatagctgaaattcttacagtggcatatcacttgtcttcctacttctctttgaacatgctaagcacacgtatcttcaggcctttgtgctagctgcccccactacctcatttgttataccacctagctatgttacctgcttaaattcagatgtctgctcacaggtcactaacatatgtaaaatagcctattcttttcatctctgtccctttattttgcattatttttcctcgtactacttactactgagcatgtctatgtttaatatgtgtaacatttgtctccccgccacccaccagggactttgtttttttgttaattgttgtatccattatcctctagaacagtagacattaatagttgcccaataaatagttgagtgagtaaatgaatacataaaacaaatagttgtaatagacataatggatgaaaatagaatttggggagaataagacaaatgaggttaaaaattgataaaaattacttaattttaatttttattaaaacatagctgaaaaagacacagggcttaaaatagcaactccttatctcattctaattcctactctccaaagttaactactttgttctcttccatctctttcttttctttttatttttttttttgagacatattcttgctggatcacccagcctggagtgcggcggggtgatctcggctcactgcaatctctgcctcctgggttcaagccattctcctgcctcaacctcccaagtagctgggattacaggcacgtgccaccaagcccagctaagttttgtattttttagtagagacaagtgtttcgccatgttggcaggctggtctcagacgccatgttggccaggctggtctcagaactcctgacctcaagtgatctgcccacctcggcctcccagagtgctgggattacaggtgtgagccactgcgtccagcctcatctctttctcataccattaaacttgatatttctaaacttttagttaaattgctatctattttatttcagttttagtgggtttttttttttttcatagctcactgcagcctcaacttcctggcttaggtgatcctcccaccttagcctcctgagtagctggactacaggcgcataccactacacctggctaatttttgtatcttttgtagagacagggtctcgccatgttatccaagctggtctcgaactcctgggctcaagtgatctgcccgccttgggctccagagtggtgggattataggtgtgaggtgccatgcccaacccagttttagatcttctttgttggctcttacgctgaaagataaggactttccttttctgtatttcccctctccccacaccacacattcatacttttcttcctctatcctgttgttataattatcagatttaagatgtgctttagatgtcacttccttagagaaatgttccctaacttttcatcttaaaccaatgtgttcagtgtttacattattatgactacataaagattgttcatatgatacaatcaacatattgcgatcacatgcttttttttcttccctggaatccttcataaatctctttttctttgcttacttttcttcacatcaccagcttatccacatacactttgctggaattctaaagtaaatacatcaggttatgcatcagttctttagcttgtttcggaagcacatctcctagaactgccaacctgtgctggctctgtactgctgttgccctgaatcttaccttcacaaattaagaattcccttcatcaccaggtgtggtggctcgcacctgtaatcccagcactttgggaggctgaaacaggtgatcgcttgagtccaggacttcagaccattctgggcaacatggcataaccctatctctacaaaaaaaaatttaaaaattagccaggtgtgatggcgtgtgcctgtggttccagctacttgagaggctgagatgggaggatcacctgagtccgggaggttgaggctgcagtgagctgtgatcatgccagtgtacttcagcttgggtgacagagcgagaccagtctcaaaaaaaaaccccaaaacaaataattcccttcctcttttttcctatattaaattttttacctctggatccccacatcaggatctttgttggtttactcacttatcttgggagaacatatcctccagtagttcctagagaaaagtgatcctcccacctcagcctcccgagtagctgggacccacaggtgcatgccaccacacccggctaactttggtattttttttttttaagtcaaggttcgccatgttgcccaggctggttttgaactcctgagctcaagcgatttgcctgccttggcctcccaacgtgctgggattatagggatacaccaccacgcctgaccagggatggtaattttttttttgatcttgtgtatcagttatctattgccataatactatatctcagatcactgagagacctcagttgcacataatagtaagtgtttattggccatatgtctaggatagttggctgggaggctctgctgatctcgagggttggccagctattagctgatctaggatggccttggttggaatgactagggtgactgcctcttcttcatttgtttcatctttcttggaggaccagtggtctagccaaggtgtgcttttctcatggtaacagtggagggcaaatggaatgcataagtgcttttcttacatttgaagtatatccactacatattcagaaatatcctattttggaactatagtcatttggtgaccagaaaaattatccatgcaaatgtgcagagaaaaaatttaagatatttagtatccttcagacgactaaacagtcgtcactttctcaaggaggtgttctttgcctttttatattaggtaagattctcctttaaatctcactattagcacttggttattgttatttcataattatcacactggctatattatttgattcatattggtctgtctctctagaccttaagctccactgaagacagcaacccagtccagcatagggttagcctggggcctgcagtagtgagtacataataaatatttgtcagacaaatgaatgaaatgattagatctcaggaatagaaggtatttttagggttctttttattggctctttttgtatttgaagtgtgttccttcttcaaggatttggcagagaagaggaaaaacatagaccattactaatttgcaggagagagaagctggcccagctttgggctgtttgctcggcctagctgcattcccctgtgtaatcaagactgtaaagctttgatgggtagttagttctttgtggctttagggctttccgatataagtaattgttttcatgagtgtattaatttgactctggaacttgtaagcaactggaaacaagactgttcctacttgtttatgtgaatgtttgttgttctgaattggatgacgatactcattgttatttcagaggagtggttgaagaatacatttttaaactaattagtgatggagttgcaatacagttttgtcattggtgctgcattcaataaacttatattacagtctaaatcttggaatgtatggaaaattaacattaattaaactaatctaagttacagaaagctgacaagtgaacagaactgaatattaaaaactattccttaaacatgagtttacttcatccactctatggtgtttagttctacttaataattccagccttttcataatttgaaaggagacccatattttgtggcttattgtttgttcaactttgatattgattttaattgttaggacaggaaattgtgatagaactagaaatttcctcccaggattgaaaaaagaccttgctcaggtgtgatctaaatattatatttcttattaatgacaagtttttttgtgttttgcttttttgataattaaggagtaaaatatatgctatatattatataactatggaattttaggtcttaaatggacaatatcaaagcagcctagctgtctttaaaatatttatatttttatatatattttatatatatatttatatatataaattttttaggtcgggcgtggtggctcacacctgtaatcccagcactttgggaggccaagtcgggcagatcacaaggtcaggagattgagatcatcctggccaacatggtgaaaccctgtctctactaaaaatacaaaaattactgcagccttgacctcccaggctcaagtgatcctctcacctcagcctcccaagtagctgggatcgtaggtgcacaccacgatgctcggctagttttttaaatttttgtgtagagacagggtctttctatgttgcccaggctggtcttgaactcttgggctcaagtgctcctccttccttgtcttcccaaagtgctgggattacaggcatgagccacctggcctagtttgtttcattttacatagcacttaaattgtaaatttttttttttttgacagagtcttgctctgttgcccaggctggaatacagtggcgggatcttggcttattgcaacctccacctcccaggtttgagcgatcctcctgcctcagcctcctgagtagctgggattaaagtgcccgccaccacgcctggctaattcttgtatttttagtagagatggggtttgatcgggctggtctcgaactcctgacttcaggtgatccacccgccttggcctcccaaagtgctgggattacaggtgtgagccactgtgcctggccagattgtaaattttatgagcctactgttggttggcagtagttgttcagtaaatattttttgaaagagttaataaatgaatgcatgtagttatggatgaagattacgtgaataaagactgaagcccagagaggttaaaaacttatgtgataatccaagacaataaataaagctatttgggaatgttctttattgtcccctgatggatgtgtggaattgttttactagggaggaggattcagcagaagctggataaacaattatagggtttttatgtggtgttgacatgtagaatagccaaggttaaattggccaattaaagctggagtaagatggctttaggaagtgttatatattaacagaatgagagaaataatcagaaataatttcttagtcccagtagccattaagtaggggaattttaatttttaagtgatggctccaggtcttcatgtgtataagattcttgcaggaaaattttttgatgttactagtaattttaaaggaatatgtgtaaaaggcttagggtagtgctcgctctacaactagatatttgacaatctaagcctagattataactgaaatataattgtgtaatcttgtccttacttctatcttatttttttgagacggtctcactctgtcacccaggctggagtgcagtggtgtgatctcggctcactgcaacctctgcctcccgggttcaagtgattctcccaagtagctgggactacaggcgcctgtcactacgcctggctaatttttgtatttttagtagaggtggtgtttcaccatgttggccaggctggtctctaactcctgacctcaaatgatccacccacctcagcctcccaaagggctgggattataggcttgaccactgtgcccgggctttactcttattttaaatgtcagtttgttaaggacagaaaaaaagactgaattttgctaatattttctacacttgatcttagccaaaaggccgagaagcgatgaattttgctaatattttctaacatgaaaaggaaataacgaagggaaagtcttttttttctttttaactttctgcagcagttgggcaaaattcctgctttgtgtaggaaaccctggcagaccttgagaattctaaattgctgcagattgttttatcttttttttctaaaacaatttgaatagcggatcctttccatctgaaacaagtttttccccttctcaccctcttgtttcatgtaattagcagtcctcctctgtatattcctattttgtctgatatagccaaaattctttaaaaagaattttaaaattttaaaattctgctgtgagtccggcaaaggggctgagagaatttctgtgtcaacatcattgagaactctgaaagcttctttacataccaagctcctcctcatcaaagctagatacaggaagtgtttatggtccctttcttccaagggaatggctctaaactaaccagcagaccctgtctcacttatgttctccttcaggttcttccttgacatcctactggctactcttagtcatgttctttctagccatcaagtctccaaactgcgtggccagacaacttgagttacctgggaagttcctaggggctagataagtactttatgccttattctacagcagaatatttgttttgtttacatgaccagctcagattgatagaatagctgtcttttagcaacagtgtaatcatttaatgacagctgttcaagggactagtaaaaggattgggaaaggggggccttctaaacaaagtgaatgggccctgccaactgaggagtgatgtctcctaaatggttggcatgttcagacttcagagtattatccatcagcttggagacccacaagttttttaaatatctagtgttatctgtttacctgttagcttggtgccaaagtgattgcaccttacctccagaccatgtctgtgcttgccctgatgtacctgtcatgttcagtacctgttttggtttatagggcttggactagctccgatgttcacttgccctgttttacttagagaaagtcatcatgtgactaaattttaagattacaaagataatgcatgtgatttagacttgagtgtgtaaaaggcttagggtagtgctcactctacaactagatatttgacaatctaagcctagattataactgaaatataattgtgtgatcttgtccttacttctatcttatttttttgaggcggtctcactctgtcacccaggctggagtgcagtggtgtgatctcggctcactgcaacctctgcctcccgggttcaagtgattctcccgagtatgggtggtgatggaccatttgtaaagcctcagaagccaaactggaattaatgtgaaagttatagggaagttagtttcagcttaatcaaagtagaatttccaaaaagtagagccatttgaaaatgtcctgtggctgggcgcggtggctcacgcctgtaataccagtactttgggaggccgaggtgggcggatcacgaggtcaagagattgagaccatcctggctaacacgatgaaaccatgtctctacttaaaaaaaaaagtcagctgggcatggtggcaggtacctgtagtcccagctacttgggaggctgaggcaggagaatgctgtgaacctgggaggcggagcttgcagtgacccgagattgcgccactgcactccagccggggtgacagtgcaagactcagtctcaaaaaaaaaaaaaaaaagtttttatcctccagatcgtagaattatattactagaggtggtgattcagcagaagctggataagcaataatagggattttgtgtaagtgttgacatatgggtagggtgggctaggtgatttgctaatagtgagatattttgattcaagtataaatttcagtagttgcagatgaacacagaaggaacaagcacagatttctgctgatggttagtaagacaacattgccaagggagggtgtccccagaagagcagaaaacctaatatgaaagctcaaatttaaaagatggaagcaggaagtaaactgctgaaggagaatgttcagaggaagaaaaccagagggtttagggtacaaaggctgagggtggagagtttgaaggaagaagaagaaattagagaaccataaagaaaatgatatattctaaagcggtagtcctcaaggtaaattgcatgtagctgtgccttgggatgcagtaggacttacatatatatatatgaatgaatatgcatatacattaagcttattattattattattattttgagacggagtctcgctctgtcacccagactggagtgcagtggcgtgatctcggctcactgcaagctccgcctcccaggttcacgccattctcctgccccagcctcctgagtagctgggaccacaggtgcccaccaccacgcctggctaatttttttgtatttttagtagaggtggggtttcaccatgttggcgaggatggtctcgaactgctgacctcgtgatctgcccgcctcggcctcccaaagtgctgggattacaggcttgagccactgcgcccggccaagcttatttttatatggatttcatgatgtatatattttgtaatatatataatttataagtaaatataaattagggaggtgtactcaacattttcatagaatacatagtcaaaaatggtttgcaacctctgctctaacaaaaataaaacaccctacatctttggttcaagattgtcacccccaacagttgtgtgaaatgtggggcaggaattatcactattttcctttggaaattaaggttccaaagataatgagaccagagccaaaggtcagagtccactgtcttctctctgaggcctcaatgtgaagacctgaactgtggcagcagataattctggagacctgttaatcagctgtatgcaccacgctacttaattgatttagaaatattgaaaaggccgggcatggtggctcatgcctgtaatcccagcactttgggaggccgaggcgggtggatcacctgaggtcaggagtttgagaccagcctcggtaacctggtgaaaccccgtctctattaaaaatacaaaaaaacttagccgggagtggtggtgggcgcctgtaatcccagctacttgggaggctgaggcaggagaatcacttgaacctgggaggcggaggttgcagtgagccgggattgcacctagtgcattccagcctgggcaacagagcgaggctgtttcaaaaaaataataatagaaatattgaaaaggcgtgggacaaagatagggtctcaagacccttactgtagtcaggggtgttaatacgttttagactgaaacctgtgaatgctcacaggtgcaaatgaaagtgacacagatactacaaaagtgctttcgtttgaccacaaagaaattctataggtctgggattctcaaagttttgacatgtcattttaagaatcttatacaaagtatagaccttttccccagaagtatgcatacacacacatactttggcatacagtttgagtgaatgtctcgttctgcagctgccctagagcatccagggacctcagctcatcatttgctaactttaccaaatgatgggttaaaattctcttccttggtaaaattctgcccacaccctatcttttgggcacttaattatacctaaaaatagcattgagaaaagcagctatttcatccacaattagagaatattcttgagtccagcatcaaagccattatggtgctttgatcaataagtttgttctccacggaagtgaggcttaatggcttaggtgaccgactaactttctccttagttgctctagaagtcacctgtgaatgagccctttcaaagggaatgattttgacttctgaaaacttaagcagattagaagccttgagtataggatttagaataagaagtactcagtagtaaccctggttgtctaactacacaggcttgtatgatttgaacttttgttgttgttgctcttctggtttccttaaacaccagacagatccgattacaattctaaatatttagttctgtgcaaacaggaacagctcaacagttcaccttcactgagtaacgtatgtctatttagataagcaaactactgttgcaaaaaccctggcaaaatgtcaggatgagcaggggaaactttcattatcttttcagccatccgaacagttccccaagaatcggacatttttgagacttaactagtcaaggttaaattactcattgttcagtgagtaaattctgtctaaagacttagctggggtcgtctttattttatttttttcattcttctttttttttggaggttacttcaacaaataaagttttatttttatttaggctttccttgtattttagggaagagaaaatatttgctttatgttcttaaagtgagtttaaaaaaaaaatggtacatttaaagatagtttggggacgggcatggtgactcatgcctgtaatcccagcactttgggaggctgaggcgggcggatcaccttaggtcaagagttcgagaccagcctggccaacatggcgaaacccgatctctactaaaaatacaaaaattagccaggcatggtggcgcatccttgtggtcccagctacttgggaggctgaggcaggagaattgtttgacccaggagacggaggttgcagtgagctgagatggcaccactgcactccagcctgggcgacagagtgagaatcctatctcaaaataaaatacaatttggggtttcttaatgcctatactcctttgtttaactatagggcttctagttctttaaagatgattagtgattgtacaaaaggtataatataataattataacagcctcttacttttcatatccattaaacttttttttttttttgagacagagtctggctctgtcacccaggctgcagtgcagtggtgcaatctcgtctcactgcaacctctccctccccggttcaagcgattctcatgcctcagcctcccaagtagctgggattataggcatgtgccaccacacctggctaattctttgttgttttttgtttgtttgtttgtttttagtagagatagggtttcattatgttggccaggctgatctcgaactcctcacctcaggtgatccgcctgccttggcttcccaaagtgctgggattacaggtgtgagccaccgcgcccggtttaagccaccgtgcccggtcttaaactttcaagtagacaggacacactggctacttgtgtgcccccagatgtatagaattatgttactagggatggggatgctacagaagctggataagcaattgtagggattttgcgtgggaataaaagtgtggaatggctaaggttaaactggccagtttaagaaaactgaagagcaagatggctttagtaagtggtatagatgaatagaatcagaaaaataatagaaacagtttctattagtgtagttcccaataggcattaagtaggagaattctaactttaagctatagcaatggctctaagtcttcatgtgtacaaagttcttggaagtaaaagtgaaaggggtgggcgtagaatgagcctcattcctaaccagaacactcatcactgaccacctatacttgttttgtaacagagtgaagcgatctttaatgcaattttgatattctttccatccactcttgcattttgttctttgaggtgtgagagaagtgtgtatctgtccgttccttaatgtacagtgccttgaatggttgacggtgtggaactttaaagatctttgtgtaaatttaccttctgatttcttttaccccctgttcctcagcctacatggagaactttcactgtaattggagagtaggaatagttatctctgtgtacaaatgagacccaattcttacattttccattgtggctgtaggaaattttattttattttgagacattcttgctctgttgcccaggctggagtgcggtggtgcgatctcggcacactgcaacctctgcttcccaggttcaagcaattctcctgcctcagcctcccgagtagctgggattacaggcgtgtgccaccatgccaggctaatattttatatttttagtagagacgaggtttcaccatgttggccagactggtctcgaactcctgacctcaagtgatctgcctgcctcggcctcccaaagtgctgggattacggatgtgactcgccgcaccaggccagaaattttaaattttgaaatggtgtgccccttctcttacttggttctcttcataaaatccctccaacttcaaaagggatggaaataattaatggaagcaaataagatattgattaaaaggatatttatttttagtaatatttcttttgggttacttccttgccccattttaagattacagtatctgatcttaggatttgaactgttccatctgctttcctccattacagtgctctcctgctttttcatatttggcttgcttaactatcagaattttgattctttcatttcttaaattccatcgtctgaagtaaagctatactaatttggagtatctgaaggagtagagggaaggccactctgaactagcataagatcttaaatacagagcatttttcaaggaatgttatattatcatttgtactgataaattaaagactagaaccacaatatattacctagtattggtccttaaggaatttgcaattacctgagccttggttttgcatgtaaatagatgcttctaagtgcttgagtctactttgaaagagttcttaatagtttaaccagtaacacttagtcttggttatactcttatttagtaaacattttattttttttctccatagatggggtaaaggtaaatttagctcagctgtatgaactattacattaaagttttttagagcaatttttatagcttttctctatatacatttgcatttacattacctgtatgtactatacatacaaattgatatgtacatgctgatgtattaaaatccctgagcaaactacatatttgtggacaatttgagcaaataatcttttgagtataaacttagactaagctttctgagtacaggaatcacatactttgacattcttctacttgcttccaaagtaaacatatttgccaaaaactttgcccaggtacccacattgtagtgggggcagccttttactgggagcaagctccaagttccttttttttttttttttttgagatgcagtttgctctcttgcccaggctggagtgcagtggtgtgatcttggctcactgcaacctctgcctcctgggttcaagtgattctcctgcctcagttttctgagcagctgggatttacaggcatctgccaccaagccctgctaatttttgtatttttagtagagatgggtttcaccatgttggccaggctggtctcgaactcctgatctcgaagtgatcctcccacctcggcctcccaaagtgctgggattacagatgtgagccaccgtgcccggcctccagttcttttctgtttggtttgtgagtgagtgagaatggagtgtgtgtaaagggggactgggaggctgggaggttgacctttgtgcagtctacctacttgtgaatgggaatgtgattccatgcctattgctgattctcaagcctgcctcggtaccacagtagttcacagcaagggctttggagtcagccctgtatttgaacctcagctctctgattttccagctggggatctatgttgggcaaatcaagttaatctgcttaaacttcagtttcctcacctagaaaatgaaggtcataattgcagcctcactagggtatctgtgatctaggagggatttttgatagtggtaaacagtagattcctgccttactaatgtgtaggtcagtttatcatctacctagcaccatcacttttttcaaaaaaggtcttttcaaccaagaatatgtcatacatatctgtattttctgactagattgcaggttcttggtccttgtcttacttgttttcgtaactggcttatagaacttgatactcagcacatgttaattgaatgactagatgatgcatggtctcctttgagcctaccatagcatttggatttaccatcattatgtttacttatgtgcgttgagaaacttatgtgatataaggtttgctttaaactatgaggtcttaaatatttcccatggtcagagtagattattgatctagtttggctagacatgttccctaacttccttaggattgctgttagacttcctgaagctgaatttttgtgggaagaagattaagacttttgtgacttaggagaggtaagttttccctagttgtatactagcaggggctaacttacctgatttcaccctttaattggtcaaaagttttggattgcagcaacttctgtataactttttccaaagagaattctattatctgataattttggaatgttttttgttttgtctgttgccttttgcttatagtggattgtttcctcctattgtttgtgattgtggcttgtgagtaggttttttgttgtttctctctcccaagaagagctttacctgtggaatcctgtatggctttggttgaggatgtattctttgttgttaatttcttgacttaaaggtttcaggacgaccaaggtagtaaaaatttaagcttcaaacctacgtaaggtgtaggtctgtcattaaaaattttcagggtatacttttccttccttccttcccagagcctcagcagaggcaggtaagtgtccttagcagctcacctggcttggtgggcagattctttgtggtctactcttttcctaaaggggcatccctttggaggttctggctttatgtcaaaatcttttttctgtgtgtgtgtgagtgtgacagagtcttactctgtcacccaggctggagtacagtggtatcatcttggttcactgcaacctctgcctcccgggttcaagtgattttcctgcctcagcctcgtgagtagctgggattacaggcacatgccaccacgccgagctaatttttgtatttttagtagagacggggtttcaccatgttggccaggctggtcttgaacccctgacctcaagtgatccacccgccttgggctcccaaagtgctgggattacaggcgtgagctaccgcacccggctcaaaatcttaacttctactccttacttgatatgagttgtgaagttgcagacatataatttattctagttagtttaagcaggagaggtttaccataaagcattaaacaccaacaaaattgccggaagggctgaagaaatagatttcaagtttgttcattcaatcagatatttattgagcatctaccatatgtttagtactatttttgggttcttggggaacacattagtgaacaaaacagacaaagctcactttccttgaggaacttacgttctagagggttttgtctttaggaacaattctcaaagccacacacaaaactggccaacaaaatagctgccagttggggttttaaaaaccaacccagaaccacatgaccactgccatggttaggaaaccacactgatcaggaagcctccactaaagctgtcggctccagaatcatgctcatctgcttttgatccacagtaaatacccaggccttgcctctgatacccgtgacactagttactagacactgtacactcaactaatgatgctgcagaacaatcaaatgccttggcctatgcctgtttgcaaagtagcagaactaggtcttcagtttctctttccaaatccatgttagtgcatatgattggtggaacctaattacatcaggagccctagctggaagaggctcttgagccttcatggtacagagcagacgacctacaaagaaaggagaatattcaatgccaatcgaccaaatgttcctttcttcttcatgttggtttttaaaaccctatcccctatattatgggtgtagatctctattttgccatcccagctcaggaaaggggctgcccacatgcgtttggtttttagttctctctgcttttctggctcctggggttttcttcttcttattcttcctcctccccctcttcctcctcctccccctcttcctcctcctccccctcttcctcctccttcctcttcctcctccttttttctctccagacagagtctagctctgtcacctgggctggagtgcagtggcatgatcatggcttaccacaacctctgcctcccaggttcaagtgattctcctgcctcagcctcccaagcagctgggactacaggcatgtgccactatgcccagctaatttttgtatttttagtggtgatagggttttgccatgttggccaggccggttttgaactcctgacctcaagtgatccacctgccttggcctcccaacgtgctgggattacaggtgtgagccacacctgtcctttctctttcttgctaactcagctttgcctttaaaataatatttgttctattatatgtagagtttttgggggaaagttttcaggttatgtagataatttcagaattagatgcccctagtttacaagtactaatttaataaaccatgttagcttattaaaaatgtgttacgtctggtgggggtgggggttggagaaagatggtaggcattccattgatttaaagtttttttttttgagatggagtttcactcttgttgcccaggctggagtgcagtggcgtgatctcggctcaccacaacctccgcctcagcctcccgagtagccgggagtacaggcatgcaccactccccccagctaattttgtatttttagtagagatggggtttctccatgttggttaagctggtctcaaactcccgacctcaggtgatctgcctgcctgggcctcccaaagtgctgggatcacaggcatgagccaccgtgcctggcctcatagtttggagtttttaaggaattggtccattttatcaaagttgtccaatttgtgtgtatagaattatcgtattatcctactatccttttattatctgtgaggtctgtaatggtattcccctcttttttattcctgatgttgtaatttatattatgtctttcttttttgttagtctttctagaggtttatcaattttattgatcttttcaaagaatgaaggtttggtttcatttttttttttctattgtttttctgctttcagtagttacaacagcagtgcctctacctttttatttggccatccctcttgtatccctatattctgccatcttttttttccactttttattatcaaggccttttcttcatcaaggctgatgaaatttcatactgtttataactgcaattaagacttctttgggccaggtgcaacagctcacgcctgtaatcccagcaccttgggaggctgaggccaaaagattgcttaaggccaggagttcaagaccagcctgggcaacatagggagaccttgtctctacaaataatttaaaaatcagttgggcatggtggcgcatgcctgtagtcctagtactcgggaggccgaggtgggaggttgaagctcagtaagctgtgattgccctactatattccagcctgggaaacagagcaagaccctgattcaaaaacaaaacaaaaaactttgatttgtgaataggttgaatctaaaagttaatttatttgcattatcataattacataaaaattgttcacttcatatcctagtagtatacctttctttccttgtacagcatttattttctcatggcctttcttccacgagatatttgcctttgttatgtcctcaattattttcaagctctccattgtataattcattctcttattctattcactcacatctccaacctcctcctagagcacattgtttctccaaactgggctgactgctctctagagctgacatcctgtgacttcccattactgctttcctagattatttcctggatcccatatcctctcctttctagacatactccctgattttgatgaaacatgtcagtaaggactgtcctaaagaaggtgaagagaaaggatactttctgagtcctttcatttagctctacatttgatgagagttgggatgagaatggaattctagattgaagagaattttccctgagaattcttatggattgcttcattgtctgcaagcatccagtcttaataatgaggaggccagttttatcctaattcttgatccactgcaggtgactgatttctctggaagcttttcagaatcttagtattttgaaagattggaaataggtcttttacaacttgctgttcgggccattgataggccattttagtttgaagatgcatgttctttccaaatattattttgatagttttctcctgttttctgttttctctttctggatattgaatatgtataaaagtttgcttcgaattctgaagaataaatataatgggaagacagatgtgaggtctagattcttggttttaatatttatgtagcatttgtctaaaatgtggaagtcacatgctgtagaccaactaagtttgtaaaatatttgtaaaatatttataaagtataatttatataaaaagcagttaagaaaaagacccaaataatataaagttaccattataaggtcccatatgaagctgtccttcaattaagaacaaaaatcaatgtacaggataaagctacaatattaagcaagaaagatacattttaattttgtttgcagtcccattagatttctaatatgattttatagctcatttcctccccttttacaaatggctttgtatcataatctgtagcaactctaaacattgcaagagtaaaagaatatactgacattacttcatggtttagaacaaacaccttgagaataaaaagtcatgtttaacatgacttgcactgaactagatacacaccatatttatggctttatgtcagtgttcaagtgtttttgttttttttttctgtttcttgatggctctgattaagttagagttaacaaactctcttctgatgccacattagtgggcatttattttctggcttgtaaaagcaggattagtcccttagactgaagccacacttgtgtttttcttactcataatgcaaataatgacttcaggcagtggtgtgggtgttcagcgaatgcatacttctatttgcagagcagttttacctgtatctacagcagggaagcccctctgggctttatttagtaggtgacagaggaaattagaatggcctggctaagcacatcaatatgcataattgacaggctattcaatactgttaaagataagtactttccattctttaactatcaaatgcagctcaaatgtattctagattgtattattttctgagtattttgttacagatccttcacgtatatatgcgaacttaaagtaaacaaatctaaggaactagaaaaacacaggcttgtctctgggcaaggtctttaaaattatcaatgtgattataatgaatgaataacatatagcccttcgaagggataaggtaaacaccaagattggaaaggcagacataaaactttattcacaggtgacacgatcttctatatagaaaatgctgaggaatcgactacaaaactattaggtttaggccggcagggtgactcacgcctgtaatcccagctctttgggaggcaaagccagttggattgcttgagaaccaggagtttgagaccactctggccaacatggtgaaaccctgtctctactaaaagacaaacaaaaaaacctattagcattaataaatgagttcagcagggttgcagggtacaagagcaatattaaaaaatcacttatttctttttgtttgttttttgagacagggtcttattctgttgcccaggctagagtgcagtggcgcaatccgggctcactacagcctctgcttcctgggttcaagtgattcttgtgcctcagcctcccgagtagctgggattacaggcaaaaaaatcgcttatatttcttttttcttttttttttttgagacggagtcttgctctgtctcccaggcttgagtgtagtggcgcgatcttggctcactgcaagctccgcctcctgggttcacgccattctcccgcctcagcctcccgagtagctgggactacaggtgcccgtcaccctgcccggctaattttttttttttttttttgtatttttagtagagatggggtttcaccaggttagccaggatggtctcgatctcctgaccttgtgatctgcccgcctcagcctcccaaagtgctgtgattacaggcgtgagccactgcacccggccaaaaattgcttatatttctatacacttggatctgataatgaaattaagaaaagagttttatttacaataaaatacttaggaataatttaattaaaaatttcaaaacttgtgttctacaaactaaaacattaaaagaaattaaagactcaaatggaaagctgtgtttgtcgactcatggattcatgaattagaggactatttttaaaatggcaatgcttatcagatctacctatttaatacaatccttatcaaaatccaggctgcccttccccccccacctctccgcaccagaggttggcatattgatcccaaaattcatgtggaaattcaagggacacagaatagctaaaaacagtcttgaaaaaactttcaaaatttactgttggccaataagcacatgtaaagattcttatcactaatcactagggaaatgcaaattaaaactttaataagatgttacctcagacccattctgatgactactgtcaaaaaaacagaacataagaagtgttggcaaagatgtggggaaattggaacccttgtgcactgttagtggtagtttaaaatggaatagctgggcatggtggctcatgcctgtaatcccagcagtttgggaggtcaaggcagatggatcacctgaggtcaggagttccagaccagcctggccaatgttgtgaaactccatctctactaaaaatacaaaaattagttgggtgtggtggcaggcacctataataccagctacttgggaggctgaggcaggagactcgcttgaacctggggagtggaggttgcagtgagccgatatcatgccgttgcactccagcgtgtgtgacaagagcgaaactccgtctcaaaaacaaataaataaataaataaataaataaataaataaataaataaaatggaatagctgctatagaaaactgtgtggcatctcctcaaaaagttaaaaatagaattaccgtatgatccagcaattccaattctgagtatatgccaaaaatagagcagtgtcttgaagagatatttgtacacccctttgatttttttgtgtgtgttttattttattttattttttattttttttgagacacgatctcaccgtgtcactcaggatggagtgcagtggtgcaatctcggctcactacagcctcggcctcctgggttcaagcaattcttgtgcctttccctcccaagtagctgggattacaggtgcgtgccaccacacctggctcatttttagtagagtaagggtttcaccatattggccaggctgttctcgaactcctgacctcaaatgatccactgacttggcctcccaaagtgctgggattacaggtatgtactaccatgcccagctaatttttgtattttagtagagatggggttttgccatgttggccagtctggtcttgaactcctgacctcaagtgatctgccctccttggcttcccagagtgctgggattgcaggcatgagccactgtacctggcctgtacaccatgtttataatagtattattcacagttgctaaaacatagaagccaaccaactgtccatcagtggatgaatgggtaagcaaaatgtggtatttaccaacaatggaatatgttctgttttaggaaggaagaaattctgacatatgctacaacatggatggaccttgaagatagtatactaagtgaaataagccggtcacaaaaagacaattactatatgattctacttatatgaagaacttagattagtcaaaattatagagatagaaagtattagggtggttgtcaggggctgtggagaggggaatatgggaaattgttgaatgcattttagttttgcaggattaaaagaggtgtggagatgggtgttggtgatggttgtacaacagtgtgaatgtactcagtgccactgaactgtacagttaaaaaaatggttaaaatggtaaatcttatgtatgttttactgcaatacaaaaaattgggggaaaaaatcttattacacagctacagtaatgaagactctgtgttagtggccaaaggataagcatagatcaatggaatagaattgagactagaaataaaccctaatatttatggtcaattgatgtctgccccatcccagccccacaaggatgccagatgagtcaatggaggaaagaaaagagcttatctatttgtagactattcattctcatagtcttttcaacaaaacagtgtgctgagacaattggatatccacatgcaaaagaatggaaatagaccccttccttatatcctacacaaaaatgaactaaaaatatatcagagacctaaatgtacgaactaaagctataaaacaggccaggtgcgctggctcatacctgtaattccagcactttgggaggctgaggtgggtggatcatttgaggtcaggagttcgagaccagcctagccaaaatggtgaaaccccctgtatactaaaaatacaaaaatagccaggtgcatgcctgtaatcccagctacttgggaggctgagacacaggagaatcacttgaatcgggaggcagaggttgcagtgagccgaggtcctgccactgcgccccagcctgggtgatcagagcaagactttctcccaaataaataaataaataataaaactataaaacacctagaagaaaacaggaataaaccttcatgactttggattaggtaaagctttcttagatatgacaccaaaagcaaaagcaaccacagaagaaaattgatgaattggacatcacagttaaaaatttctgctcctaaaggataccatcaaggaagtgaaaagaacccacagaatatgagaatatttttgcagattatatctgataagggactgtaagagttctttattctggatacaacttaatagtaaaaagacaatccaatttaaaaatgggcaaaggatcttaatagacatttctctaacaaggatgtacaaatgaacaataagcacgtgaaaagatgggaaatacaaatcaaaactacaagacagcactttgtactcactaggacggctataatagaaaaagataacaagcctgggctggcgaggatgtggctgacaagactggaatctttttttttttttttttgagacagagtttcgcttttgtcgcccaggctggagtgcaatggcgtgatcttggcccactgcagcctccacctcctgggttcgagtgattctcctgcctcagtctcctgagtagctgggattacaggcatgcgccaccacacccggctaattttgtatttttagtagagagggggtttctccatgttggtcagacttgtttcgaactcccagcctcaggtgatccacttgcctcagcctcccaaagtgcagggattacaggcgtgagccactgcgcctggctggttggaatccttatacattggtggaggtaatgtggaatggtctaactgctctgaaatagtttggcagttactccaaatgctaaacatagatttaccatatgaccctgcaattctgctactaggtatatgctcaagagaaagaaaaacatatattcacataaaaacttgtacgcagttgttcatagcggcattatttataatacttaaaaagtggaaacaacccaaatgttcatcatttggtaaatgggtaaataaatgtggtgtatccatgctatggactattattcagccataaaaaggaatgaagtatgcatacatgctataacatgtgtgaatctttttttttttttttaataggagtctcactctgttgcccaggctggagtgcagtggcatggtctcagctcactgcaacctccgcctcctgggtccaagcgattctcatggcctcagcctcctgagtagctgggattacacgcacgagccaccatacctggataatttttgtggttttagtagagacagggtttcaccatgttggccaagctggtcgccaacctctgacctcaggtaatccgcctgcctcagcttcccaaagtactgggattacaggcataagctaccacacctagccctccttctagtacttttttaagtgaacttttaaattataacgtgtatacagaaaagtatgcaaaaagttactagtatatagcttgatgggttttcccatccatgtagaattatgcatgtcatgaaataaactgggtgcgttggctcatgcctgtaatcctagcactttgggaggctgagccaagcagatcacttgaggtcagaagtttgagaccagcctggctaacatggtgaaaccctgtctctactaaaaatacaaaaattagccggaaatcacttaaacccaggatgctgtggttgcattgagccaagatcgcgccactgcactccagcctgggcaccagagcgagactctatcttttttttaaaacactattctctcctagttactgtatccccccgggtaaccactgtcctgacattaacatcaatttttcctgtttttatactttatataaatgaaaacatacaaggtgtattcttctgatatgatttcttttacacagcattatatttgtgagttgtattgtagactgtgcattctcattgctgagtagtactccattgcatgaattttttttttttttttttttttttttgagatggagtcttgctctgtctccaggctggagtgcagtggcgcaatctcggctcactgcaacctctgcccccacccccgccccgggttcaagcgattctcctacctcagcctcccaagtagctggaattacaggcacctgccaccaagcctggctaatttttttgtatttagtagcaatggggtttcaccatgttggccaggttggtctcgaactcccgacctcaggtgatctgcccgcctcagcctccctaagtgctggattacaggcgtgagccaccatgctcagcctcattgcgtgattataccacactttattctttctatttttgaacatttaggtagttttcttgtttttagctattatgaatagtgttgctatgaatattctcgaacatgtcttttggtggacatctgtgtgcatttctgataagtgtgtgccaggaagtggaattgctggatcataaggcagtgcttctcaaactgtattgtgcacatcagtttcctgggaatcttgttaaaaggtagattctgcttcagtagttcaagggtagagcctgagagtctgcatttgtcaggagccagttggactggctgtggaccacactttgagtataccaaggccataggatatgcttgtgtttggttttagtaaagaatgccaaatggttttccaaagttactgtctcagtttacatctccaacagcagtgcatgagattcctttgtttaggtgtgtgtgagtctgtttcgctcaaacttttacatatcttcttctagatcgtctcagcttttcttggaccttttgtgttttcacataaattttataattggtatcagtttccacatacaacctgctggatttttgatttggattgtattgaatctgtagatcaacttgagaaagaactagtgtttcaacatccaaattcctgaacatggcttatagccctccattattgaatggtctttaatttctttttttttcccccctccaggttaaagtgattctccttcctcagcctcccgagtagctgggattatgggcatgcgccaccacacccagctaatttttttgtatttttagtagagacggggtttttccctgttggccaggctggtctcgaactcatgacctcaagtgatccacccacctcggctcccaaagtgataggattacagacctgagccactgtgtctggcctaatttctttcagtaatatttctagttttctgtatagagattttatttgctagttcattcttaagtatatgattcgttgatactattgtcaatgatttcattctaaaatttctatttaataattgttggctgctggtatatagaagtacagttggccaggtgcggtgtctcacacctgtaatcccagcactttgggaggccaaggtgggtggatcacctgaggtcaggagtacaagaccagcctggccaacatggtgaaaccccgtctctgctaaaaatacaaaaattagccaagcatggtggtgcacacctgtaatcacagctacataggaggctgaggcaggagaactgcttgaacctgggaggcagagattgcagtgagctgagaccgcaccactgcactccaacctgggcaacaagagcgaaactccgtctctcaaaaaaaaaattgatttttgtatgttaacctttaatggaacaatattggtaaattcacttaccatttttcattgtatatattactttatttttttgagacagggtctcatttgttcacccaggctggagtgcagtggcatgatcatagctcactgcagccttgatctcctagtctccaacagtcctcttgcctcagcctcccaagtagctgggaccacaggcacataccaccatgcccagctaatttttgtatgttttgtagagacagggttttaccatattgcccaggctggtctcaaacccctgggctcaagctcatggttatatatagattctcttggattttctttgtgaatgtaatcgtgtcatatgcaaatcatgacagtttaatatatttcctttccgaggttatttctttctctttctggaatgtactgtttgggacctgcagttgaataggagtgatagtgatatccttgtcttatttcccattgcagggggaaagctttcagtatttcaccattaactgtgatgtttgctttagatttattttcttttttcttttttttttttgagatggagtctggctttgtcatccaggctggagcacagtgtctggatcttggctcactgcaacctctgccttgggggttcaagcaattctcctgcttcagcctcccaagtagctgggattataggcacctgctgccacgcccagctaatttttgtattattggtagagactgggtttcaccatgttggccaggctggtcttgaatccggacctcaagtgatccacccgcctcagcctcccaaagtgctgggattacaggtgtgaaccaccactcctggcctgctttagattttgtatagctccccttcatcagattgaaaaaggccttatattcctaaatttgctaaaagatggttttggttttttggttttaaaatcatggccagatactgaattttgtcaaatgctggttcttcttttacttagggtctcactctgtcacccaggctggagtgcaatggtgcgatctcagcttaccgcagccttgacccctctagctcaagcggtcctcctaccacagcctcctgagtagctgggattacaggtgcacaccatcatacccagataattttatttatttattcatttatagtgatggggtctcgctatgttgcccaggctggtctgaaattcctggcctcaagcgatccttctgcctcagctgctgaagcactggtattaaaggtgtgagcctccacccctggcccatttatatgattttaatttttgaggccttaagttctataacccaataaatttctatcaggggaacccacccccagtatttcaacgtaggttctttctattttccctaagtgtcggctgatctgagaaatagagtacaaatagaggaattttacagctgggcctctggaggtgacatcacatatcggtaggaccgtgatgcccacctgaactgcaaaaccagcaggctttcattaaggacttcaaaagcagggagggcctgtacgaacagggagtaggtcacaaagatcacatgcttcaaagggcaaacaagagaacaaagatcacatgattttgaggaaacaggaccagggcaaaatcaaactcctgataagggtctatgttcagtggtacacatgttgtcttgagaaacatcttaacagaaaacagggctccagagcagagaaccggtctgacctcagatttaccagggtggggtttctttcccaccctaataatcctgagggtactgcaggagaccagggtgtatgtcagtccttatctcaaccacgtaagacagacactcccagagcggccatttatagacctccccccaggaatgcattcctttcccagggtcttaattattaatattccttcctaggaaaataattcgcgatatcttccctacttgcacatccgtttataggctctctgcaagaagaaaaatatggctctattctgcctgaccccgcaggcagtcagaccttatggttgtcttcccttgttccctgaaaatcactgttattctgttctttttcaaggtgcactgatttcatattgttcaaactcacttgttttacaatcagtttgtacagttagatacaattatcacagtggtcctgaggtgacgtacatcctcagcttatgaagataacaggattaagagattaaaataagacaggcgttaagaaattataaaagtattaatttggggaactgatatatgtccgtattaaaatgaaatcttcacaatttctgttcctctgccgcggctccagccggtccctccgttcggggtccctgacttcccacaacaatttctcttcactaaaataatcacatttttgctctatgtctctgaaattgctcctaaatcccactgagtagagtttgtgttctggatctcttcagtcacatatttacaatatcttgtgttagattgctggaggatttttttttttttaaaccagtttccatgtttgattctagagagaaacctttatttatcttagcttcaaattactattgggcagggggctgtacctcactgtcactcaggatcaactgtgtaatttgtaggacccagggcaagatgaaaatgtgaaatactttcctcaaacattaagaatttcaaaacagtggcaaagctttataccaagtgcaggcccttccaaacatggggcttgtgtgatggcatgtgttgtatacttgagaagccacccttgctgtcaccactgtgtatagactagctttggattagaaatactctgtcagaaattaaatgagtttcaagtgtttaacttttggccggggtggtgcctcacacttgtgatcccagcactttgggaggccaaggcaggaggatcacttgaggtcaggaatttgagaccatcctggccaacatggcaaaactgtatctctaccaaaaatacaaaaattagccgggcgtggtggcacatgcctgtagtcctagctaccagggagactgaagcaggagaatcatttgaaccggggaggcggaggctgctgtgagccgagatcaagccacttcactccagcctgggtgacagagcgagaccctgtctcaaaaaaaaaaaaaaaaaaaacccaaatgctcatactgtacttctacaaatatggactctgaaatgcacattcccaagcatttgtaaaacaagatttttcgagttcccatttataattgtagtatagtttataatatgagctaaatgcctgtcagtttagacaacctgatatactcaactgtgggacactttgagagttcttaaaaatacagctaatggccagacacggtggcccacacctgtaatcccagcactttgggaggccgaggcaggcggatgacctgaggtcaggagtttgagaccagcctgaccaacatggagaaaccctgtctctactaaaaatacaaaagtagccaggtgtggtggcgcatgcctgttatcccagctacttgggaggctgaggcaggagaagcacttgaaccaggaggcggaggttgtgctgggccaagatcacaccattgcattccagcctgggcaacaagattgaaactccgtctcaaaaaaaacggaaaacacaactaacttatacaaattattctctgtaagagaaatttcttgttggtttatgacatttgagttaactaaaaaattgggattgaaccagaaaaattttgctcaataactagattttaggctgggtatgatggctgacgcctttagtcacagcactttgggaagccaaggtgggaatatcgcttgagcctgggaatttgagaccagcctgggcaacaccgtgagacacttgtctacaaaatttttaaaaattagctgagcatgatggtgtgttcctatagtctcaggtccttggaaggctgaggcaggaggatcgcttgagcccaggaggtgggaggctgcagtgagccatgatcataccactacattctagcctgagtctccaaaaaaaaaaaaaaaaaaaaaaaagtatattgggagaatggagaaccagagggtgggagatattgaaaatcatctgtagtgagttgaagtccatagacagtgtctaaatgagatatatccagaaaaagtagtaatcaagagctgttgactgtttggaagattaccttgtttattgctgttcctcttaaggtatttatattagtacagcacacctgcatcagactggatttgtggctgtcacatgcaaatggaggaaatttaagactttttttttttttcacaattagagacaaaaattgcgaagaacgtattaaacttcactaatacagattattttattaaaatatcatgtcaaataatggtagaaacatttagagagatggaaataattacaaaagactgctaaaagaagttggaacaagttgggggatgtttaattatatatgcatatttgatttagaacaatttaaaacatttcaataacgtaatatagaaacatgttcatatacaagaggaaaatgtacattgcaaaatagtatatataatatgaccatcttttttttttttatttttttcccctggagacagagtttcaccctgttacccagactggagtgcagtggtgcaatcatggcgcactacagcctggacctcctggggtcaggtgatcctcccacgtcagcctcccagatagctgggactacaggcatgtgccaccatgcccggctaattttttgtagagatggggtttcgccatgttgcccaggctggtgttgaactcatgggctcaagcaatccacctgccttggcttctcaaagtgctgggattataggcatgagccactgtacctggcctcatttttgtttctaaaaagaaatgaaatgaaaaattttggacagataaacactgaaatgttaaagggtagtgggatttaacatgatttttattttcttttttgagacagtctccctttttcgcccaggctggagtgcagtggtgtgatattggctcactgtaacctttgcctcctgggttcaagcgattctcctgcctcagcgtccggagtagctgggattataggcgcccgccaccatgcccagctaatttttgtatttttagtagagacagggtttcaccatgttggccagcctggtcttgaaatcctgaccacaggtgatccactccccccagcctcccagggtgctgggattacaggcgtaagctaccgtgcctggccgtgatatttatattcttatgttttatattactttttcgttttttcagagcaattaccctgtattactttctcataatcagagggaaaaaatttcattttgaaaaaagtagtaattgtgacataactttaagcagggactatatatctttttatttcaaacatccaccacaatgcgtagcatgtggaagatgtaaatatctgcacatactgaggaaaggtgtgtgtcagtgagttgcttctttgcttaataaaagcattccggccgggcacagtggctcatgcctgtaatctcaacactttaggaggctgaggcaggcagatcacgagggcaggagttcgagaccagcttgaccaacatgatgaaaccctgtctctactaaaaatacaaaaattagccaggtgtggtggtgcgtgcctgtaatcccagctactcaggaggctgaggcaggagaatcatttgaacccaggaggcagaggttgcagtaagctgagattgtgccactgcattccagcctgggcaacagagcaagactccatctcaaaaaataaaagcattccatggccattggcaaagcaaaataagctatctaagaaacagtgtattataaaaaatgcttcaagaattaaatgaaaagcttaggaattatgattgtcagagagaagtgagaaaagaaaatgcaaaaagcaactggtaactgttatttagttttcttttgcataagtaatacttgcactgtgtgtgtgtgtgtgtgtgtgtgtgtgtgtgtgtgtgtatgtataattttttttttttgagatggagtttcactcttgttgcccaggctgcagtgtagtggcgtgatcttggctcactgcaacctctgcctcccaggttcgttcaagcgattcttctgcctcaacctcccaaatagctgggactacaggcacgcgccaccatgcccagctaatttttgtatttttagtagagacggggtttcaccatgttggccaagctggtcttgaactcctgacctcgtgatctgcccacctcggcctcccaaagtgctgagattacaagtgtgagccaccatgcccagcctaatgtatacaatttttaaagcacagagaagtatatagtgaaaattcttccccttgctatcagatcagcacactcttcagaggcagccattgttattcttgtatatccttccagaaatacaggatattaacagtacaacaaagaatttcattgtttacacatcattttatgcttatgtaagtttccctgtaggataaattcctagaagtagaattgctgaatcaagggatacctgcatttgcaatttttgtagatttggccaaattgccctccaatgaaattatattagttaacacccccaccaccaatgtaggagagattttatgtaatttcctaggtatcattgataatgtttaagaatttcttattgccaggctgggcatggtggctcgcgcctgtaatcccagcactttgggaggccgaggccggcagaccacctgaggtcaggagttcaagaccagcctggcctacatggtgaaatcctgattctactaaaaatacaaaaaaattatccaggcgtggtggtgggtgcctgtaatcccagctacttgggaggctgaggcaggagaattgcttgaacctgggaggcgaaggttgcagtgagccgagattgcaccactgcactccagcctgggaaacagagcaagacttttttttttttttttttttttaaagacaaattcttattgcctatatgagtgatctaatccttgacaaatgagttttcattttcagtatatagtttggtgaataaactcttctctacaacaacagtctgtaccacactggctagagttatagtgaaatatggttaagtactgaaccctttcttagaccctatcagatccaaagatactgaacattctccagtgctatcaaatctttggagagaaagtttaccatagcctttccttccttctctttccttttcctatcttgcttcaaacatagaaagaagtaccatatgaaataagtaagcctttttaggcagttttttcattccttagctgagagtagaagagtgtgctgcaaaagaccttcataaaattgaataggtaacatagcaaaataagctacagtgtggatcttggaatcagacagacttgaattctggttctgtgtgcctcttagctgtataatctttgatatttaatatttataaaatgaggataataattcatagggccctattctacaaaaggacactgtttttgtcaaatccagacaccttcaaagtaaggataaaaacccagggaatgttagttcctttttaagtctgttttgtgatttataaaatgggataaatagtctcttcttcacgagttcttggaataattaagatatacaaacacattggcacgcagagcaccctcagtaattgtgaattattttttactgttactgcagtcatttgatgtctgttgaaggaattatagcctgcatggacttactgtgcactggaaggaagggaaatctgctacctggtgggttaaagcattttgctttaaaaggtcgttagtagaaggcaggctgagtgctgggtgcgctcaggtgtgactgactgcaggacaccaagaagaaatggggtttgaagtaacagctccctttatccaagccgaaaactgtgacgcaaacagtgctttctaaatcgctgtgaatggaacaacctattagggaaagtttccatctggagtactggtaatgaactcaaatgagagtaaactgctggaaaattgcaagagcaatggaaaataaaaagggtgcctagattgaatgagttaaggttgtattatactttagttcagaaacaagttatggtgactggaaaaagtttaagtaattaattctagagtaaactgtgttagattaaatttattggagggacagctcaaattctgtattaaatctgtgtaattctagatctagggtcaagatttagatgagctctcatcgtctaatcccagtagaaattcccttaagacaattaggacctgagaaactcctagagtaagtaagaaccattccaaattgtaagaaacagtattttctgactgtataaaatcttgtttttcattggcctgtttatctttgcccctgccatttgtcatgttggttctctttacgcattacagcttgaaagtcataccctgatagctagaattttagactcttcagttaaattcaggcaatattaattgcatgcctattgggtaccaggcagcatgctaaatgttaggcatgtaaagacaagacgttgtccttgccctcaaagtatgcatagccttggcaggtggtatcagtgatactaacgatggtgataatctagctaacattgatgaagcacctgcaatttactcaataacagttcttggtgctttgtatatattaactcagtcctcacaagggtcttgatgtaggtattaatagtattatttcattttacaaatggagaccctgaggcacaaaaattcgagtaacttgcctaaggtcaagcgggtgagaatttggagcaaagccctcgattctgctatgccagacagttcctgagttatttatgctttggtcagagcttagcttattaaaattatgatttttaaaagcccacttttctttaaaccttaaatatacttaaaaattcactgaaaaatttagttgggtgttaatattaaaaatgcctatttgcttgttttttgactgatgctcaagcgcttttacatttgacagatgaaattcctctattaaataccatttacaggctgggtgcagtggctcatgcctataatcctagagctttgggaggctgaggtgggaggatcacttgaacccagcagttcagggctgcagttatctatgattgtgccactgcactgcagcctgggtggcagagcactaccctgtctttaaaaaaaaaaaaaattataaacttgactagaattccttaaacatttcaaaacatgcttacaaatttaatatatctgatatccccaggcacttcaaacttcttccagtaaatcaactacataactttaataagtcaaatagtctcttaagaattttaaacatttgaaaaaccagaacatatactcatgagtgtaatggttacaaaaatgatgattacacttgcttaaatacaacttatacaaatatatcactaccatttattcattcaggggttacaaatttacccaaccaaggtggacaaaattaccatttcgaacctgctatagagttttgggggtggagatttaggactgggtcaataactttgaggcttatttattgggctaagctctttcatagtggtgggattgtccaagcctgtacctcttgtgcttacccaatttttgaccacaatctcttacctgctctagagggaatggaattctgcagaccctactcaaactgtgtctttactgactgatttgcactgatagaactgtgtctaataaatactcatgtaataatttggattgatttataacacttacaaattattggaaactcatgtatgtcataattccataccgaggaccatctctagcacaaatagtacctttgtgtgaattaacagaaaggtgcccggccggctgcagtggctcacgcctgtaatcacagcactttagaaggccaaggagggtggatcacttgacatcgggagttcgagaccagcctggcgaatgtggtgaaaccccatctctactaaaaatacaagattagccaggcgtagtgctgcacgtctgtaatcccagctactcgggaggctgaagcaggagaatcgcttgaacccgggaggtagaagttccagtgagctgagatcatgccactgcactccaacctgggcaagagagcaagactccatctcaaaaaaacaacaacaaaaaacaaacaaaaaactcagaaaggtgcccctctaggtagatgaattacaaaagctcaaagttaagctcaccccaggcctggctggattttaatctctacttgcccccttacagcttttaagatttctccccttttaagtaccattaagactgatgaatcttaactgaattgtcagattgtcatttgagcctttaaactggctcctttgtagactttctgacagaaacaagatctagccccatctagattcccacgcccccaagccccccgcttcccccaaggctagaatcagctattctccatggagccagttgcttttgtggtagaatagtattaggtactgttagatacattagtgatttcattgcatatcaaatttttctgttggattactgatacggttctctagtgacaaagctctaaaagatctctttttaatgggtcatggtgtttccagtgtaattttaatcctttaaaaatcttttcaatatttcaatatttcaaaatattgaaaagatttttaaaggacttatttaagtcctactatgtggcagacagcattctaggcacagaggagacggcagtgaatcaggtcatgtccctgccttcgtggattcagtatctaagtggggagcagacaagccttacatctaccccccacttattttcaagccacaagcttgtttcctgtgtcatttgcaatacttatttgccagttttgatatatgctgccatgccaagcggtgtgattaaattacagtgtcgtctaaactttctatgatgtaactggatgtgtattaaccaattcgatcctggtcttgaagccaggcttcgtttgtaatcattcagtgcctacttgatgatccttctatagttcaagcattcaatagggaagacagcgaatggaggccagttcttcacattgcctcactcttgcccgtagcctcctttcctgggtgttactcctcagacgctctgctggcccctgctgcttcctgccctgttgtttgtttcttccttttgtttcctccatccaaaagccccaatctcactgcaacatagggctttttttttgggcggggggtactttgtcatatagttttgtttcctttttttttttttaaccaggttaaaaaagggtgaatcaaacacttttctccttcaggttctcttcaagtctggtgttaagttctctcagtggagtaggtatttgtgaggcccaacaatacttggaaaggttttattccttaagcttggtggtaagaacgtggatgtttgttttcttttacgctgttcgtcgtgtctgaaatcttttgtaataacttaatgttttaatgttctggtctgataacttctggaggagtggcaaaagatggattattaacagctagtagacgaatgcatgaagacgtacgatggaggatgtcattaggtgtctactatgtggcagacagcgttctaggcatggaggagacagcagtgaatcaggtcatgtccctgccttcttggtttcagtatctaagtggggagcagactaagcaaataaatatgaaccaaaacatcagatgctggcaggtggtatgtatggcagagaaagggcatagtgactgggcaggggaactgttttagatagtggtcagcaaaggccttgtgaggaggtgacatttgagaagagacctgaatgaagtgggggataatgagtgtgaacatgtgaggaattgctttccagaagtggagacaggaagagcaaagactcttcttggataggactgtgtttgataaacagcaagaagtgcctagagaaaggcaagccaggctgggcacagtgactcacacctgtaatcccagcactttgggaggctgaggcaggtggatcacctgaggtcaggaattcaagaccaacctggccaatgtggtgaaaccctgtctctactaaacatacagattagctgggcatggtagtgggcacctgtaatcccagctactcgggaggctgaggcaggagaatcacttgagcctgggaggtggaggttgcagtgaaccaagttagcaccattgctctccagcctgggggacagagcaagaatctgtctcaaaaaaaaaaaaaaaaaaggcaagccgccaggccaaaatcggtgggctgtggcaccataaagatcctcacgagctgctctagtggggaggtttgggagagttttgagcaggggagtggcagaatcttaccctttagaaaagattactttggcttttctgcaaaggacttactgtggagagcaagggtgagacaaagagatcagtaagctgttgtaattcaggggagaaagaatagtgacttggaccaagagggtagaggtatgggggtggtgagaaaaaatcagattctggatagaaaaagagaagaggtaaggatgaggcctaggtttttggcttgaacaactgggtagatgttaatgcatccttcccctccttaaaggaggaacatatttagagaaagaaagtgtgatatgcttggtagacagccagtggagatactaagtaggcaattggatgtataaatccagaattcagaggaatgatctggagggagacataaaagatcaccagcagatagataatgaaaattttgagacaaaatgagatcattactcaaatgaagaagtatagacagaagaaaagagatccaaaagtggaggttcaagagtgctctgatttttagaggtcaggaatgagaagctagtacagaggattgaggtggaatctccactaaggagaaccaggaaaatatggtggaagcaaggtaaatatactcttctttcctttttttttttttttttttttgagatggagtctccctcttgcactcactgcaacctccaactctcgggttcaagtgattctcctccctcagccccccgagtagctgggattacaggcatgagccaccacgccctcctaatttttgtatttttagtagaggtcgggtttcaccatgttggccaggatggtctcgatctcctgaacttgtgatctaccacctcagcctcccaaagtgctgggattacaggcgtgagccgctgtacctggcctgtttactcctttcttaaaaggatatttacggccgggtgcagtggctcacgcctgtaatcccagcactttgggaggctgaggcaggcagatcacttgagcccaggagttagagaccagcctgggcagcacggcgagatcccatccctactaaaaatagaaaaacttattcagatgtggtggcatacacctgtagtcccagctactcaggaggctgagttgggaggatcacctgagccagggaggttgagactgcagtaagccattatagcaccactgcactccagcctgggcgacatagtgagaccctgtctcaaaaaaaaaaaaaaaaagagtaatgaaatactgaacaagatgagggctaagaatcattgtatttagcaaaatgagaggtcatggagatcacaagaggggttctattggacaagactaatttggagcatgtggaagagaaatgaaagttgagcaagtggggacagtgaatagagacagctctcctaaggcttttggtgtaaagagaagtaaagtagagtgatagcaggaaccagataggggacatggagaagtttttcatttttaaagatgggaggtatttcagcctttgggtgtgctaatgcagattatctgggagaggaaagcctgtgatgatggaggcgtctcaccatgtagcattctgtggcctcctcccaatcctgtggaggtggcggttaagggaaggaatagttttaccaggagcaactattaaacatatgatagaatgaatcattggaaacaatggaaatatctaacacagaggaatttaaatacactgttctatagccataattgttagatatgcataaattgaactattcagccactaaaaatcgtaataaggttctatattgatatgaagagactttcaagacttaagtgaaagaggtaattattgtgaaaaaaatatgtaagacacacacactttggaaaaaaatgtctgaaaggtagtattatgaatgattttcaatttttccattaggttctaattgttttccaaattactcccccatggattctctacaacgaacatgtgttactcgtgtggtttttttcttaagttattagtatgtcagtgagttcaactctttcatagcaattataaaatatttctatattttgacttttttagccattttatttcaggttttcaatcttgcatttttgttctttttttttttcgtctgagacagaggcttgctctgtcacccagactagaaatgcaatggtgcgatctcagctcactgcaacctccgcctcctgggttcaagcgattctcctgccttagtctcccgagtagctgggattacagacacccaccaccacgcccagctaatttttgtatttttagtagggatggggtttcaccatgttggccaggctggtctcaaaatcctgacctcaggtgatccgcttgcgtcagcctcccaaagtgctgggattacaggcatgagcacttttgaattcttgttttgagctttgggttatattaattaatccattcaaccaatatttaatcagtattttccatgggttgataattgttttaagctttgggaatacaacaataaacaataacagatgagaatccctgccctagtagaactttctttctagtgggatataagataataaacaagataaaagtataaatttcatactgtttcttaggtagtgagttggatttaagacaggttgtggtgtggccaggcaaataagatgaggtgagaggggaaagggagttgagggtctgattagaattattgacagtagaatgaatgaaagctagactgggaaggggcgaagggcgcatgagggtgtaggaacagtggattgaaaaccaggcaaaggcttgttggaattggtactaacaggagggatctgtaaagatataggtattggctggagaggggatgtttggaagtgagataatggataggttgtagtaattgtgaatgacaaggtcaatggagtgatcatagaagagagtgactaagttaagattgaaaatataaaacatgagaagagacctttgcttctccctatggtggagtaacagggcccagattttatgccctttccttaacaaggaaactatgcagaatatcctgaaacagtggtttttagacactagacaacaggcaaggcgggagagaaggcagtgcttgggagaaaagtgagcccccgtgattgtcccagctgaccgactggagatcacagggcaaggagggacaggctaaatggagccccacagcctccctgacgaaggagacagagtggagaatgtaaggaaaccaaagagagtagaattcccagaaccttggaagaatgcactgcacacctcccagagaaatgcggcgcattcctgagtcttcagcagagtcccgtcgaatgtgtgtgtgtgaggagaccaccaaggctgctgaaaaataagggatggccttggagtcccgggcttcttgtggtgagtcgatgaaattagtcctgatggtgctaagacagacaataatggagaggctgtgagtattgaggggcagggggaggagtggtcttacccgaaacgccagagttctggcgctttcgctcgattttgacaatgagtgagacctgtagggtgatagtcttgctcccacagttccctcttgacttctgctgcttcccttgactcctgctgtaggaaacagagtcctgccgagagttggacttcattgttaatcatccgggttaaagggcaacattgtcggtgttctcctttttctatggactctttcccccagaatacaactctatggtttcaaaacaggagtcattgaacaaaatattttctagcaaatttttgagaaaatactggttcctagaggtaagaattacttctgccgtgtatgtgtgaatatatatgtgtgtatgtatatgtagtaatcttagccaaagatagttgcctatggttagatcaattcctggtaaagaaggttttgaaggccaaattagaattctttaaggtcagagagagttctgttcatctttgatgaatgtgtttaagtgagacgtggcattctgagtgagtgaaagcgtcataggaatttcatcatgggactgaagcagccacaattctgacttcttatataaacagacctgtgaaactgcagtttctaccgcgtcagctgggcgtgctgatttggaactttttcttagggtttgtagttgttgagatgaccttttagattttggatcaggttaggaaatgatagtaatagaaggttcttagtaagttagtcattatttcatatgccaagcattgtgctgagtattttatatgtaatttatttaatcttcaaagcagctctttgaggaagatcctatcatactttttttcctgtgtttaaactctttcttcttcatcccctattgtcagctggtgaccttatagacaaggtgtccccctgctatggtctggatccagtgatgttagaactggatcctataccggcttaaaaaactgattgtgcttatctctttccaactctgtttagtgacactgttaataacttgggatcagccatggtaggaatacttacaccatggaaattgccaaatgctacaaatcagctttttccagagagctggctgttaaacttttatcatcacaccaccttctgggtcctctcctgtcttacccttagttgattcatgtattagtccatttgcattgctgtaaaggagtacctgagactgggtaatttataaagaaaaaaggtttattttggcatatggttctgcaggctgtacaggaagcatggcactggcatctgctcctggtgagggtctcaggaagtttacgatcatggtgaaaggcaaagggggagcagatgtatcacatggcaagagagagagcaagagaaaggaggagaaggttcagactctttatttttttttgagacagggtcttactgtggttgcccaggctggagtgcagtggcatgatttcagttcactgcagcattgacctcccgggctcaggtgattctcctacctcagcctctcaagtagctgggattacaggtgcacaccaccacactcggctaattttttgtattttttagtagggagggcgcttcgctatgttgcccaaactggtcttgaattcctggactgaagcaattcacctgccttagcctcccagagtgctgggattacaggcataagccaccatgcccagccaaggtcccagactcttttaaatgatcagatcttgggtgaactgagcaagaactcgcccaacactgggcctggcgcagtggctcatgcctataatcccaacactttgggtggctgacggcaggtggatcacctgaggtcaggagttcgagaccagcctaaccaaaatggtgaaaccccatctctactaaaaatagagggtgtggcatggtggtgagtacctgtaatcccagctactcaggaggctgaggcaggagaatcgcttgaacctgggaggcggagattttggtgagccgagatcgtgccattgcactccagcctgggcgacaagagtgaaactctgttcccccctccccatccccacaaaaaaagaactcacccaacaccaactgaatagcactaagccattcatgaggagtccacccccatgatccagtacctctcactaggccccatctccaacattggggatcacatttcaacaagagatttggaggggacacacatccagaccatgtgatttccattaaacaacaaagtcagcaaaaggatggaatcattaaaaattatatataccctaaatattattttgaaataaaacaaatttgcaatcatttgacaaacttgttttgattataaaaatgtgcaaaaatgtaaaaattgagactagtataatgaatatacatatattttttagatgtgataatttttaattttttgaaccatttcaaagaaagttacagatatcatactttatcctaaactgtttttgcatacttcttccacataacctaattccatcatcactcttaagaaaattagggtaccctaaaatcattgactactctctccatattcacattttcccaattgttccacaaatgtcatttgtagttggttttcttctaacaaggatgcaatcaagatttttgcattgcattgtgatattatgctttttttggtgtctttaagctagaataattcctctcattttttcatgacattgagtattttttcatgatactgactttttaataagtttaaagtatatataaaagtagagaaaatagacaataaaccacaatatacccattaccaattcaataactatcatggctttgttatattggtttcatttatcttttttctttgcaaaaatatttcaaaacagattcaagacataccatttcatgcctcataagtctaagcaataaagtcattttgtgatgtaaccaaatacagtactgtgataataccaagcaaaatttatttttatttttatttttattttttttgagatggagtcttgctctgtcacccaggctggaatgcggtggcgtgatctcggctcactgcaatctccgcctcccgggttcaagcgattctcctgcctcagcctcccgagcagctgggactgcaggtgcgtgccaccatgcctggctagttttttgtatttttagtagagatggggtttcaccgtgttagtcaggatgatcttgatctcctgacctcgtgatcgacccacttcagcctcccaaattgctgggattacaggcgtgagccaccgcacccggccgatattggctttttaaagaaaccaagctagttgttttgtagagtgccctacatttggggcttgtatgattgttttgtcattgtatcatttaactcatttatctatcccatgtatttcctgtacactggaagctagatccaaattcctgactacattaaacaccttcatcagtaatactttataaaggatgaaatatattttggtgtgcaatactttaggtggtacatatggtctggttatccactactaatgattttaaatttgatcacttgattaaggtagtgactgcagttggctccgttctattttatttattttttatttttatttttgagacagcgtctcgccctgtcacccaggctggagtgcagtggcgtgatctccgctcgcggcaacctccaactccctggttcaagcgattctcctgcctcagcctcccaagtagctgggattacaggcatgtgccaccatgcccggctaatttttgtattttagtagaggtggggtttcaccgtgttggccaggatggtcttgatctcctgaccttgtgatccacccacctcggcctcccaaattgctgggattacaggcgtgagccaccacgcccagccaagttggctccattctagagataagctttcttctttgggattagcaatgatctgtggagtgatacttcagcaccacacaaatattattttctccatcaacctctccccctaatagttttagcatctgttaatgttctttgcctgaatcaatacatttcaacaggcattggaagatggtgttgccattcttctgaagtaggacccaggcattttctttgagttgggcttactgattcgtgtttcatacaatagtgcatgaatcacatccgtagtatatcttctctaagttatccaaatcttctctaaatctgagttttcacttcaagtggaacaagcaatgcaaagcattttcaaagcaatacaagtgcagaatcttcctagatctgttttctcttaccccctcctaattcaacagcagggatttttttgtttaacagcctgcttttactgattctttctgaaagattcatcatatttgctgtgggttgaatgtgtctcacaaagttcatgtggcgaaacttaatctccaatgcaaacactgggagatgggggtctaataagaggtgattgggtcatcaggttcctcgtgaatggattggtgtcattatgtagttaggttagttactgtgagaatgggcttgttataggagcaagttcagtcccctcttgctctcttgcccttctgccatgggatgacacagcatgaaggcccttgccagatgtgggcccctcaatcttgcacttcccagcctccaaactgtaagaaatctgttcttcataaattaacctgtcttgggtattgtgatgtagcagcacaaaatggactgagacagtgtccgtagaaacaacttttctattctcttaagtttttataatacttaaattacataattgcagcatcaagtacaaatgtcataaatatttttggaggctgggagtagtggctcatgcctgtaatcccagcactttgggaggccaaggcgggtggatcgcttgagctcaggagtttgagaccagtctgggaaacacggcaaaactgtgtctctacaaaaaatacaaaaatttagctgggcatggttgcacatacctgtagtctcagctactcaagaggctgaggtgagagaattgctggagcccaggaggtcaaggttgcagtgagctgtgatcgtgccactgcactctagccttagggacagagtgagaccttgtcttcaaaaaaaaaaaaaaaaaaaaaaaaggtttggaaacagaaataaccaattcttagtaaaatttctacttaatccaggggagtttagaatgcagagtactagatagcagtctattagacaaaagcattcagtgtgctgtgggcctcagtcagtgtgttctacagggagaatggagtgtgttcattagcacattgttacatggaggtcagttaagagaagagtctaacatgttgtaattttccttgcctgtcttccttggtcgacttccagttccttgacagtaaggaaatcagtcttgtatgtgtttgagtttaatcgctggtgcatggtacagtgcttagcatatagtgagtgctcaagaaaaatacttgttgaatgaattcatgactggccatattgacctcaagtgaattctaatcataaacatggaaacctttgcaatatctttaaaaatgtcaaggttggtatggccattgcacataatttattatttcattggcttttccccttctcattccctcagtctttgagtctttctctgctctgtgccaacttccttcaatttattgtgtattacaagctacctgtgtttattatcattccagtttcctgacaaagatgcaaaaagaatgtgtagcagtttggctgcaatggcgctctgcccaaagagagatgagattcttaggaaaatacaaagtagttccttagttctctattctagagcttaaccaatcccaggaactgaagtcttctgtttcttcacagaggaaatatgacaaaggcagtggctgtacaagcttccttcatgggccgccctccccactgcctcatccagtaagcgggagcaactacttctagaggtgagaggggagggaggacaatctccataacccattcgatgcacccagctgcaaaattttggtattgagaaactgagcaaacaatttgtagagttgctatattgaactttaaagcaaaataagcctacataggattgaatgctcaggtgatacaaatgatggtctttgatagaagcctacaatctatattttgaaagaagctacttatagctgtataattccaataatcccaagatcctgtttctatagatattaaaaggtattatgcatgtacatttgagatgatttttagcttcctaacccatgagaaagttcatcagtaatataatcattatcatttattgagcacttactatgtgccaggcactatttaaattgttttttcatttgatttttcaatttttatagtaaacatagggtatatctccatttacagacggtcaaagtgggaggccatgagaaggtaaatgacttgctctcagtcacacaggtagtatgtaacagagtcaaagcatctacacccatacttgtctaattttaaagttcttaatcactgatagtatgcctagggtcctgtcacatatttgagctcttaaaatctgtgccttttttgatgaggggtcagtgaccgagagcagcctagatctgctgaacattgtatcaggaactgaggtgatgttccataaggcatttgtagtgcgtactcacagaaagcttaagacagtttgtcatttttaccaaggaccaggtccctcaaaaggatggtctgtttctaaggttctttacggaagcaaatgaatgttgagttcttttggccattcattcgctcatttattcatctagtcattcagtaaacacttatctttttttacttgacaactcattgtatttgagtatcagagtctcggttttcaggttgaattcatgttttgtgtttataagaagataatgaaaattcttgaagacattctcaagcacaacagaggaaggagcacagggtttgatttctacttgtttttcaagtgggcttcatctgagaacaaactctattgtaacctttctagaatttggtgccaataagagttaaaataataaaatcagtacaattaaataggaaatgagtgtcttttatgtacaaggccttagattaggtaacaacagttggtcattcctctgggaaatggttgctaaaattataatcaactggcagtcactgattggccttgtttacttcattgtgtcccaggaaaaaaaagacaatctcctcttatgacaagatcttgcagagataataccatttccgccataatcttcatccccctcccattttcttctttcttttctttttctttttctttttttttttttcttttttttttttttgagacagtctcgctgtgtcactcaggctggagtgcagtgatgtgatatcggctcactgcaacctccgcacaccaggttcaatcgattgtcatgtctcagtctcccaagtagctggcattataggcgtgtgccaccatgcccactaacttttgtatttttagtaaagacgaggttccaccatgttggccaggctggttttgaacccctgacctcaaatgatccacccgcctcggcctcccaaaatgctgggattacaggcatgagccaccgtgcccggcccccactcctattttcttaagattaatttgagctatttagttaagctttattaaaagtattggccaggcatggtggctcacacctgtaatcccagtactttaggatgctgaggcaggtggatcacctggtcaggagttcaagaccagcttggccaacatggcgaaaccccatctctacttaaaaaaaaaaaaaaaaaaataggcgggcgtggtggccagcacctgtaatcccagctcctcaggaggctgaggagaatcacttgaacccaggtggcagaggttgcagtgagctgagatggtgccactgcactccagcctgggtgacagagcaaaactccgtctcaaaataaataaataaatacataaataatctaccagacactgtgctagtttctaaggctttagatgtgaaagagaacccttccttcaataatctcacagaggactaaaaattcagaggagccaggcacggtggctcacgcctgtaatcccagcactttgggaggctgaggcgggtggatcacgaggttcaggagatagagaccagcctggctaacacgatgaaaccccgtctctactaaaaatacaaaaaaaaattagccaggcatggcggcacgtgcctgtagtcccagctactagggaggctgaggcgggagaatcccttgaacctgggaggcggaggttgcagtgagccaagatcacgccactgcactctagcctgggagacagagcaagactccgtctcaaaaaaaaaaaaaataatctcagaggagagtgagatagttattaatacagggtaataagtgccctaatggagccaatgaaggctttgtgggaacagtgacaggcaccaaacccagctggtctaggtgaggttaggaagacttccaagatgagatgatgcttacattgaatatttgagggagaataagagtaaagaagccaaggggaggccagtgtttatggcaaagagaacagtgaaatagcatatctagtttggggaattggaaaatgtatgctcttggatggaatgagcaaagctatgggagatgtggctagagaaggatcccatcatgacgggctttgaatgccatcccaaagaacttaaacgttcctaaatgcagtgggaagttatggaagaattttaagcagaggagtaacatgttcagatttggtctttaataagattactatggcatcagtgaggtggccttgaggaaattacattaaagttaggtacattagaagtaatgaggacttggaatttaggtgaactggtgatagggatggagactatgaaataatcaatattggctggacatggtggctcatgcctataatctcagcactttgggaggccgaggcaggtggatcacttgaggtcaggagttcaagaccagcctggccaacacggtgaaacccagtctctactaaaaatacaaaaaattagccaggcgtggtggcacacctgtagtcccagccacttgtgaggtgggagaattgcttgagcctgggaggcggaggctgcagtgagctgagatcatgccactgcactccagcctgggcaacagagtgaggctccctcttggcagggggggaagtcgatatttaggaggcagtcttaaatttagaacctaacacaatgttaggtaccaatatgtcatagccggatgaaactagagggaaaagaggcatctaagttgactttcacagtttcacatttgacctttacagatgtcattagtataaggattagaagcagggaaacaggttttgtgaagaagatgataggtttagttttggacatgttgaacttaagatgcttattggacaagaggaggaggaggaccagatggacagatggaatatttttatatctgaggtttagatgagactgggatggtggagtatgtagattttagggttttcagtctgtgctttatgctccctttgttgtagttactcaattagtgcatcgtgaaaagcatattaccacaaagctaatgaagctaaagcttaagtgctcagatgtgtgggctgcttccaaggccctgggaagacccctagcaagttttacatgtttatgtgtatttgtaaattttgaaaaatcggaaagtttactgtgggccaaaattactctttccacattgagttaccctctcttactcttgtgtgtggcaatgttggagtggtcccaagcatttttgggattcagctgtgggaaagttaagctgtggatatacactttgtttgagtttactgggatatatctctgtggttgcagtcactttgatgtatagttattggtggccatctcactgcataaatgatatccaacaatgtggatgtcactcaaaggtacaagccctgcattgtattgagacaggagtgtgttctaacacatctggcactggaatctgcaagtagaagagcatgaaatgtgtgaaaccaaaaagtggctggtggaaaaactttccactcacccgatgtcttagcctgaacatcagcctggtagaaagacttgcatgcagggaagtttatatggagtgcagtcccaggaagcaggagttcaggacaaggaaagtgaaatgagaaggagggaaagaaaatttaaggatctgatagcgcctaggcagcaggtgttcaattccactagaacctttttaggaacctatggaatggaatgctctcagaactgtctgcttaagtacaaaatgcggggggggcgtgaggggatttatcccgttgatttctccctcttgtttgcatatgcataactgcagaataagtttcaagagaaatcctaaggcaggaagtgaaatattgagcattagcaatgaggcagtgtctgcctgcactgatgcacgagcatgaagccactgcaagcctgcgtgaactagtcactgcggcagtggagggagtgagcactggggcctagggggttggaagtggctttttagaggtgtccaacactgtcagaggaccctattccccttgatccctggttgaaatacacattttctcttgttagaaatatatacattaggggccgggtacggtgactcatgcctgtaatcccagcactttgggaggccgaggcaggtggatcacctgaggtcaggagttcaagaccagcctggccaacatggtgaaaccccatctctactaaaaaagacaaaaaacagctgggcgtgatggtgcacatctgtaattccagctactcaggaggctgaggcaggagaatcgcttgaacctgggagatggaggttgcagcgagccgagatcaccccaccgcactccaacctgggggacagagtgagactccatctcaaaaagaaaaaaagaattaccctgtagaatgcaaatttttaacagtactgcaaatttcatccagaatgccactgttaacatttgtttctagagttttctatatataattatgattaatgcaattaattacaatgaatacaaatgggaacatactataatattctacatgacttttttttagagtagcctttcataacaattgatgtagctctttttttttttttttttttttaaatagctgcatagcattctattgctgatagaatcctactatatccacgctagctgcatagcattctagtgtggatattgtagaatttacttaacggggctttatcgtggatgtttaggtggtgacttttttcttatagaaatataaaaacttagctgagtgtggtggctcacgtctgtaatcccaacactttgggaggctgaggtggatggattgcttgagcttaagagtttgagaccagcctgggcaacatggtgaaaccctgtcactacaaaagatacaaaaattagccagatgtggctacccatgcctgtaatcccagctacttatgaggctgaggcaggagaatcacatgaacccaagaggtggaggttgtagtgagccatgatcatgccactgcactctagcctgagtgacagagtaagaccctgtccaaaaaaaaaaaaagaaaagaaaaacagaaaaactaatttttgtcttctatacattttttaaatttattttatttttatttttatgtttttgagatggagtcttgctttgtcacacaggctggagtacaatggcatgatctcagctcactgcaacctccgcctcccaggttcaagcaattctcctgcctcagcctcccgagtagttgggactacaggcgcccaccaccaggcccacttaattttattgtattttttagtagagacggggtttcactgtgttagccaggacagtctcaatctccagacctcctgatctgcctgccttggcctcccaaagtgctgggattacaaataggcgtgagccaccacgcctggacaatctaaggttttttttaaaaagcttctggtgaagaaaaaacatgtacaaacaattgtgaaaatgttgcaaaaaatttcctctcttgaaatacatccgtctctacaacttaaaggaggatgagttaggaaagccataaacacaaattctaccctaggatcctatttttggttggtagagatgggggtttcaccatgttggccaggctggtctcgaactcctaaccttgtgatccgcctgcctcggcctcccaaagtgctgggattacaggcgtgagccaccgtgcccagcccttctacacatttttaagagctattgggggaaagtagatcatgggaatggtgagtaggaattatgaaggaatctataatagagaacactgggttttaaaagttgtttgcatcttttttctcctctataatgaagatgaagtgcttgaagtttctggggacaggaagcaaaagtaaaatgctaggattttaggacaatgaggaagaccttgaaatattttcaccctttcatttttttttttgaagtttatcatatgcacaaaatttacagaagataattaatacattggataagaatttatctagatgattaattttccttctaatatccagagattttttgggagggggataatcttgatagctcttttcccttatatcacataattattaactatgtaatatatgtttactattaaatgtataataataaataatagcaattctacctcgctccaaattgaggtcatcaggaaggacttcccaaaaagaggagacttgagtgagaaaaggggttaaggtctgtctttcttgttttttttttttggttttaaaaacaaaacaaaacaaaaaaaaccattactttccccttcaagcaggtttaaaaaccgacctcattcctctccttaaaacgcctgtgactgcagcaaatgtacggtgtggtttgatctgcagtgttatttagcacattgtctgggcttaggtaatttttgttcagtgactgtgacaacaggaccacatttttatgtatgacttttgtataattactgatcttgtctacttgtgttgtagaaatcagccaagaaattagcttagttgaaatcagtaagtttggactgtaaaacaaagcttctaaataattattggtctaaaaactaaaaccttataatggaacagaagagtaaatcataaaaccaaagccctaacatttgggcttagcagcagaagtatagatctcttttaaaaatctcctactgatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtctgcagtccggcctgggcgacagagcgagactccgtctcaaaaaaaaaaaaaaaaaatctcctactattggctgggcatggtggttcatgtctataatcccagcactttgggaggctgaggtggaaggatcacttgagtccaggaattcgagaccagtctgggcaacatagtgggaccgtgtcttgaaaaataaaaaataactcctactattattggatatattggaattctactaaacggactactaagtagtctggtcagtcctcgtttatcattcttataaacgctgcaggcctaaaggaaagacagaaatagtctcattggttctaaaataaaccccttagttctatagaagaactacctgtctcttggggaacatgagaaggttcccatcatctcagcctgaaagccatcttttgtcttagccatgttttccattgcccatcacttactagggaaacattccaatgagtgtacagtgagtgttacagaccaccaaaaaagatgaagtggagatgcccagcatgcctcactatttataagaaaatatttccccaaaagatgggaaaatccgagtctttaaatactcagagagagaaataatggaaaaaactcttcagtctctgttctgttggttcatgagattttctcacaagtcatttggatgggccattaagtaagtcacataatgactggaattttctattaattgcctcactttgggtttctggctaaagtatctggcagcaagactgaagaacaagcgaaagagaaaaggagtgggtggtggtgggaatgtgagaccatccattgtttgtttattgcctggaatcctaacttaggggagagggctggagggctgtctttgataggaccatccacttggatggctagaagtaaatgacttggcttcttgtcttttaaacagtttaggtttctttgtttcagagggttactttactttctgtgtctgctgttgtcaccgggaagttcatggatcgaattctctggcatagcgcacacacattagtttgtcttcttatacgcatcagtcattagctgtcttggctttgggaaatgagaacttagtttaatcctagttttccttttgctttctgctttctgttaatccctttgtggtatagatcctgagtctatcagtcaggatccaaccagagaaacaaaaccaataggacacacacacacacacacactctttcatcaagggatttattataagactctagcttatgtattgtggaggatgtttaagaaagcccaaattgataggacaggtcattaggaagagaagatgacaagcaggctggaatcccacaggcacagtctgaagttgttttctatgggagaaatttcttctctccttcagaaagtcttaaggcccggcttttaaggccttccaactgattaagtcaggtctaccaagagtgatctcccttaaagtcaacccatgaagtcccattagggacttcatttgcatctgcaaaatcccttcacaacagcacctagattagtgtttaattgaattaccagggattgttaaattcatcaacacattgggagaagccaaagaggagctgcctggaaaatcatcctgccacaggtgtgcctctgcagacgtttatcaaatcgaggtggggtctctgctactctctccaaaaaccgtttctctcttagttatacaactacctgctgtatacctcacccaggaaagcatggttggctaatctttgtcaggattggacctcactcgggttttcaaatgttgcatgtaaaacaattttttgactgaaaaatgtttttctattgataaccgtttagtgagctttttaaatatttgtttaaacttaaacactaaagcataagggccactgtcaatagaaaactaaggccttattttaccaaggaaactattaaaatgattagtttgtgggtatggctataaaagggaaataggaaggtcattgtggtggtagaagtgtcctatactgtggctctgtcaatgctcatatcgtggttgtgactctgtgctgtagttttgcaagatgttaccattgggggaaactggggaaaagtaaatgggatcttgagcaaaatccacaggatcttcctgttgttccttacaattgcatgtgaatatacaattgtttcaaaattaaaataaaatgttccattttgtaacagcaaaggatttttcaaataatatgaataatcatttcctaattgatctttttaatcatattaaagaagtagacatctatatatatttagccctgtgttgggaattatatatattatatagtattatataataaatatatatattttatttttatatataatacattttcatagaggggggcctcactatgttacctaggctagactcacttttgggctcaatcatcttccagcctcagcctcccaagtagctgggacaatggaggcacaccaccatgaccaccatgtctggctactcaatatgtatttgagtggaagaaagcatacgatgggaaaattgatggtgacagttaagtatagtgttgaatataaaaacgttttgtaaaaatcagggtcaaattattaaatgaaatattgggtatagtataagaagatggagtcttctctctgtaatgatgacttagagaagatagatagcatagcctcaaaaaataatgccagacataaacataaagtataagtacaaaggaaaactctagaaatgtggagagggtagttttaggacaaatataaaatatcttttagctcagaaagttgtatacgttgaaaatatgtttaaaaggtttaaatgcgatttgtagatcactcattcagtaaatatctgcctgcctatagtgtgtcaggcaggtatctacagcttttttgtttttgtttttgttttttttaaacagctcttagttttgtcacccaggctggagtgcagtggtgcaatcttggctcactgcaacctccacctcttgggttcaagcgattctcctgcctcatcctcccaagcagctgggattacaggcatgtaccaccatacccagctaatttttgtatttttagtagagacggggtttcaccatgttggccagcctggtctcgaactcctgacttcaagccatttgcgcaccttagcctcccaaagtgcagggattacaggcgttgagtcaccgtgcctagcctacagtcttgtgtatttcaggaactttcctaacatgtaaatgttgatgtccttgagggtaaccatacctttcccaaatctccattgataaaactgtaaaatctgagaaccacctagattagtttttctcaatgtataatatttctggtcttactgcatggagatttttacagagaagtgaaattcaaccagtcaattttaaaataacactcctggctgctgcatgcactgtgccaagactgtttagccactaatggagaggacttgtctactttgcttctcctggttttaaacaaagtcttttagagggtgaccacctcagtgagtgctacctccctactgtcagagttgttcaagtggccaaagagcagcagcaacactgtcatcgacgctaatagataaattcagggtcctgtccaggagagggccctgtatcaaataaacctctaccctcaccaaaaaatgttagatttttttaaagaaaccatgattccatattccaccagtcagcctcactggcagacgcattagttcaggcctaaccaggagtgaggatgttcatggctggactgaaggaactgtcctgctagggaggtctgggccggccacttatgggtcagactttggaatttttggaagtagtaaaaggaggcttttgtctcccagaatagcaacagttatcatttaaaaccagtggcttctatatacagcaagtgcttctatatatacactcatgtattgtttatataggactattttaagatctgtgtcacatttttctggtgtattttatggtgggaaaattcaattggaaaaaatgtacttagatctggtggggatggtaaggtaaaataagtacttaaaaaaaaaagaagatacacacagtttgtttttatttttattttagctttcagtacagaaatagctaggtgatagtttcctaaatgaaattgtattgcttctccttaagcaggtttgattatagctcgtgttctaatactagattttttttgctttttttttgagatggagtctcgctctgtcagccaggctggaatgcatggcgtgatctcagctcattgcagcctctacctcccagattcagtcctgcctcagcctcccgagtagctgggactacaggagtgcaccaccatgcctggctaatttttgtatttttagtagagacggggttttgccctgttggccaagttggtctcgaactcctgacctgaggtgatccgcccgcctcggcctcccaaagtgctgggatttcaggtgtgaccgattgcgcctggcctctaatactaggttgatctccacagtagtccgaagacttgcaaggcacatatcagcattcatccatgtattcattacaaaaatctgagtgtttgttacgtggcttgtaattcagggtttatttttctttgggttttgccggtgtttaattgagagggaaatggatagagaaatgacttgtctaaaatactattaagagtaatgtgggtatagagtcccaggcattcccatagcctaggtacggtgcggctgtggcagggcagccccagtgggttgtgtgtgttagggcagtgagtgaggggctggggctctataagggctgaccccttcttacctgctctttgtagagggtggcatcaagctaggtgttctgggagaaaggtgagaaacaaggagcttccagtctagcagggaaaagatcacaaacttagtataagaaagagatgtggccagatggcagtggctcatgcctgtagtcctagcacctctgggaggccaagaagggtggatcacctgaggtcaggagttcaagaccagcctggccaacatggtgaaaccctgtctctactaaaaatacaaaaattagccaggcatggtggtgcatgcctgtaatctcagctacttgggaggctgaggcaggagaatcacttgaacctgggaggtagaggttgtaatgagccaagattgtaccactgcagttcagcctgcttaacagagtgagactccatctcaaaaaacaaaaaagacagatgccttaagagaaattcagatgacattataggagctcaaaaatataaaagataatttctacttttgggaatagaacaggcttcctggtatgggtgatattatgtgtggaattaagagcaaggtaaaaaaggattaaaagggctcaagcagaggaaggggtgagtagagccatggaggacctgactgtgaaaagtcaagtctgggcggatgaagcttaagaaggggagagtggaggttgcagtgtggtgatgcctttgagccctgccctaggaacattttctccttaattcagtagctggtgggaagtgagcactgtgcatgcgtgatggaatgctgtggttatgttatggtgagtaagtcttcctttgtgaatggaggagtagagaagaaacaggagtgttggccgttggctagacttggcaggggctgacacaaaggtggatccggagttgatctggagctgatggcctaatcagggagaccatgttgtagcacactgagctacaggtgtgcagataacaagctgtggggtgaggaggcatggagctgactgatttcagatatttgaaggctgctgtcaacctcatccctgcccagatgtctcttccatctaaacgtctctggcttatgtaattgttcctcccgtgacatagtttgtatatcgtacagcatttcccctcagtttgcctcttgtaaaatacaagacccagacctgaactaagattccagatatagctaaatacgggaggagaattgcttctcttattctgaagttgtgctgtcccccagttatcatgacatgccctgttgctggaccagcatgtgatctgtctatgcttaagggacctgctatcaacaaagggaaggggcaggaaagggagccctaccgaaggggccacatggagggtgttcgccttggagcctgaagtctgctgaacctacttagcccctcctcttatcacaacattacctattccccgttcctgtctccagccccgtcttccgcctcacccacccctgtagctgttgtcaacaccctgactcccaccggctctttccggtggtagttttccaggtatacacaaatgtcaagtttcactgagctgtgaaacttatgcagctgtgtgtgtgtacctattcattcattcattcttcattgaaaaggaagaaaaagagaaaagacaaagatttcagagttttaaagcctgggtgattggaaatctaatggtgtcatgttcagatctagggactcaaagagggaggtgttattttgaagaggacagctgaactgtcctaatgacaggccttttctctgtggtcaaggctacttggcagaagcaggccagttcgggcctccgtgttagaagcagaaagggctcgaggggaaagcacactagccagactctagagtcttcagcatgtcacttacactgtggccctcaggcccttcctccaccacagtctttatctccagcatcttctgtcgccaaaatcacctttcgtgacctttcggctgcatttgatacttttgactgctttctgctatttgggacagtttttgtttttgaatgtggcttccaaaacacccattccctttattcccccctccccttcctgctggccactctttctcaagtctctctttggttctatctcagcctcctgacccaggaaactcgggcacccccatgcttagcgctggctcttttcgccatccatggcctaggtgatctcagtgggtttctggctctgctaccatctgtacttgctcagtttttgtctgtagcttacctctgtgtctctctctcttgaattctggactcttgtatctatctgacatttctactaggatgtcaaatttatccaaaaccgagctgacttctgccttctagactgatgccatgcactgtcctccactgggagcggcagctctgttcctctcattgctcaggccaaaaagcaagtcagcctgactctctcattctcctccacccgctatccagtccatcagcaaatcctgctggctctttctgaaacactgtctatccagaatgcaggtacttctcatcacctgcaccattgctcccgggcccaccatcctccctggcttggcttactggtaacttcctgattgggtttccccgcctcagccctttcccagggctattctcctcccacctgctgccaggcctttccctggccatcctgtgttaaatgtcatcccgcccctactgttatgttctccacagcacttgaacacgacccaacatgccttttcacttcaaggtttattcttctattagttttcccagagtctgcttccctagtgtccatctcccctgctcgaatgcctcttgagagccagtgcttgtattttggtccttgtggtatgggcctggcacatagtaggcagtcagcagatatttatggaacaaacaaatgaatttgtgtgactatagttcattgttcatagttcattcatagcccggattttatggcttatatattatgttcatatacattctctcacttgatcagtttgttcacttgtaaatctgactaaatccaattgtaattatatttaaagtgtattgacttccttgactgccaatatgcaaattggcttcctctggagatcttaagtgtagccattaaaagatcatgtcattttttgttagtgacatgggacctaaatttagacttggagagcttttgcttcttttatcactagttctatagaactccctttttgcaattttattgattcctatttattgaattattataattttatgttagtagatcagaaatttaaaaacaaaagcatatcagatgcttcatttgccgtctccttggttagtaaggaggccgcagcatctcacaacttcagggaaacatgaagcattgcattctgtgctaacggtgccccctggagttgtgcaacgcagatgtcatggcgaatgtaagatgtttggcttgagtttctcatgacgggggtctgttttcttcctgctgtttgagtggcattttaggaccccacaggctcagtttgccttgtgcttgcattattgggtcttcttgactactctgtgtcactttttattagcacagctatatcacgttgttcctaattcccttccactacatccattccatcgactttcttccttaatgtctgcctagtcccatttcacttcattgacatcaacattgtctgatagcaaacaagtccatattttcatctggccgttacaggtgtccttgttggcttaatcataataaaaacagttattaccatcaaaatacaaatggtatctgtcatttaaaatttgagcctagaagtatggtaaggttaaaagatgcaaatgtggtaatccactaccattctgggctggtttaccaattcagagagaatatgcaaataataaactttaatttgtggagcagtggaagcaggcagaggtagaaatttgatcccaattctaccttgtatagatgattttagttgcttagtccatctcccagtgcagacatggtttttgtaatttcacctgtgttactgccctgccctgagcactagtggttatagaaagatgggcaatctaggctgttcataatagcttgcttaggattctgaatttgaggagagatgtatttgtaaaaccctgtactctgaaaacaggcctgtttagattcccttaggaccagaaaaggaggagaagggctaggaatttaaataccagaacagttcaaactgcctggtgtacagcaagatctcttacagcttgcaagaaagggcgctctcccaagccctgatcgtgacaacaatttatgctttatttgatctatatgcagtttataaagtttatttagtctatgcatatttaaaagttttagtgtttaatatctgtgattaaatattttgttgactgctatattttcattcttctcgttggaagttaagaatccatcagtttatcatctttttaagttttgggtttattcttctattcgttttcccagagtcgcttttctgctttcagtcctgacttaatttttccaatgctcaggttaagaaaggtcctatttgagctcggttttgaaaatttatgtattgaaaagttgtttatttgggaggcccatgtggatcacttgaggccaggagttccagaccagcctgagcaatatagcgagaccctgtctcaacaaaaaatttaaaaattagttgggcatggtggtgcacgcctatagtcctagctgctcaggaggctgaggtgggaggatcacttgagcccaggagttcaaggctgcagtgagctacgatcatgccactgcactccagccagggagtgagaccctgtctcagaaaaaaaaaaaaaagttgtttacattttctttttgatttatcccttgacaaggactaaagtccctgcagtgaatggttaagtgggaaggtgcatggaatcactgttctccaaaagcctgagtgaaggagagaggtgtcattgtttttcctttgtactgtgcacagggaagaagtttcagaaaacaggacttctcaccaggaattccaaagttaaaagaatgtggccctggggcagatggagaagtttcagccttgaaacaagtgaacttggaggaaaacttaattttcagtgtaagaagcctaattcacaggaataatttctcctagagtaaggccctttccagccaaatctgtcggtgctattgagctggtatttcaagtatgtccatctgcatttaaacgagttgctccaagacaatctgattatacggtagttactttggtgagaatagcgcctcagtggaatggaaacttcattttgagtctaatattagaccttgctttggaaaattccttttaaatgatcacaagctgggaatagcaaaagaatttaactttcgacagacagcattcaccaagaatttttaactgcttatgttgggtccttgggaaagcagatgtgagaaacctaccggaccaagtggatgagatgagaattgacttgacctgatgcagtgtttatatccattgctgataagtttccctcctcgtctcctctgctcaaaatgttttcattctttgagcgtgagcatgctagggatgaagattgtaggatgcctaattgtctaacaatctaaacttctaggcttgtagacacagctgcctagaagggggtctgaggcagagcagaagctgacttagactgccaagttaagaaagggccaacagatctgcaggaccagagccattgtctgcgtaagtgctgggagcttgatcagatgcagccctcagaatatttttaatgtggctggttgtatctgggtgaacttacccaacttaaagtgttaactaaactttatttaaagctcttgcaccccaccccccgccaccgccaccaagaaaacactctgtcattaaacaaaaattatacaaaaattagctgattaggaagtttccagataatgcctactttggcttcatttatggatatgttttagatactttgcatgctttggattgggaaaaccaatattgttgtttgagagatgctgttactattttaaaagatctttgagattgaaatgcatctttttaactttttattttatttttttatagaaatgagttcttactatgttgcccaggctggtcccaaactcctggcctcaagcgatcctcctgccttggcctcccaagatgctgggattacaggcgtgagccattgtgccctgcctgaggtgcatcttctaatcactttgtacatttaataatatagtggggttttttccctctaagttggtaataagttgatggtgccttagaatttaggaaaaacattaataaaataacgagcattaccacttagtgatcacccagccgattccaggcagtgtctttgctgggtaccagcattatctctgattttcacaacaatcctattgcagtaacaattatgaggctggctttaaagataaggaagctcagaaaagttatgtttggtcatggtcttctgctagtaatggctaatgagtggcctgctggagttcaaatccagaactgttcgactcatgttcttcccttgccatcctggtctcaagcaatccatcccccaaagcagcagtctttaacctatttatgcctagtgttccattattggaatgctaagcttgtgggagttatttatattctactgctcaaggtcatcaccaaggtctgatttttcacaaaaacttgcaacctgtgacataaatgggttaaactttttttggtctcaggaccccttgaaactcttaaaaatgattgaggatccttttatttatgtgggttctatcttttgatatttactgtatttgaattaaaacagagaccttcaaaacattggttgatttaaaggacaataatccattgcttgctaatatagtgttattaataaaaatattttctaaaacaaacagtagaagagtgccattgttttactttttgcatgtctaatcaagctaaaaggaaggcagctgggttcagtcttgtgcattcagtctgtgcagtatactgtgttagttgaagtatatcaggagaatctggcctcacacaggtatgtatttggaaaagggaggagtatcagcttttttggacagtgatgggtattctcctttgatattacatcaaaactccatacatagtaatttattaaaggttagttgtaatgtagaatctgaaaccataccagtagacctttggactcttacattaactttgtttggtccgaaatcttctttacagaagaatactgaataatatatgcaggtactcccccttctaaataatacatgtagatactcccatattccaggaagtagagcttaactcccacccttgtatgggtgggctagacttagtgatttgttttcaaataatagaattaaggaaagggaaaaatgagtaactttccaatggagaaacctgggaaacacagccttaaccaagtgatgaaaaaggtgaatgtcagcagtgatgtcatataaccactgatgtaactagaaaacctataacccagtatactcatgggtgaaacatcagacaagctcaaatcgggggacattctgcaggaggcctgaccagtacccttcaatattgtcaatgtcataaaaagcaaagaccgaaaaactgtcacagaccagaggagactaaagagacatgacaactaaatgtggtgtggtgccctgaaccagacaacaaaacaaagaggatgttgtagaaataatcagcgaaatccaaataaagtctggagtttacttaatagtaatgtaccaatgccaattttttagttttgacaaatatatcatggtagtgtaagatgttaacaatgggggaaaccgggtgaagggtttataggaactctctgtactctctttgcaacttttctgtaaatctaaaattattccaaagtaagaatttttaaaaatctgttgttctgtcttatactccaaatggattgtgtactcgtgcatgattttgtaacattgccatagtcacttggaaaatattggttcactgagttatacagatcttcaaaatgttgacagattgcaatattcaatatttttaacaatcgtttgttaatatcaccagcaatctcatcagaaaagtctttaattgttgagaagctgttacgctcgtggctacaagtctcccaaaattttaattttcttttcttttttttcttttttgttgagacagagtctcacttgttgcccaggctggagtgtaatggcacgatcttggctcactgcaacctccacctcctgggttcaagccattctcctgcctcagcctcctgagtagctgggattacaggcgtgcaccaccacacctggctaatttattttgtatttttagtagagacagggtttcaccatgttggccaggttggtcttgaactcctgacttcaagtgatccgcctcccaaagggctgggattacaaatgtgagccactgcgctcagcattttttttttttttttttgagtgggagtctcactctgttgcccaggcctggagtgcagtggcacaatctcggctcactgcaacctccgcctcccagattcaagtgattctcccacctcagcctcctgagtagctggaatcacaggcacacaccaccacatccagctagtttttgtatttttagtagagatggggttttgccatgttggccaggctggtctcaaactcctgacctcaggtgatctacctgcctcagcctcccaaaacgctgggattacaggcgtgagccaccgcacccagctaaaattttaactgtctgttgaaagctcaaattttatcattggcagtccacactgcctattgttttccttgatgtgacaggttcatttttgagaaaatgcctgacaaatacccaagtctatataaccatagtttgtctagtagtcgtgtttgaagtaaaaacattcaacaatgaaagtggccagtccaacttgcaagtcaatcacaagagtctttcctcaggacggctgccatacttcagaattcaacagaagtgttttatgacaattcccatgttgtcatacagattaccaaaagacatgtactcaggtcaggatttaatgaaattaatgtttactgcttcagcaaggacttttttttaagacagtgtcttactctgtcgcctaggctggagtgcagtggctcgatcatagctcactgcagcctcgaactcctggatcctcccacctcagcctcccaggaagctgggactgtaggcctgcatgtccagctactttttctgtttatttttttgtagagacaggatctcactgtgttgcctaggctgattgtgaacccctgggctcaagtggtcttcccgcccgggcctcccaaagctcttggattacaagagtgagccatcgctcccagccaagtacattcttaagagaagctacttccttccctttactgcatgtgtgttgtgacagagaacagtgttcactaagtgcagcttgctcccactacgttcatctgtgctaaggtgccttttcaccatcagttcaaatttcaacacagtgaaaacagccaatagcatcttagtattcttatgaaaatagttgggcctcatggacctcctataagggtcttgggaatccctagggcaccatggaccacactttgagaaccactctctttaggtggcagttgccgaaaggttacgcaacaagagacattaccattaggaagcagagaacaatggtgcagtgcaatgtatgtggagggtgacgctcttctggcgtaactttctgccttttaatggctcttgaagttcttccatttgtttgtgatgtctcagtaccattttaaaatgctgaaacagagattttgataattcgacatctgtgtttgctggtgtttttaccatatcacatataacatgtcattcagaaaattcagaaagtcacttcctaaactttttcttgtctctaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacagtaagtagcattgtctgagtgtatttcccgaaacctttgctttttttgttgtgctgtttgtgagtcttctgacgtttctccagttgctgcctctgtttataatgacacatgatgtgtgtaggccgtgcacaacctgttggtatattccagtccttttatcagaaggagcagaccctgtaatgtcaagcgacagcattcttctgaacagccagctgcttctaaccactgatgagggcattacttgccctaaacagaaaactgctgttggttttaaattttattttacatatgtaaaaaaatctctactaaaatttcattttatacaactaggtatattgttttcagataaacttctgtttgtacttttcataactcaagtactctttaaagtgaatgggaggccgggcgtggtggctcacgtgtgtaatcccagcactttaggaggccgaggcaggtgaatcacctgaggtcaggagttcgagactagcctggccgacatggtgaaaccttgtctttactaaagatacaaaattagctgggcgtagtggtagtggtgcatgcctgtaattccagctactctggaggctaaagcaggagaatcgcttgaacccaggagacagaggttgcagtgagccaagattgtgccactgtactccagcctggttaacagagtgagagtccacctcaaaaaaaaaaaaaaaagtgaatgggatttgttaaactgatagatgacaactgtttatacttccttgttccagaacccttgggtcaggggtggaggtgagatgtgcaagtgtagcttgctggggcagtgggtcgggggtgtgggaagcaggatagggtagggtacacagtaagaatgtgtttttcctgttctctgcttctctgctttctctttgggggaaggtgaaagtggggagtggcttggatcagggcagggtgaggtaagtatggataccttatttgcccaggtgtagacttgatcctgaactgagtgttgaactgagtcctgtctcattaaagtgtaaaatatgattgctggactgtggagcttaaatcttctttggccacacccttagcaatgctcaagggttccataaagccagagatggtccaggcctgagatgtttgggggtcccaggggtgggatagagaaagagcatctgggctctgtgtatgctgcctggttttaaagcatggcttggcggaggggaaatggactgtctgagcttcccaacaagctggtcattcaggataaagtctgctttgctcaaagcagggtgctttttattcagtcctgctagaaggaaacatcccacattttaaaattgagaaagtttgggaggccgaggtgggtagatcacaaagtcaagagatcaagaccatcctggccaacatggtgaaactccgtctctactaaaaatacaaaaattagctgggcgtggtggcacatgcctgtagtctcagctacttgggaggctgaggcaggagaatcacttgaacccgggaggcggaggttgcagtgagctgagattgcgtcactgcactccagcctggtgacagagccagactctctctccaaaaaatgataataataactgagaaagtcactgggcatggtggctcacccctgtaatgccagcactttgggaggccgaggcgggtggatcacttgagttcgggagttagagaccagcctgaccaacatggcgaaacaccatctctacaaaaatataaaaatcagctgggcatggtggcacgcacctgtgatcccagctactcaggaagctgaggcaggataatcgcttgaacccaggaggtggaggttgcagtgagccgagattacaccactgcactccagcctgggcaacagagtgagactctctcaaaataaataaataaaactgagaaagtcttccctgtacccacaaaagaaaaaattttacacttaactaacgactattttctgaaaacgtatcctgttttatcctcacatctgaatagcattcttaaaaaacaccctttcccacatctgttttatcctttcctcacttggagggtcgtcagaggtctcagagaatattatttgtacgtttacgttcttttcatccttcctcacaaatgactgtttaaaaaccaactgtggctgggcgtggtggctcatgcctgtaatcccagcactttgggagggcgaggcaggcggatcatgaggtcaagagatggagaacatcctggtcaacatggtgaaaccctgactctactaaaaaaaaaaatacaaaaatcagctgggtgtggtggcgtgcgcctgtagtcccagctgctcgggaggctgaggcaggagaatcacttgaacccaggaggcagaggttgcagtgagcagagatcgcaccactgcactccagcctggcgacagagtgagaatccgtctcaaaaaaaaaaacaaaaaaaaaaaaacccaaaccgagtgtgtctgtatttctgtttgcccaggggtagtacttaccattaggaaggcgatttaccatttaggagatcctatgtttgcacttcagttttatacaaatgttagtttaacttctcttaagccttgattggactgatctcatacagaagtgttgcctgatgttactggctcaagatgctggacttgtggtttcaggtttttttcttttttttttttttagactaagtcttgctctattgcccaggctggagtgcagtggtgcaatctcacctcactgcaacctccgcctcctgggttcaagggagtctcctgcctcagcctcctgagtagctgggattacaggcacccgccatcacacctggctaatttttgtatttttagtagagacaaggtttcaccatgttgttcaggctggtctcgaactcctgacctcaagtgatccacctgccttggccttccaaagtgctgggattataggcgtcaccgtgcctggccgatttcaggtatattcttgatctggatagagattgggagtgacagctgttgccattagaaaattatttttaaattctgtattgatttctactgtctggttctcaaaagaattgagacagacagaaagtggaagttgcagtcgccttctcaggaaaagcctagtaatcaatctgttttgctttatgcaagaaacaataatgcagtgactcagtccttgggaaggagcaagcaattggggtcttgtctttaagctcgttttttcttgatcattaatttgtctagaaaaatacttgaaagatggttttgcaggagttaccttccaggtcaggaactggtaaaccaaagcccatgggtgcctgcactctgcttctggtgacctgcaagctaagagtgtcttttcacatcttaaaattgttgcaaaatggctaagcatggtggctcatgtctgtaatcccagcactttgggaggctgaggcaggaggattgcttgagcccaggagttcaataccagcctgggtaacatagtgagactctgtctctacaaaaaaaattttaaaattagctgggcgtggtggcacacacctgcagtcccagctacttgggaggcagaggtgagaggatcacttgagccttggagttgaggctgcagtgagctgcgattgtgctgctgtactccagcctgggcaatagagcaagagcctgtcttaagaaaagaaaagaaaccaaaagaagaacaattactttgtgacatgcaaaaattatatgcaattcaaattgcagtgttcataaagaaagtttgattggaaaacagccatgctccttcatttttctaaacagcagtgtggagactatgtagacccacatagcctaaaatattgactctctggcccttttcggaggaagttcgcagacctctgtccggatcccattcgtatctgcttgaccttgaggatctcatggtctggagtagcagtgaagcaaacatattattaaaacactgctctgcgaaagcattcatgtttgtttcttaagggggttttgtttgtgtgttgtctttcagcagagggaaggggcctcttacaggcagggacactcctcccttgtgtgtacacagtggtggtcctttgctggaggatggtgacattgagcaacagtggactgtgcactccaggctgcgcgccctgttgctgtgtgcttctgtgggtcttgtgagaggctctgtcagcatttgcctgatgctgtgctcacaagggccctctacagaccttcctgaagtacattcactaatcaggctgcctgcggtcactcgctgcggactgcgtggtgcccaggccgccgtgctgatttgatgaggatctggctctccctccctccttccccgtggcatctgtgcatagagcgcctgcatctggaaatacagtccagctcttccaatatattttgtctttttcattcaaaaagagccctcatctcatgggatgcatttctttttttttctctcttttaattcctcccttagctgacaacagaacgaaaaagaaagtggctcaccgggaacgaaagcaagatttttctgcctttaagcagacagacagtgagatgaaggttaaaatatcaccacagctcctcctggccatgcaccgtttcctagcaacaggcaagtgcagcttatcacagtttgagatctctaccaaccctgaagcgtgtttctcacccaccactgactggggtgggttgggggtggacactgggaaatggggtgataagtaatgccacttttgtgttttgttttttttgtttttttgttttgttttgtttttttctttttaaattctctcctctcctatgttcagtgtcggcatgaaccctctgagacatttaccaggggtggaccagtaacttaaaattggtctgaaaggtaaggatgaatgttagtgccacactgcatgtgtacagtaggccaggccatctccttccagctaggtccgtgggagagccagctggcggagcaggctgatggtgccagcctggcaccagcttgtttgatggacaattgagtccaatctctcttcagcttgtcctggaagcacagttggacatcagtggtaacacaggggctgtgatttgcaaagaagaaaactaggttttcacaattaaatctttatcttttatgattttaatgaaatcaaattctaagaactttgatatggatttcttgatggcctcctcagatcagattaactcgagtccatttcaggaggcaagtgttcatgttgtttaaaccaccaacccagccggcactgactgctccagagaggtcaaggttgaatggacttaagatactgaccaacccttctcccatccccagatgctctccagggttgagctctggtggccaggggaagtgtgagaaagtctaaagcatccagtggctttagaagacatcggtgtccctgataggcagccagtgcctttcatctgcatgcagtaaacttaaaccatgtttaaaagaaggctagccgcaaccacatggtggaatgctgtttaactctttaaggtcgtgttctcagacacatggaaatgctcacaatattatatttatcacatcagaaaatatagcttaatacaaagtggggagaaacagaatctaaaactatgtgtacattaagattagagttgtgtttttgtgtgtacacacatgtatacatgagcacacgtgcctgggcatggcactggaaagaaatgctcacttgattgctcagaatggtaatctgagtggttggcttatagataagtttttctttcttctttctttttctgtattttctaaaattcctgtaattactatcttattacaaaaaagtcacaagttaatacagaacttacagctttcataaatacataattagaaaataaaagaacagacgatgtctttcacttattattctttttctaattttgataatactgttcctcatttaagtaccacaaattaaaactaaacatctaggccgggcatggtggctcattgcctgtaatctcagctcttggcggggccaaggcaggctgattgcttgagaccagtctggccaacatgatgaaactctatctccactaaaaatacaaaaattagccaggcatggtggtgggtgcctgtaatcccagttactcgggaggctgaggcagaagaatcacttgaacccgggaggtggcggttgcagtgagccgagattgcgtcactgcactccagcctgggtgacagagtgagactccttctcaaaaaaaaaaaaaatttaaattaaaaaaaaagaaaactaaaactaaatctcctactctgcttctgagatatcatagagtccagttgtaggatagcacccttcagtcagtaatttttgtttttgttatttaaaataaaattgctgtctttgtaaatacttttgaacattactttttttttttaaattagcatgttgatgtgtgcacatgccctgctcttatttccagtctcgaccctctttgttccccacattccttggggtagttgagtgggagagggagacgtggggcacctgtgtgtgtgcgctggcactaaccgcacctgatgctcctgaccttggcttcttcctttggctgttggtcgacagtcaggctgttatggcttgttgaggggcatcccccgcactcaaggagcccgcttgccgttgattttcgtttctgtcagtgaaattagtgtacttttatgaggactgaagtcaatgatgggttgaaaaggaaagaagtaaaaggaacaaatgtgagaattcagcactttctaatttctcccaggtaatctgtccccagtggatcaccaaacggaagcctcgtccattcaaatgctatcactttgattccaagtattcttatctaaacacctcaattactattaatagtataatttttctctctctgtttgaaatgtaatatcaagttgtgtttatatctatagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggtcagaagaattattcaatagtggtttgctctcactgagtatccatctttcagtttggtgtaagtgaatgggtgtcaccgtgtacatactgaacctttctatagggggtagccttagacatgggagaattttatcttcctgttttcatatctgtaaagtaattctaatataaagcaatgccaatagttactttaattttcaatactaaaaggtgcttagtaggctcggtgcagtggcacatacctgtcattccaccactttgagaggccaaggtgggaggattgcttgaggccagaagttcaagaccagcctgggcaacatggcgagaccaccatctctacaaaaaatttaaaaatgagctggatgtggtggcatgcacctgtggtcccagctacttgggaggctaagacagggggcggggcggggattgcttgagcccaggaggttgccatgtttgcaccactgcactccagcctggatgacagagcaaaaccctgttttaaaaaaaaaaaaaaagttggggggatgcacctagtgattactgagtcagatgaaaatggtgaattcaattgttagtattttttgaagagtgtgggagagtttaccagtacatgtctgaatctcagtgggtgtttgaaatttaagtgtcatgggttattggtcctttttccatccttttttccatccttcatgaggacttaagtttatacagcttcttagagatatcttagcatctcttccattaacgccatcaaaataatccatttgttgttgtttttattcctggttaccaaccaaactgttttatagaggaactgataggataattacagcctcttacagcagagtagctaattccttctcactgtaacataattcagtagatgaggtgagaaggtcaattcattctaaacttcctttgagtggctttggtgcttgggttgacaggaggccttgttttatcacagtttcacttaatagagctctatccttggcatggaggccaaggtggatattagtcgataaaatgctaatgtggatcaaatgtgtagattcaagctcgggaaagtgttgtgttcatgtgtgaccccatgtttgggcagcattgtggtgtttggaagcaggagtgaggagtaggaaaatgccgagggttagctgattacatgtcacattcttacagtccttcttagaaacttctgtttgcaagtttactaatttagtacgctgattcatcttctaaatttagttttcctcaattgttttttttctttcctctttggagataatgtaagcttgtaactctgagtgcactgttgggaatttagtttatttactgcagtgagggaataaaacattcatgtttctcataagagtgagatgcgaatattccttaagcctggagaaactctggatacatcaaagactgtcacaggaggaattggaatattgacattgtgaattttagtgttaatattagaaactgtggttttcagttgtctacttttatatagttagtgtttatgaagttgtgattcagtaatgctttattgctatataagaaagccatggatctaaaaatcttatggaaaagggacttcataatctctgtccatttacaagtaaatcttttaagatatttttgataagacatctatgtatatttacctgtatttgtataccaatttgtgttaaatacttatataaaggtgacaagttttttgaactgttaggctgataatgccatgggggttttacaagtagtgtgtatgtttgatgaacaggacttacggagatgtttggtgaaaaaccatgatcttgcagacagccagttacctaaggtacaaagagaagagcaaaatgaaacaccctcacagcctcagtcaatctggcatagctgccatcattaacaaagcatattctacctaatatgtcactaagccagcgttggaagttcatgccactttagggagcatgatccactgtggagtttgtttgtttttttgtttgttttgttttttgtttgttttgagagggaatcttgctctgtcacccaggctagagtgcagtggtgtgatcttggctcaccgcaacctctgcttcccaaatttaagcaattctcctgcctcaggctcccaagtagttgggactacaggcgtgctccaccacacccggctaatttttgtattttcagtcgagatggggtttcaccttgttggccaggctggtcttgaactcctgacctcaagtgatccacctgccttagcctcccaaagcactgggattacaagcatgagccaccgcgtctggcctccactgcatttcaagagcactaaataagaaaaaagcaataatatctgccttcccttcctggcctcagtgccagtgagatgctctccctgcaggaaaaaaccctttaagtaattgataggaatataattgtaaatagaaacacatcattttttagttgaagccctagataagataaattccaaattattcaaggaaaatgacctaagtaaacaagagtattttgtaagttaccatgtacatacctcccactacatatgcataaaaaagccaaaacttcaagttttatctgtaaaagtagatttttacaccaaaatgcatttcagaagcaataaagacagttaaaagcacagtaaatcatggaaaaaactttattggctctacatgctttaaataacttaacaaaatacgtatgtaagaaataggaacatgattttggtggaagtgtttttccaccatcatagaagatcaggcatactaaaaaaaaaagtcatagttttaaactgaataccttgtaaaatagaattaacagatttggaggaaattaaacataatcaagagaaatatactttcgaaaaagcttatgtgggctgggtgtggtagctcatgcctgtaatcccagaactttgggaggtcaagataggatcgtttgaggccagaagtttatcagcctgggctacagagcaagatccccttctctacaaaaaattttttaaaaattagccgggtttggtgacaggtacctacagtcccagctgctcaggaggctgaggcaggattgcttaagcccaggtgttggaggctgcagtgagctgtgattgtgccactgtactccagcctgggcgacagagtgagcatgtctcaataaaaaagctatgtgactcataaaaattgatcatttatcatgttacagtgtacatgctagtaaatacaaaaagatagaaatttcatgaaactacctgaatcgatgataatgaaataaaattcgaaataaaaaatacataaaagtgctgggcatggtggctcacgcctgtaatcccagaactttgggaggttgaggcgggcagatcacttgagtccaggagttcaagaccagcctgggcaatgtggtgaaaccctgtctttacaaaaatacaaacatcagctaggagtggtggcagctactcaggaggctgaggtgggagaatcacttgagcctgggaggcagagattgcagtgagccgagatcgtgccactgcactccagcctgagggacagagtgagacccccatctccaaacaaaataagataaatttaaaaaaagaaaaggtcatatattaaaaaatactaagtcatgttaaaattgtgatacattctcttatgtaggtttatattcaagacacagaacatagtgtataatgtactctctttttt

SEQ ID NO: 30 - DNA, 8710 bp, Homo sapiens
atagtctcacatgacaatcttaccccctagaaactactcgatcacgttcttctctaattagtctcccagggacctacaccacttttaaatttattctggggaaattgtggcagatttttaatgtatattataatgtgctttattccatgtacttagatacacaaagtgttctagatcaatgttatgatattctgatttttttttttttttttttgagacagagtttcgctcttgttgcccaggctggagtgcaatggtgcaatctctgctcattgcaacctccacctcctgggttcaaatgattctgctgcctcagcctcccgagtaactgggattacaggcatgcaccaccacacccagctaattttgtatttttattagagacagggtttctccatgttggtcaggttggtctcgaactcctgacctcaggtgatccgcccgcctcggcctcccaaagtgctgggattacaggcatgagccaccgcgcccggccttattctgattattaataggaattatttacattgctaaagttataggtaagagtcattaaattgttgatgttttggttaaatgataagcactcataaatgttgtctgattatatcctcacatgaaccctgaaaggtaatgttttctcacctttccagaatgaagagagaaatttagaaatttgtcaatgtcacgggcacatcaatgcttagtccagaactcgaactcaagcttatctgattcccaagcctgagttttttcactcacatacaaacaccaaaatcatgtcctctctcatttttattattattattatatattattacctatattattacctataataagtaatttttattacatataataaaataatttatattgttatattaatatattacataaaaatattactattatagataatataaaattatttataattatataatattttatcatttattatatctcattttataaaacgagaattcctattcccattaacaggtgaacaagctagccaagcaagttgaactggttgcagatttaccctgttttatttcccagggagaggagagaagggcactgcaaggacaggtacagcatgcgcaaggtcatggagacaggaaaggacatggcaggctcagaacatgatgagaagtctggggtagtttaagaggagggctgaagcagatgcttggagatgaagttagagaggatcaccagaaccagatcatgaaggtctttgtaagccatgtgccagagttaggatggtaatatattagtaattcaaatcgaggttttgtacaaaatggaagtaacccaggcaaattaccaaaaatggactaaaatgtgagaaactgaaagcaatccttagagagggcgtggccattgcacttgagtcactggaaagatacaggctatgatcaagtcgaatcagctactggttttcacaaggaagtaactcaggcaaattaccaaaaatggactaaaatgtgagaaactgaaagcaatccttagagagggcatggccattgcacttgagtcactggaaagatacaggctatgaccaagtcaaattagagactggttttcacattgttttcctgggaccttaatacatttttaaaatattttctccctattcctatctataaaatacacaaaatatgtgtggaacacactacagaatgtttgttgaataccctgactgtgataggaccggcctttttgatattgcactccataaatatccaactattatctctatttctcattcttaagagtttgatctagtctgcgttgtgttttccacacttcctatttcccttgtgttattttccaactcactattttctttaactctggaaagccctctgatccagtttacaaataaggcaataaataaaacataacagaaaacattaacaaagtctcatactataatggacaatagatggacaaagtgcttatacacggttatttgaatcaaatggaatgaacccattatctggaagtacatacaatctgtactctttaatcaatcagtaactttgcaacacaaaggttgttactcagaaagtatcaatcaacagatttaagagattttattcagcaactataacctcacagcagtagaaaacagcacatagacaaataatttaaaatattgtgtttataggaccgaggcctaatacctgtaagaatataattttactctctctattttaatatatttacattttaatcaatagtactacccatgatatgtttaatgcatgggtgtaaattcattactttttctcatttgtattttcctttataaatgacaccttaagagtatgatgaaacagtgctgaaagtttaaggtgtattatgggaaatgcgtcaatcagagataacttcaatatccttagcagacttttaatttccctaagaattgcagaaccatagtcatgctatctagagaaatagcttgctcagaacatctttaaaataagaatacattcaatcattcttgcaggtaattattaacccaagtattgaactgtaagagatacctgacttaaaataggctctttttgcaaatactgtatacagtatgagcaaatcattgctaatgccttctaacatgactagaaatattataaatacaggtcatggaaaattatagttttaatacacatatgaaaagattagtggtttgccttcaactgaacaaagtcatattcttccactggataaattattttctggcataaattagatgcatatttggaaactcatattaactgtttcaaaataacatagccaggaaatcatatacactttggagttgcaatattgttgtactagatagcgtttacacttatgagctgaaagaattccatactcatggaatgcacaaagttttgtttactgtttccaaaaaaagtgacttctatgccaatttgtcaatttatattaggtttggtgcaaaagtaattgcggtttttgacaacgcaattacttttgcaccaacctaaaagaaacctagctaaactagaaaaataggtttgttcatttgattaacatagatatatgctctagaatctaaatctaaaatccaacctctctttaggatttttaccaatatttgatgacaaactacagctgtggggaatatagcattatccccaccactgtgtttactggtgagctagtcctcatttgaaatatttctcttcttatctctctttccttaactatctcttcctttcatcctttccttcccttgtccccccaaaaaacaactaaattttcttaatctagttgtttcacagacaaaatctgtagtccctagagtgtctatgaggtaggtaaagggcttatgtcctttgagaaaacagggtcttggtggaagactatgttaacatcaggcccgaagtgcccttgggggatagttacagaaattgggtcttacctagctgacaacagagtctggagaaaagaactacttcctgtatgcattaaagagaacttcacgacaccattatcttaaaatactcttctaagtatttcggacacacagacaattattcattcttcctttccttcaactaattttgttttacttcctacaatatgccaagcaccaatacaggcatcagaaataaatgatggacaactccagaaagatccctcacctatgggaatttataatctggtggtgatatttaaataacaaaaagtaaactaataaacaagctatctcaaagagtagtaagtattgtgaagaaggaaaatgtagtggaataggatagtaactagcaaggaatttaaagggatagagggatagatagagggatcccaagcaatcttcctgagggagggatacttatgctgaggcttgaagaatgaggaacagccaggcttgtaatgatctgaggaaagaacaatgcaggcactcagataggtggaacagccaactcaagactctaaagtcagaccaaacctagcacatcaagagagaacagtgtttgtaggtcaaattaagtgagggaagaaatgtggaaagaaaccaagttggtgaataggtttggcccatttatgtaaggtaaaaggtaaaggttaaaagtttggattttattccaagaacaatggcatgtcagtagaagttttagaagaggacacattaatgatctactttaattttgaaagatccctctggctgctgtgtggagaacaggatgaaaagaggcaggcgtggaagcaggaagtccaagtgagagacagctgcaattagacacgatggctcgcactctggggaaagaagcagagatgagaagttgactcatttcagatagtcaagtgctgaaggattgcaagtgggaggtgatgggctgagaaaagaattctttattcctaaaagatgagagaatgcaaaatgaattgtgagtcagagagaagccaaaggcattttttttgtggggagaaagaataggggccaggcacagtggctcacgcctgtaatcccaacactttaggaagccaaggcgggcagatcacctgaggtcaagagttcgagaccagcctgaccaacatggagaaaccccatttctgctaaaaatacaaaattagctgggcgtcctggcacatgcctgtaatcccagctactggggaggctgaggcacttgaactcgggaggcggaggttgcagtgagctgagatcgcgccattgcactccagcctgggcaacaagagtgaaatgccgtctcaaaaaaaaaaaaaaaaaagaataggtacaaaaatggtcatataatctatgacttctctatgaaataattcaattctaaaagaagggtgcttccttacacgttccacagatgtgcatccaacccatgtattgttctaatgagatgagtacagataggcaggtgagcaagggccattcaaaacacgcccaggtggcaacagcaataagagagtatgatggaagagggacaaaatgagtccttcctcactacttaacccagtgacctgaattagcaaccacctcccatcatgggaagcattacactgagatggcatcgtggacagaaagaggaagttaggcagtggcaacagaaactacttgctctgttcattaaaagataaactggaatgaagctggaaaccatcattctcagcaaactatcgcaaggacaaaaaaccaaacaccacgtgttctcactcataggtgggaattgaacaatgagaacacatggacacaggaaggggaacatcacacaccggggactattgtggagtggggggagggggaagggatagcattaggagatatacctaatgttaaatgacgagttaatgggtgcagcacaccacatggcacacttatacatatgtaacaaacctgcatgttgtgcacatgtaccctaaaacttaaagtataataataataaaatttaaaaaaaaaagacaaactggaaaggtttggagatgagggtgctccacaaaagatgaagagtattaactagttcctggtagacatttataataaaagaaaaaaggcatatgtaatacctgcttgatatcagagaaggtcttagcatcaaattagaccacatgtgctgcttagcatttcagatagtgtttggcccatggtgcttacaatttcatggattgatgattgattggatggtgtggaatctaggaagtatatttttagtacagtcattagttacaatagagctaaccgtgtccagtaaaaccttgtctcagactctaacagcctctaaatgcctttgaaattgtccttttggctaaagatggaaaaaaaatcacagatttcaagtcataaacacacaggtggagtggaatgaagtatctggaaataccttaacctggaagttaagagcagtgggtttagaaaaaagggaaattgtcatctaatactgagacttctgtgaaaggtaacaatgaggagattttgtacatccattaattttatctgctcataccaaacaacctggcagggggtagttactgttagcagaaaggggtcccgatctagaccccaatatagggttcttgcatctcacgcaagaaagaatttggggcaagtccataaagtgaaagcaagtttattaagaaagcaaaggaagaaagaatggctactccgtaggcagagcagcggcatgggctgctcagcagcttatacttatttcttgattctatgctagacaaagggtggattactcatgagttttctgggaaaggggcaggcaattcccaaaactgaagttcttccccttttgggaccatatagggtaactgacattgccatggcgcctgtaaactgtcatgcactggtgggaatatcttttagcaatctaatacattataattagcatataatgagcagtgagaagccagaggtcactcttgtcaccatcttggttttggaaggttttggctggcttctgtaccgcaacctgttttatcagcaaggtctttatgacctgtatcttgtaccaacctcctatctcatcctgtgactaagaatgcctaacctcctgggaatgcagcctactagatctccaccttattttaccaaccccaatgcctctgacattactaattctcatgttccagaagaagaaactgaagttcaagaaagctgtacaaagcccacagcgcacatctgggaatgtctaagaatgaccctccctgccccgcagcagccacaccttagcctgtgctgtaaacatgccgtacaggtgtggggagcacacactacggatggctgttgtctgacattgtggcaattccaaaaaaaggcaaaagcaggaaaacacactattcaactttaaataagcctctttgattttgctgaataataagtagttgtatggaaatgcattaaaattaaacttaccggcaagtagatgtcattaacaatataatagccaccatggcaatcctaaaaaaaagaagcagtggccacttttctgtagtctgtagacagcagtcagccaacagtcactgccctgggctgcccttgatggcattcagagtcatgctttttgttattttcccacaaaaggttagatccccgctatgcatcatgtccagaaaaaccttgtcaaactctcaaagtctctaaatgcctttgaaattgtccttttggttaaagatggaagaaaaaatcacagattccaagttataaatacacaggagaagtggaattaaaatctcataaataatattactggcaattaaaattctttgtgacttatacccagaattctcagagagcttcatgcacacacacacacacacacacacacacacacagtgtccagggtaatttcatatttactcaaaaactgtatgagtatatgcccaaattctaggtagagggggagtcatatattctaaaaatagtggaaattttaaaacttggaaactatttcagctccaagtttaaaatataaaaatatttcctaaacttattttttaaaaacactttattttgaaaaatttcaaacatacacaaaaattacaaaagtagtataatcatacccatacacctttcacctggattcactcatagttaacacttttccccatttactttatctccttcaccaaacatacatatatattttttcttgctgaatcatttgagactcactgacgacattatgacccttcgcaagcacttgagcatgtatctccaaagagttacagtctcttagcccccatacaattactaaatacaattaacattgaaaaatcatattatttaacatgaagtctatatttatatttcagcaatcgtctcaattacatcctttatgcggggtggccgggaggaatgatgcttttcttttttgtttttgtttttttgagatggaatctcactctgtcgcccaggctggagtgcagtggtgcgagctcagctcaccgcaacctccacctcctgggttcaagcgattcttctgcctcagcctcccgagtagctgggactacaggcaggcgccaccatggctatatatatatatatatatatatatatatattttttttttagtagagacagggtttcaccacattgaccaggctggtctcgaactcctgacctcgtgatttgcctgcctcggcctcccaaagtgctgggattacaggcatgaatcactgcgcctggcccagaatgatgcttttctaatccaggctccaatccaggatcacacattgcattcagcggccgcagctgtataatcttttatcaggaaacaatgacattgtgagatttgaagaatatggacaagttgttccatagaatattcttcaattcaggtgtgtctgatgcaagcatacttgtatatacctacagtaggccttttgcaaacccaagactgttacaaaacttaccataaaaatacagcaaggaaagaaagctacatgttatgttcagggactggtctcctgttaaagtgcctccttagatttgcatcaatttttctttaaaattatgactcacaggacttcctgcttttgtatctgccttgttcctctaattgttgtcagccagtcttcaaacaaaaacatcacatttatctatcctgactaactttccaagtcatttcgaaagccataaccctaaaccccacaccttgccttcaccttttggcaatcattgcagagttcctttacttaatttcagttcttt

SEQ ID NO: 31 - DNA, 13740 bp, Homo sapiens
actatttttttcaatttaaggacaacaggaacgtggatctgtctaggtgtggctacaattcctgctccacggcttggccagagcccaaggctgacctgtcctaacacccccattcccttccccatgaccccccatggctggcccatccacttactgttcattctcatagtagagcttgccgatggcccaggcgacgatgatggggaaggggatgcctgaaagaaggaaagacttgggctgcaggggacagatggacagggactttcttgtaggacataccgtggggtaccacaacagggctaggatcatgtttttactcttccaacagcaggccacccacaaccccaggggtgccctgtccctcaacacctggcccatgcccctgcccctctctccaagcagggctgcgtgattttgtgatagagaagtagagccagccagtttctgagccagagacaaaggcctttggacaggtccttcctggcagggggagaagagctatttgaggaatatcctttggagagatcctttgcttgttcctcaccagcatggagggaagtagctgcatccaccggactgcgctgggggtggagggcagggccaggctctggtccttggacccaagacgaagggaaatggcctggtgagaagtcctccccccaactaggccctgctgcccctgggaccctcacaccatccgatgaagaggaagaggcacttgcgcaggcgctcagtggagtaggtcatgacaatggccgtgtgcaggtagcagccttccacaaacatccagaagaagttggtcaccacgaagtagttgaagatggtggtgatgcagcggcaccagacctgtgtgcagggcagagaggctgtcaggaggcagcttggggcccaggtaggacatacccatccccaggcagggcaacaagacacagggctccccaaagggggttcgtggacatgccatcaaataccagcgaacctcactctgaaaagcttcatccttctccagtgctctttcacactttcagattaagttaaggtgccattctccactggggccaacgtgttttttttaacttctctctaactctttctaatttttcattctagtaaagagagcaagagtctggctctgagctttctgtaggcagaggctggaattcaaccatcttgttgtgttttcattttagtttttttgagtcattttcaatccatagcaagtcagacctgcttccttttggggatgggatatggaatttcatttagaaaaaaatgaaaaaataaaagtgagtaaagtgagtcaagggtgtatgaagtggggctgcggccagggaggggattctccaaagactctgggtttgggaacttctggacttggcacaattattactagctctggagggagacttgcaaagtacacggcccccggcaagtcactgcacctctctgaacctcaaaaagtaaccctgccttccagggtggttgaaggagatagaggatggcaaagacaggcatgagggtagctgtgttgtggctgtggttgtgcctgctgtggttccgtgccttcccagcagaggggaatgtgtccctgtccctctgagcaaggccacccttccccaggcaccaaggctaccttcccaaaggaggcagggaggggaagaccctgcccctttagagccacgcagtgggccatggcagggccagggtctagacattgggcttccaggccagagctcctctcaacagaccccacctggtcatcttccccacaggctcatccccagggcaccctgagagccaaggctgggacatggggaatgatggagccagctcaaggtccggggagctgtgcgtcaggggctctgcttctgcacacagcccatcctctctgtctggctctgacagccccagttctcagataaccctcctgtgctgagctgttggctgcttctgggcttccctgcacagtccctgtggctggctgtctccttttttctgagaaagtcctgctgaggtgggaagctaccaagcccctcctcccaaccctacttttcatccagggttgatgatgttctattagcacaagcccacgttggagctagaaggcaccctcaactcgagtgaacctgtttgattctgaggcagtgttctatgtgggaccatgttaaggatcacaccaggctggtgtctgctcaggcacaggccacccaaaggaaatgtactgagaagtctctgtcggtgtgccacagggctctgtgatggcccaagactagtctacagttttacaatagcttggacacagtacacagcaatggacagaaatccagagtggacagttagcatgtgggatagccccttatgtagaggtatcatcactgcatgtgaccttggcgagtcacttaacctctgtgagtctcagtttccatgtctatgtaatggggaaaatgatccctgctggtctcattaggattaagtgagagaaagctcaacagaggttagttctagcttccttttctcaaaggggtctttgagggcacctgaatccacaagatgaggagtggactaggataaatgtgtctagagtcagctttgtgaagctcccagcctggcagcttcctgctcctcccagcccagctctgttgggacaatggctagggtggaggtgagctcaggtctggttttgcacctgagccacagcccagatgacagcattctggccatgggtcagccaaggagcagccagaaagtcagttgtcaccagctgagagtagcagggactggtgaacatcagtctctgtgtgcaaatctccaaggggtctgtctcagagcctggagagagcagaggggatctgttctcagagtgggggcaagaatggggtggagttgcagaagttcaacattaggaagagcttgtaagagtaaaagctgctcaagaagaagagggctgctttagcaggtagtgagcttcctgacaaaggaggggtccaagcagagaccagacagacagatgggtgcccccggagcccagagccccccaggtatagccccgagtctccccgagcaatgacctcattgctctcgtgcacttcatggtcaacgagctgcagcaggaaccacatgacatttcgcaggataaaggtggtgatgaggttccagtgaatcacattccgcagacagcgaatgctcctgtgggaggtgcaggtcaggggtcagccaggttcaggggtcaactgggactgggttccccctgaggccaggtagagactcagcctgggatgagggcagggctgcactaggagccacttcccacccatggtggccacagttgggcctctgagtccagctcccactctgcaccccacatgcctgctggtgattcatgccctggcaccccacccaaaccccactttctccacgggcccttttatctgctgggccccagaatggaggtgagaatgtctgggagaggtgaagggggtgctgtagggggagggatgaggagaaagcaaggcggaagggcagactcaccgcagggccaggaaaagcaggaaggcggccaccagggctgccacagatacgcagtggcccaggtagttgacgacaagggcgatgcggtagtgcaggtcatacttcctctgctggacagacagacatgggcagggcagatggaggcatgggcacgtgggggtggggctgggtattccagccgtggccacctctgtgtcctgaccttgggggcagaagtgctccaggtgtcattgccgtgcctggctcttagggttcgttcctgttggccctgggtggctcttgttgttataaatggctgtggtcaggccttccaacatgcatttatttttatttttttagagatggggtatcactctgttgcccaagctggggtccagtggctattcacaggtgtgatcacagtgcaccgcagccttgatctgcaggcctgaagcaatcctcccacctcagcctctgaagtagctgggactacagacaagtgccactgtgcctggcaccaacatgcatttttgggggcacattttgagaggtatgggtacagattcttttttaaaattctaggctctagaatgcttctcctgagtttagtctcagcccggatcccagctggctgagtgactgagggtgagtcgatttttatttctggacctcagttttgatgtctatacaatggggccaacctgccatcctacctaagaagcaatggcctatgggaggcctggggtggggtgcattgagattagtctgccctggagaccacacgagggggtgcactgtctatagagaatttagaaattctattcaaactgaataaaagtcagttgacttttaattatcaccaagtgttggcaatttgaaacaaagttagtgatgaaatactccttcctgccagggagagccacccctccaccctacccaacccctgtgttgattctccactgctggaggggcagagagagtggaggtgaggaccaagggctggaggcccccctgcccattgagtggcctccctgcagaacccctgtggctcacattttgcagaatcactttctcagggcgggtgaatgtttttccctctcaatttggacttcatctggggcaaagtcccagccccactgaggactatgctgggtaatgaggaggggatggagctgagatgtatcctttcaggtcaggaatgaggcgtagcctcaaggagaggagttcggtgcctcagcagcactgaattgaattccagagcgagagctggagcagggctccagagaggcagagcaggacccagcttctcatggggacagcccttggggggctgcatttgtttccatgtggagtcacagaatcagaatgccagatggggaaactgaggcccagagggagaggaaggtgtgcagtcacacaacccctaagatgttaggagcattgattacacggttattccctttttgtgtcacatgccaccttggctttgtcctctagcagcccaagctctcttgaaggtaggactccatgtcccccttctctactcccctacagtgtcactaagcacagggcaggacactgggggcaggggcaggaggtacagaagggagtgactgggtgacaaaaggactggtctgccccccttgggatcttctctgctcaacctgagtccaaatacctgtgtgaggcctggggtcacagcaggtgagggccactcaccttgtcatccaaaatgggctcacactgtgagtagttgatctttgaggcccacgtcccattctccaagcattctcgataggcattccctacaaaaaatgccaactgccaagagtcaggtcactcccctcctcaagaaccctccctggctccctggtgcccacaggataaggtgtacgcacctcagctctcctagggcagcaaatacaatgtgcatctgaaagtttacatgtaagtcacttatgtgaaaatagcacaaaaggctcatcttacaaaatagctaaaggcatgctaaaacccattttagacacaatctttgactagcattttgtacactttcattttgttcatttgcttcaaaactgaatccaactgtgaggagtgggttgtgcctgaagattcactgctttcagcatgccacataatttacatccttgtctcaattgttttatatttatgaggtccatacttcaccaatatcagcacttccatttttataatagctaccatttatatagcatatgtttcccatgtaccacttcctcttctaactgctatggatatacatgtcaattcaatctccacaaccatcccatgaaggaggcattaatatgaacccatttcaaagaggaggaaactgaggcataaagagattaagctactggccaaggatacaaagatgacaagaggattcaaactcagaagttgtggcttcgggtcttctgttcttaacctttaggccatatcaagtagtggcaaacaggaatgagtgaatgctggggactcagggctgggccaccgccctcgggctgctgctgcctgggaggctaccacgagatgtttctaaatgttcaagaaccagcctctgtatttaagttggaacatgatttaagtgtgaaaagacatttcaagcagcaatgtcctgtgcacaaaagtgcaggttttgtcaagggggaaggtaggaaagttaaaaaatgctcacatttgcctttctctctatctcagctccaactgtcaaggtctggctcctaagccaccccctccatacaccagctccaatcaggaggaagccctcccacctgagaaggcccggagctctcgaagcctgcctctgcttggccttcatcactagtgtgtttctgacctaccgggtgggttacaaatgctgaacgttccattgtttgggggtgatttgtaccagggttcagctctctgactaatgggcagttgtctgtgaatttttctttctagcatatgttagatgtacaatgtaaagctaattaaaataaatagcttgcagagcacagagttgcagagctggagggggaaccttaggttgtttttggaagcagtgtgttctgaaataattaagttacttaaaaacccacttccgttgagcccgatgagttggaagcaatggaattgggaaggagcacttgccgaagagcaaaatcaatggggaagattctattagcttaattgttttttagtttggtgcctggagctcatccattcttcaaacccagggacgtgactggcctattccttcctcctgggccaaggcccatccctggcagggccctgccatccccctgccaagtgagtcagggaatgccctggtctgatgctgattctgactctcaggaagaggaagcctgctccccacccctagccatggcgcccaactccccaggtgggatctaatttgatacctagcactatctttccttaccaacattcgtgctcatgaaagagaaaggttacctcaactcgtgagggtcagtgatagtgatgtcactgaactaaaaaagcaaaagtatgtaaggagggtaagttcttttgtgaaatgaacagtccctccctgatgggggtttacggtgcctctgaacagtctatgtgaggtgaggcagaccaggatcctgcctgtgcttcaaagggcagaaaaatttatcttctatatgttcatagatattatccagctttcctgaagctcagtgctaggccccttccttcaggaagacctccttgattgcttctactctatagctctctctctcctgagcacctccagtcctgaccgcctgagccccacactccagcccttgccccatgaccagcctggagctgtctaggtgagtgagtctggtcactctgatcaatgtgggggctccctgaggacagggccttggaatacttgtttcccgaatatgatatctcatggtggcactgatcatggggtgggcttgcaggtgggagggggtcaggatagaaatgctgcaaatcagagacctttcctctccctcacaccaatgcccatggggtcccaagttccatggattctgtctcctccttttctttttccagagtcaactcccctcctgcccatccctccatctgctctctagtcttcttgcctgggctgctacaacagcctcctctcctcttgcctccctgcttcttttcttgccaccttgaccatgttgatttctgcttaaagccatcagtggctctttattgtgctcaagaataaagtccaatttcttagcatgatagtcaaggcccttgacacccaggtcccagcctaactgtcctgacccatctccagcattctacatggccactggcattggcacacataggtttggcacataccctctttgtgtggatccaccacttaaagcacctcctccttcttacccactgctcacggatgaactcctacccatctttaaccccacactcaaatgccgcctcctgcatggagccatccccgacacccttaggtctgaagcagtcctttctttgtttcctcctctatcccttcccttctcttgtaacgtagtttttccactttattgcccttgaaccacaataacacatacattttatgttataatccagtacacacacacacacacaaacacagaatccagctgtactattttcctttccagcctattctaatgtcttctattcatttcacacacactgatcatgacccactaaattgactccacagtccactcttgtgtcacaatccatagtttgaaaaatacaaattctgttttagtgcatttgccataattcactatgaacttcatctctttggacctaatccttcttttctttgctactggacttgagctccttggggatagacaagtaagtagaagccatattggagccaccatatctccctcaggacagagccattgaggaaatgtcggctgaacagaattgactcagacctgctgacccctgggaaagcaggtgggatgcagaagcgggaggggacttccctctctggcagcccagccctgcctgcagatgagcttctggttacagacactgggtatcaaaggactggaggatagatgtgccccactcttcaggggagctgtctgctgtggccaatgagggcactgggccctcaggcacagcctcggacaggagggagtaagacagaaagaatctcatccaccccgtgggaaacgtagacggatgggcacacactctgagggctgatggcaaggctagaattgtggggctggatgcagagaggtgggtgcccattaccatagcaacacaggtgcccctgctgaggatcagtgctgatgatgtggagtgtgggcttccaggggcattagggtctgaatgatgcaggcagggtcttctcttgcaggactctgtagtctgggaggcctggtttccatgcccagagtggcccaggcctgccaaaaacccccattacaatgggctctccccgtttcagatgctgacactttgcaaagagttcctggttcaggcagttacctggggtggtcctgaagcctggctgggacatgagaccctatattctagctgtagttttgtctctagatagctaggtgaccatgactaagccccttccctcttggtctcagttttgcctcttagaaatattacagtaaattgattctctatgatgttattggcatctcaggtggatcaattatatgttatgtgagactccccagtctactaaatgccagttagcaccctcaagctattgtgacaactccaagcatcctgacatcaccatcaaatggttggcacttctatctctgataccttctggaaagacatggaccataggagacagggaccatgagggactacttttggtggtagttttgggggaaggagtacaagggacaggggtaggcatggggaaaagagttaatgggactgtggtaaggcacaacaatggggtcattggctatttgcaaagaaaaggacaggaagtgagggagaggctggatatggtggctcatgcctgtaatcccaacattttgggagaccaaggcaggtgaattgcttgagcccaagagtttgaaactagcctgagcaacatgatgaaaccccatctctcaaaaaaaaaaaaaaaaaaaaaaatagccaggcgtggtggtgtgcgcctgtagtctcagctactcagaaggctgaagtgagagaattgcttgagcctgggaggcagaggttgtggtgagctgagattgtgccactgcactccagcctgggtgacagagtgagaccctgtgatgatgatgatgatgatgatgatgatgatgatgatgataatgatgatgatgatagaagaagaaggaggatgaagaggaggaggaggaggagaagaagaagaggtagtactagtagtagtagtggtggtgagggagagaaggtgatgacattgaggtggggagggccagaagcaatatttacagaaggaatgaagtcactacatgggatcggaactttcagcaccgcggacagcacaactccattcttcatccctgcctatctctaaggttggggacctcggagagctcctaagaaccagccttcccacccgatattccgaccttggccatgggcccagcccattgaggtcaagctaattcatgccccttttcaaggcccagctccagccccagctcctccaggtagtttccatgactgttccagctccccaagggtccagctgcttgtgactgcctggctcatgctaggctgggattgatctttcactgacccctataaaggtgttgtactttcctaaccagcccaggttctctggagcagaagtttaccttattttgtacaaggctgagagcctctaaaggcatgtcctgggttgctgtcatctctggccttttcttaagcactgcacagagctgagcacacaggatctcaggatggaccaaagctgatgctgtttcctaggttacttgggaactcattgaaggtaggaggctcagagtgggccaggaggacagtctgccaccttgtatgcccatgcttcaccaagatgcatggcaaatacaaaacagtcacacatacatgcaggaggaagcaaggtctcacacaaagacaccatgggtaggctgacccagctgccaaaactgcagacattgcagtccaaccccacatgggggaggggtgtcagtctcaaacagcaaacctgtgggcagcattctccaggttcctggcatgaaagctttgactgttccaagggaagcaagttggaaactgagttatcaggcatctccttgggaattaggaaggaagacaacttctgcatttggtctggtgggaccagaagagagaaactgacacatctggggtcactcaaccatgaagaggcagaagatctctctcccttgggacacgcttcctcacgggagaccctggagttggtgtacctaggagagacagactctccctgtgaccctgtgtttcagcagatgcagccagttatgccacctcttcagtgtcattaccacttggtgtccagatcctcagaagagaataccttaggggccagatatcccaccctcagttccctttactgcctgtagttgggccactccagatccagccatcttcttgtctggcctggggcctagttgagaaatctttgaccatgactttgagtcacctttcttacctactttttttttttttgagatggggtctcactctgtcacccaggttggggggcagtggtgtgatcttagctcactgcagccttgaactcctatactcaagtgatcctcctgcctcagcctcctgagtaatgggactacaggcatgtgccaccatgccatgatcatttgttatttttttgtttgttttgtagaaacggggtctcactatgtggttttggctggtctcaaactcctggcctcaagtgatcctcctgcctcagcctcccaaaatgttgggattgcaggcatgagccaccatgcctggccatctttcttgctttctgtgggaaaaacctctcaatcaatgtctcctcccagcttggcctccacttcctggagtggattgcttttcatccccagttaagagacttttggggaaggtggacagagctggggtggtcagacgtacagtcctagtactaacagcatggttttcctgagcttcccaaacgaggtgcatctccttgagtcagcatcctgcattgcttggaggccactgcaggttaaggaggactgaccaactttgaggcccacctggcatatttctgtcttgatccgatcacagcaaattggtggtcagaggggaacaggcagctggtgatgttcacccaagctcagacccagactgacgtagaagtgctagattgagtttgggagtctaatattgccaaccccagccactgggtgggaaaggcatccccagggccctttgctggtgctgtctgggattcaggccagggaacttggattccatttcttagtgttatatggacacagctctctgagcctcgactgcctgttctggaccttcagagaccctcaactccctatttccacaggacttttcactcatggtgccctgccatccttaagcaggacctgtaagcacacttacaggagacagtggggaaactgagtcatagaggcactgagcagtttaatggagaccatactgggtctatgaaaaagggaagggggagtggaacccagctcactgtgtaagctctgccctccccagagaggggcagtgggaggaggcccctacctcatgctcccgcctctactgtacagggctccctccttccagccatcctagcaacactcagtgggctcgtcgccatgacgccagcctgtggaggaaagtggggaggggaccaacacaggacccctgtggcagaagctgccttggaactgagaaacatcactagaactcatcaagccctccacccacctggtgcagatgaactgaggtctgaagaggggagaccacctgcccaaagggagaaaagcagtcagtaggatggccgggattagatctggctctcagttcctagttcctatgaagtaatgcagggagaagacagctggctggcaggatgccagcagcatccctccaggggggcaaggggctgcctttctctacaggcttttaggtaccagaccttctcaatctagatagacagaatcctccctcccaggacatccccagaagccacagagttctgggggctctcagagatagcaggagaccaccaccccagaatgaggatagccattcttggtgtgagcaggatttcccctacccaaggacatgatggcccctccttccaggccccaggccaccttcaactcccctccccttgctgacaatgccttagctgtctacagggagccccaagcagcatcatctcccctgtgtgccatggccccacgaggtcagcatgttctctgtccccttcacacagataagaaaactgggacttggacaaggagggcctgccagtccctcagtgagtcatggcaaacccaggacttagatccagccctgctaaatctgagcccaggttcctcccactctcccttgccccagctgctctcctggcaggtgctgtgtgtgaaagggaccgcctgcctgactctgaagcacctggtgagggtgggcagtcagaggggcccaaatgcctgtacctggggcccagccaagaagccctgtggggagctccctgaggatcactgagatggggctcctccttcagcccgtcttcagggctccaggctctgctgtggcactggtggtaaggagtgcacagggaaggatgctgggacctctgacttaaggagcaggtgggaggagaggaaagggccaaggcccaggtccccagccagcccttgattgagatttagatggcacattttgaaaagcagtatccttccagagtattctggtcctgtgccatagggctacggacaagcagccgctgtctctaaagccagcagaatcgaggcccatgccctggtccaacatttgaggcctccatgatctggcttattcttccctccctcctcttccacttccgctcccaccctcccttccatctgacacatcattagctcaatttttcaaggcactgttcaacaacacttcctccatgaagtcttccaaatttactttcccttactcttggaataactcccttccatgtgctctgac

SEQ ID NO: 32 - DNA, 4849 bp, Homo sapiens
tattcagaggagtgatattacaactagaaaccactcattagcaaaaggagatgcagtctcaacaagtgtttcttcttcttcttcttcttcttcttcttttttttttttttttttttttttttgacagagtctcgctctgttgcccaggctggagtgcagtggcgggatcttggctcattgcaacctccgcctcccagattcaagcgattctcctgcctcagccccactagcagctgggattacaggcacgtgccaccatgcctggctaatttttgtatttttagtagagacagggtttcgccatgttggccaggctggtctcaaacacctgacctcaggtgatccacctgcctctacctcccaaagtgctgggattacaggtgtgagccaccgcacccggcttcttcttattttatattgagttgaatatttgagtctaacagttttctacatatacttatctttagagacaggatcttgctgtgtcgcccaggctggagtgcagtggtgcaatcatggctcactgcagcctcaagctcctagactcaggttatcccatctcaacctcctaagtagctgggactacaggcgtgagccaccatgcccagctaatcaaaaaaaatttttttggccgggtgtggtggctcacgcctgtaatcccagcactttgggaggctgaggtgggcagatcacctgaggtcgggagttcaagaccagcctgaccaacatggagcaatcccatctctactaaaaatacaaaaattagctgggtgtggtggcgcatgcctgtaatcctagctacttgtgaggctgaggcaggagaatcgcttgaacctggaaggtggaggttgtggcaagccgatatcgtgccattgcactccagcccgggcaacaagagcgaaactccgtctcaaaaaaaaaaaaaatttgtgtggagatggggtcttgctatgttgcccaggctggtctcaaattgctgatctcaagtgatcctcccaccttggcctcccaaagcactgagattacaggagtgagccaccgtacccagccacttttctacacataaaacagaaatatcatgaaggtgcttcatacctgtattacagaggaatttactgtcataagtaccttctaaagatttgacattcagctgggcacagtggctcatgcctataatcccagcactttggaaggctgaggtgggcggatcacctgaggtcaggagttcaagaccagcctggccaaaatggcaaaaccccgtctctactaaaaatacagaaattagccgggcatggtggcgggcgcctgtaatcccagctactcaggaggctgaggcaagagaatcacttgaacccgggaggcgaaggttgcagtgagccaagatcgcaccacagcacaccagcctgggcgacacagaagactccatctcaaaaaaaaaaaaaagatttgacattcaactatagtagctacatgttggttagtttccttataagccccatcatggaaagaattaaagatgaatttgagaaaaatgaaaaaaaacttagacaatcaggttctgttaaattgttacagatatgtcttgcttaaatttctgtttattggccgggcgtggtggctcacgcctgtaatccctgcactttgggaggccgaggcgggcagatcacaaggtcaggagttcaagaccagcctggccaacatggtgaaaccccgtctctactaaaaatacaaaaattagctgggtgtggtggcgcatgcctgtaatctcagctactcgggaggctgaggcaggagaattgcttgaacccaggaggtggaggttgcagtgagccgagattgtgccactgcactccagcctatgtgatagagcgagactctgtctcaaaaaaaaaaaaaaaattctgtttattactttgtaaccacccaatttgtaggaaaaagtttcatctcatgcaatatgtcaaaagtgtgattgcctcgatgtgtaatcaattgtgatggtgaatattaggtgtcgacttgattgaagggtgcctggaaagctggtattgtttccggatgtgtctctgagggtgctgtcagaggagatgaacatttgagtcagtggactaggagaggaagactcacccacagtgtgggcggacaccctccaattggctgccagtgtgactagaacaaagcagacagaagaaggtgggagaagctggcttgctgggtcctctggctttcatctttctcctgtgctggatacttcctgcccttgaacatcacactccaggttttttggcctttggacccttagacttacaccagtggctcgccaggggctctacggcctttggctacagactgaaggctgcactgtgggcttccctactttttttttttttttttttttgagatggaattttgctcttgttcaccaggctggagtgcaatggcacaatcttggttcactgcaacctccgcctcctgggttcaagtgattctcctgcctcagcctcccgagtagctgggattacaggcacctgccaccacgcccagctaatttttttgtatttttagtagagacgggatttcaccaggttgaccaggctggtctcgaactcctgatcttctgatccacccgcctcggcctcccaaaatgctgagattacaggcgtgagccaccaggcctggctgggcttccctacttttgaggctttcggactcggactgagccactattggtttgtttcttcctcagctcgcagacggcctattgtaggactccaccttgtgatcctgaaactccctttcatctagacatagatcctattggttctgtccctctggagagccctgcctagtatgtcaatataccaattacgaataaggtctttgacatgcattttccatactcggtcattaaaatccgaggtgtattttatcttcatagcacacttcaacttgggccaggcacatttcaagtcctcaagtgccacatgtggccggcaaccactgtagtggacagcttaggtctctgaagtcgtctttgattgaagtttaacaaatgctgccggttttcttcctattactcttgctattctcatcatcaccagataagcattgttgttaatccagaacaccagctatggaccaggcatggtgcagagactctgcagatctcctgcgagccagatgatgtgattcccattttcaggatgagaaaactgaggttcagaggttaagcctatcgctcggggtcatgcagcagagatttggcagaaaaggactcccaagaccttgatatctcattccacctttatcatattgtcttgggatatttatttcagcagaaatcctaagaccagaaagcctgggtattcctgggccaagggtctagaaagatggtgacaagttggttctggatcatggtatggggaggaggatggatgttcctaattcatattacagaatgtaaactgatagaagtgtgtgaatataaatatatattacattacacataaatataatagatgatatgttttaccatgattattttatatatactactatgtattggtatgtatcatgtaatagatatagttatatattatgtaggtgtatatattttttaataaaatagctgggcagggcggcttgtgcctgtaatcctagccttgggtggtgggagaatcgcttgaggccaggagttcaagaccagcctgggcaacatagcaagaccctgtctctaaaacaatttagaaaactagcctggtgtggtggtgtgtgcctgcagtcccagctacttgggagggtgaggtgggaggatcgcttgagcccaggaggttgaggctgcagtgagctatgatcacaccataagacccagtctcgaaaggaggccatgaggggaggggaagggaggggaggaaaatgtttataaaccccacagtaagtggcagatactgtgctaagcacttcacatgtattaacaagtattaatttaatccacagaacaactcctggtggagccatcgttagcccaattttacagctgaggaaaccgacatgcacagaagttacgcacattggatcaggccacacagctggtaagtggcagagctgggatatgaaggcagggagaacggatcctagtggccactgggaaggtgcaatatgtactaagacaaatatacttgcatatgttctcactcagcaaacatttattgagggccactatttgcccaggaaacccagatgagcaggaagacacgcgctcggggctggagacgtgcacacccggggaaggaggtgcacaggtgaggagctaggctgttgcagttcaaactggtatgaatgggcaggcaggacgcagaagcggggagagtcatctgccaggaagaggggcccgggaaggtctgggatggctttggatcagaagttcgttggatgtggccgaccgcgggtgcttcgggagcgatgggtgagttgatttggctctctggacttcccagccagcacctccccattgcccgcttcccagcccgcgtcctcagttcctccgcaaagtcagcttcgccgcagcccacctcccacccaggaccggccccaaagcccttctcgattacctcgaaaggatctccggcactgaagtcgaaggagaggatgaggtgaacctcccgcgtcgggggcagcacgagtgggaagggagtgttgatggctaaaccagcatccaccaggtggaggtgcttccggctgctcattatcttgtcccggatgccacctgtggtgcccaggaagaaagaggatcagctgcttctggggactgaaagcaagacttggaaatggaaggcagagagggggatgg

SEQ ID NO: 33 - DNA, 8491 bp, Homo sapiens
ctctttctcctgttgcaagtgttttagtttagttgaagtttcacaatcagtttgtttccatttgtgttttgtctttcagaaattcttcgttgttttagtcttctgccatgaaaatttcttctgcctttccttcggctgtagatttgtgttccccttttttctttcttgagttatttcagtggtgtttttgaagagaaaataaaatataagtgatatatctgccacattgaaccacaagtctccttgggttcgtttacaaatgagaaaacaaaggtccagagaaaagggagacacataaacacacacagacaaaaacttccccaaagtagtatttgtagaataaaccaggatttaaatctcaatccacctggtttcaaaacatgttgtgtgtatgcacacacacacacccaagcagtgtggccaagtgatttaagtaattttgttagaaatgttctaccagagcacatccaggtaaatactgctttttcaatggagatagcttttatgagggtactgttgatcagaatgtgtacagcatgcctgtttgtcagtaccttcaaaacctttgctgtgtccttttgactatcttcaaatccctattgtttgagggtagatttcacttttgaaaatttccagtcatgtggaaccaaatacgttgatctaaaaagaataatgctgttttttttaaatcaaaaactaaaaagtgtacctatgaggaaacttattttcttgaaggacctgtggactggttgagatagttcctgaagaattccaaaaatatttaagcattgacatcactggaataagtgaatgaccgtgtgaggcagttgtttttgtgttctgtgaacataaacattctgggataatttttttttaatcttattaattcacagtaaatcaaaaatattgtataactataaaaatcactattttcgtatgcaacattttcagtacctaaaaagatccatttttcagcttgggcaacatggtgaaaaatgggcaacatgggcaaaaaatacaaaaattagccaggcatggtggtatgcacctgtagtcccagctacttggggagctgagacaggaggatcacttgaacccaaggaggtggaggttgcagtgagccgagatcatgccactacactccagcctgggcgacagtgagaccctgtctccaaaaaaaaaaaaaaaaaaaaatcctttgaagttacatttcatggtttttgtatatttgtttatttatttttagtgattaagatattcacggttcaacattcaaaaaagtttttaaaatatatagtgaaaaatatctttcctggcagtatcgttttttctgtaccttcaaaaattacgtacatagacttccctttttaaaatacaaatagtgtcatactatacacattagctgttctgtatcttagtcactttttcacttaatgttctatggatgtcattctgtatcagtgcataaagagcatctttattctttttttatagctgtacaacttcttacagttgtaccagaatttacttaaccagtagcctgataggcatcttttgctatcacaaagctgtaatgaataatcttatgtagagataatttaccacatgtgacggtatatctgagatacaagttctgaatagaattgctgggtcaaaagatagatattgccaaatagtcctttccagcagttgtttcagcttacaccctaactgataatgtttccatttctgcatatccttgccaatacattgaattatgtactttctcatttttgcccatctgatggttttattcttttaggtatctcaatgtcattttaatctatatttcttttattgtgaattagatcatattttaatgattttataatattcatttatgttcatattctctacctattgtcttactgggtttttatcctattgatttatagaattttttatatgttagaaaaatgagttctttgtctacatcatgttttgaaaaaaataaaacactgtaactgctgtgcagttactgccaaatgtaacacaaaactaaaccagaaacttccttaacaacagctgaagaaaattaactgtgaatatcaaaatcagtagatactaaatcaactgttagaagagtagaatgtgcaaaagccaccctcatggttaagaaaatgctttctacttggtgtacagaaatttttttctatatcctaatcttggaagtgacagaaatttttaaattatttcttaatataaggggggtttttttgtttgttttttgttttgttttgttttgttttgttttgtttgctgggttcagtgtcccttttagctatattttaaatggaggaagtatgatgttgagccctttgcaaagatgataacgaatgttaatagcttgatcgggggatccctagggcttgttttctgcccctacttcagctgcctgtttccagcagaaatgactgtattgtcctgtattacatgtatacttactcatgtttgtgtcacagaaatgaccaaaaatatttcatttattctctggacaaagagagagagcctgtgtatttcctagaagaaatacgtgaagcataccttcacattttttacagaaggcagtttctaaagaaagtcgcaaaaggttgaaatgactttcagaataaaaaccaacttcttttaagcatgcagtctatccaaacaaaacttttttttgacttaaaattttattagtatggggatttttttgtttgtttttgtttgcttagtcaccaaactcagcatatgaatcttattttgaaaatattttatccaacttattttcttaacatttttttcaagactagtaaaattagatactgtgtcctattactgagtcaaataaactatcttgcaaaacttagtattgctagtagacagtggacagccatgtaaattttcttagacttttaaattaattaattttggttataataattaagattagatttcttgaaataagattgaggaattaacatgtaggcagagccaatgggacagttttagataatctttgaccaactttctgatttaaataatgacagaaagtaagtgattatttccctttttttttgttgttttattttgttgtgtttttcagaatcctacagaatttgatttctatatcatttgtcatgatagagatgaggttaatcgaaagctgtaattatatacatttaaaagtaaatgtgtttatgtaacttttatttctcagttatactaaatattgaatatattcacttagaagtgagccttgcatgtattatgtagttaataatgttcagtaactagcattaagtacattttgggaagcatccttaaatctacttattcttcattcattcgaatgagaaattctacctcaataagctttcccttaaaactccaaggctgttttagtttttaaaaaaagattctatttgggctactataacaaaataccactgactaggtggcttaaacaacagaaatttattttctcacaattctggaagcctaaagtagttttggtttcttctgaggcttctttccttggcttggagatggccctcttctctctgggtcaggttatccctctgtctgtattttttttctcctgaactcctcttcttggaaagacactagtcatattggattagggcccactgtaaagacccattttgtcttagttacctttttaaaggccctgtctccaaatatagtcacattctgagataccaggggttaggacttcagcatattaatttggaggggggtacaattcagcccataacaatgatcaattaatatatattcattttagaaatttcaaataaccatcatagaaagaaaagcagcctttaatctcactacctaaagtggacctaaagtgtgcgtgtgtgtgtgtgtgtgtgtgtgtgtgtgtgtgtgtgagatcccagaatttttttatattaatatatatgaaatagtttataaaaacagagtcatcctgaaaataatgttttggaatatgttttcttttttcatttaacagcacattgtcaatatctatgccataattcattaatcagtccctaagtttctggaatttaggttatttataaatttttttctagtataaatagtacagagatgatcataaagctttccaaaaaagcgttacagaaaaacgttctaaaatgcatatactattttcttcaattacaaaacataattcaacttcttttttcatttgggccatcattataagtctcagttcttatactgttattgtacagctatattctaagattagcaactgtagagctgtgttcatttgctgcatggcctcagattctagtttctgttcctgcctctgatagaatgtattttatcttttgctcaccactcttatttcgtggtgatgacactgtgttacttatagcatattctgatatgtgactgaaaagcagataaccaaaattgttaaatttatctttaagataaataatttctgacaaagtcctgagtgattctggataacagtaacctatgtacaaactttaatatcagattttccttgattcagaaatcttttttcactttctcatttacttttttattatgtggtcacactagatagtttaaattgctgaataagtgacctttgtatcattgaagtaatattttaaaggagaaatctcactctccaatatattatttttgaaaataccatcattttatcctccactgagataatgacttcttaccttttcttcttaaatcaggattacctgagctggaattggaagcaattgataaccaatttggacaaccaggaacaggcgatcagattccatggacaaataatacagtgacagctataaatcagagtaaatcagaagagtaagtaatacattttgtattttataaggtatcagataccaacttctaaacagagaactattttttccaaactacatttcagtctacagtggtattttgtgagatattaatagatgtaaatacttactaaaaaaaaaaaaaaaaagtgggcccggtgcagtggctctggcctgtaatcccagcactttgggaggcggaggcaggtggatcacctgaggtcaggagtttgagatcagcctggccaacatggtgaaaccccatctctactaaaaatacaaaaaatttgccaggcgtggtggtgcgcagctgtaatcccagctactcaggaggctgaggcaggagaattgcttgaacccaggaggtggaggttgcagtgagccaagattgcgccattgcactccagcctgggcaacaagagtgaaactctgtctcaaaaaaaaaaaaaaaaaaaaaaaagggtggcggggacaagggaaagacactgaattaaacagatttattgactgcatgaccacaaggctagtatacgttgtaatcaccaagagattgatataatatgtagctattgttttatatttcatgtattactttaattgattaccataatgtatctgggacctatggatgaattggcctcagtacaataattatattgctcttgaacttttagttatattattattttgtccagcatttctcttcgtttggtgcaagaagttataagaaaggaaagtatactttttacatctactcagtgtcacatcttgattagaattgaatttcttactccccgcaggcagccatattccataacgcaggctgcgtctcatacctgccaaccacaggaagactagatagtattgattgtggtttagcgccttaactatgaactgtattcccatttaccttctcaaaggaagaatgcttataattgtattattagtgttattaggattagtattattttgtatatatttctgttttatgtatcagttggtatctatttggattagactgtatatttcctacatgtaatcagtgaataatttgttgcttaatacctagcatatttcatttttccagtttgatttcttttgtaaatggtaatcatgtcatgttaacaatcaaaatgatttgatcatctttaaaagttaatataatatgtactgttttgattgtggttcagttattaacaattaatggcattcataaaaggtaaataaatagaataagtagaataaatctgaatataggctaaatgattttttctcagtttttggctgattttgtttttacttttattaaaagttatttcccctttcttaactgtttggttaattttccaggctatttctggaacataaagaatatgggaacaaagttcaatgactgacaaaagaatgaaaactatattcaagctacataccaaatactcatttaatttctacacattaaacatagaacattccatggcattagaattgccaagcatctcaacagtgaattttctaagaccaaatttgcatctatatatgtatataaagattgaataaattatttgctatgtcagtctgaaactttcttgttttttaatcctgcagccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggtatttattaaagtcaacattatttaactgatggagccctaagaagctagaaaattattttaagcaagattttaaagtattgtacccactatgctttagctgttttataatttacctcttgtgaaacttatcaaaatatatgagttttttttttaagaaaaagtattacagtaattagaattagaaataagtcttagcttttcactatggaacagaatcttacaagctccagccagaatagaatccagatttatagcatcacttctcattttagagcttaatttatccttcattcacgcttgtcttctgccagtatattccatggtattgcaacttccaggttagccttttttacacgatagggtgataaaatcactttagtgcatcttgaccagcatttttaaatggagtagaatagtgtagaatacaaagtatgagaatgcatagcccataaaaagaagtcatgttttgtgaaactcctttcagctgcatacaaacacacacacacacaagcacacgcgcacgcgcgcaattaggtcacaatttatatttcttacagtgggtaatagtgaaaacatttggaaaccataacgctacagctttctgttacatgagctgtggatttttttttcaaataaaagcatgaattttatatctgagatagaaaaatgcctgcttgatccctcctttaagaatctacttcctatagtaagctattaaatgtaaagtttattgattcttaggctttgcaatgaagttttttcccaaaccttttagttttatttcattgatttggagcctttattttaactatattgccatctctttactgagattttaaatatctcagctaatccgttactccatttcaaaagcagcttttataaatgatttctttaggtagtaaacttctggagagcatgaattcagaatgaatatatgatggtgctttctagaaatacggaagcatgttacttattggcagaaatttatttgtaaaatattctggcttcttttctaacaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcaggtaagtgctcttgtttagcagttgatactttttttttttttgagacgaagtctcacctgtcaccaggctagtgtggctagtgtgcagtagtgctatctcagcccactgcaaccgccgcctcccaggttcaagcaattctcctgcctcagactcccgagtagctgggattacaggtgtgtgccaccactcccaggtaatttttatatttttagtaaagacagggtttcaccatattggccaggatggtctcgatctgttgaccttgtgatttgcccacctcggcctcccaaagtgctgggattacaggcgtgagccaccgcaccctgccagcagttgatactttttaaaggtatataccaaatctctctgcaaggcagcccagttgctacaataaaagtgtcaagtccactcccagaactttcatgaaagacttgaagagccatccttcctctcctaggaaagggataagggaccttttcattcaattaaaga

SEQ ID NO: 34 - DNA, 130401 bp, Homo sapiens
tattcatagtgaaccatcccatgtttaatgaaagtcaccaacacaactaagtcaacatgctaaatgtgattcaacctggtctgagcgtacgtttgatgtgaacttatcagcctgaatgtactgcagggttttcttgtattgtgctggggggactatataagctactacacttgctcgatgttgaggtacttcctgtgcacacactaaagttccctgtgtgagtttcccaggtgagaatgtttataacagaataagggctatccaggggggcaggggaggctcacagacatggaagggcttcctcaaagtggtgagcagaggatggatgacaggccaacttatgcatgaagttctttgcataaggcgagcagaacacgtttatgtgggaatctgccaagtagctgtgcataaggttgagatggaatgtccaaagacactttttgagacagggtcttgctctgtcacccaggctggagtgcagtggcacaaccatggctcactgcagccttgacctccagagaccaaatgatcctcccacctcagcctcctaagtagctgggagtacaggtatgtgccaccacacccagctaatttttttttttttttttttttgagacagagtctcactctgtcacccaagctggagtacaatggcacgatctcggctcactgcaaactccacctcctaggttcaagccattctcctgcctcagcctcccaagaagctgggactacaggcatgcatcaccatacccagctaatttttgtatttttagtagagaatggaatgtcgccatgttggccaggctggtctcgaactcctgacctcaagtgatatgcccgcctcggcctcccaaagtgtttttttttttgttttgtttttgttttcatttttgtagagacggtggtctctctatgttgcccagactagtctcaaactcctgggctcaagcaatcctcctgcctaggcctcccaaagtggtgggattacaggcctgagccatcgcacctggcccaagacactttaaattctccttccttctcctggagataattttagattctctagcactattctcatgtaagaactgtacaaatttttattatagtttttagctgagttgttctcaaatataagatctaatgattattatctatagacatagactttatgttattatgtttactcactatttccaatgtttgtcgatgtcagtgaacccattataaattctaaaggtaactgtgtctactgaactctttttgtaaaacacccagagctatgcataaaaatgaaagctataaaaagtactttttaggatgctatttagagcacttaagaaatgtttttctgtttaattttttaacttttaaaaatatataagcaaaatatttttttagctggccatggtggcatacacctgtagtcccagctactcaggaggctgaggcaggaggatcgtttgagcccaagagttcaagtacggcctgggcaacatagcaagagccccgtctcttaaaaaataatttaaaaaaaatttttttatttaaaattaatgagagaggcctctgggaagcttggcctggcctcacgccaggccggcctcttccctttgctgagtttaccttgtatcctctcactggaataaatgacagccacacgtactctatgttgagtcctcctagttaatcaccaaactaggggtggtcttgggaacccccaacccagttaccttaaaaataaaggcagccttaggcagtacaaccagaaatctagtgcctaaatgaaatcctatttttctgtatattgttcaggctgtacctgaaatcccacaattagtgctcagtgtcactaaactacagctgaaggagccaggaatgttttgcctaaacagaaacttagggagacagggaggaattttcttcaaaagttgaataaaaatgtaagcatccacctcacacaacagtgagtttcttctgcctggaactactgaagcagaagctggatgattatcttccaagaatgacaaagaaagattccaatctgggaggttagggtacgtgatctctctaagaccacttccatctttaagatttatgattctgggccgggagcggtggctcacacctgtaatcccagcactttgggaagccgaggcaggaggatcacgaggtcaagagatcaagaccatcctggccaacatggtgaaaccctgtctctacctaaaaatacaaaaattagctgggcgtggtggcatgcgcctgtagtcccagctactcaggaggctgaggcaggagaatcgcttgaacccgggaggcggatgttgcagtgagccgagatcatgccaccgcactccagcctggcgatagagcaagactccatctcacaaaaaaaaaaaaaaagatttatgattctggccgggcgcagtggcccacgcctgtaataccaacactatggggaggccgaagcaggcagatcacttgaggtcaggaattagactagcttggccaacatggcgaaaccccttctctactaaaaatacaaaaattagccaggcttggtggtgcatgcctgtaatcccagctactcaggaggctgaggcaggagaatcgcttgatcccaggaggtggaggttgcagtgagccgagatcacgcctgacttcaaggcacgtaagcaagatacaaacaaatgaaacaggctgggcacagtggctcctatctgtaatcctaaaactttgggaagccaaggaaggaagattgcttgagcccagttcaagaccagcctgggaaacacggcaagaccctgtctctacaaaaaaatttaaattaaaaaaagaaacaggccaggcatggtggctcatacctgtaatccccacacttggggaggccgaggcgggcagatcatgagatcaggagatcgagaccatcctggctaacatggtgaaaccccgtctctactaaaaatacaaaaaaaattagccaggcgtggtggcgggcacctgtggtcccagctacttgggaggctgaggcaggaaaatggtgtgaacctgggaggcggagcttgcagtgagctgagatcgcaccactgcactccagcctgggcgacacagcgagactctgtctcaagaaaaaaaaaaaaaaagaaaccattagaaaatattgaaataccaagacattacaatatgcaagacagtgtacaagagtttagtgaagggaaaaatcagaagttgggaaaaaacttgattgaaaacgtggcattttacccaggcgtgatggctcacattataatcccaaccctttgggaggccaaggcgggtggattgcttgagctcaggagttcaagaccagcctgggcaacgtggtgaaaccccatctctacaaaaaaaaaaaaagattagctgggcatggtggtgcgcgactgtagtcccagctactcagggggctgaggtgggaggatcgcttgagcccagaaggtggaggttgcagagatgttttctgagagatcgttccactccagcctgggcaacagaatgatactctgtttaaaaaaaaaaaaaaaagtgatattttatcttgacacaaagagaaaggcaaactttaaataggtggaaaagggcaaaagagcacataaaagataatgtgcaaaatctcaaagacagaaacgagcacagcactaacgaaagccagtgaaaaaacagccttgtcaaaaggtgtgatttctcaacagttagaaacaagccggctggagaggtaaaatgggactgagtcagagcaggctttgaaattagaatagtttggctcttatgtgataggaaacagtgagccatttcagagtctaggcaagtaaaagatgcaaaaaagagcttaagaacaatctaggggtgggcacggtctcctacttcgatccatcccagcactctgttctgcttacctccacaggcagctcaactgacgtgttaaaagcacttggggtccactgctcagagatactgactttgacattgctaaatgtttttcgtgaagcatggagcaacgaataactacaaaatagagagaatacagatgaatgaatagcaaagagaaacagcattcaataaaatcacaggtataggcccatttcttttattcaattttattttattttatttggtgggcagccacctgaaccaaaatagattcagagaggctctctcaattttatttctttttattttttgagacaggatctcgctctgtcactcaagctagagtgcagttatgatcatagctcactaggcttcacctcctgggctcaagccagcctcccagcccagcctgagtagctgggattacaggggcactctaccacgcccagtgcacctgtcatcttagctacttaggctactcaggctacaaaaatttctgtattttttgcagcgacagagtcttgctatgttgcccaggatggtctcaaactcctgggctcaagcgatcctcccaccacttggcttcccaaattgccaggattataagcatgacactgaacaattttagaattcttcttcttctttttttttttttttttgagacagagtctcgctctgttgcccaggctggagtgcagtgctgtgatctcagctcactgcaaactcagcctcctggattcaagccaattctcctgcctcagcctcccgagtagctgggatcacaggcacgtgccatcacgcccagctgatttttgtatttttaggagagacggggtttcaccatgttggccaggttggtctcgaactcctgacctcaggtgatccacccacctcggcctcccaaagtgctgggattacaggcatgagccaccgtgcctggccaagaattcttctctttaaaaaaaaaaaaaggatgagccaagcacggtggctcacgcctatagtcccagcactttgggaggctgaggtgggaggattgcttgagcccaggagttcaagaccagcctaggcaacataagaagacttcatctctacaaataataataataaaaaataataataagccaggcatggtggctcatggttgtggtcccagctactcaagaggctgaggcgggtagatcatttgatcccgggagttcgaggctgcagtgaaccgtgatcacaccactgcactccagtctgggcgacagggtgagatcccatctcaaataaataaataaataatcattatttctggcgcctttcataaagattaataaacaaaatctactcagcagaaatgtcaaaaaaagctgagtaacaaggtcacttacagcatgcctctaacacccaatggcctgatgtatgctatgttactaagagaaccacttaagatcacctttgttctccagctcctgcttttaacaaatagaggacttctctctccaaacagggtgatgaaaataaacgcctgtaatcccagcactttgggaggccgaggtgggcagattacgaagtcaggagattgagactatcctggctaacacagtgaaaccatctctatttagtagccgggcatggtgacacgcacctgtaatcccagctactcgggaggctgaggcaggagaatagcttgaacccaggaggcggaggttgcagtgagctgaggtcatgccactgcactccagcctgggcgacaaagtgatactccgtctcaaaaaaaaaaaaaaaaagtgagatatgttttttaaaaaaaaaaaagtacaaaataaaaaaaaaaatagatcagggcttctccgcctccacactgttgacatttgcagatgaaacgttctttgttgtggagagctgtcctgtgcatgggaggacgtttagtagcatccctggtctccaccactaactacaagtagcattcctctcccctcatgaccaccaaaactatcttagacaccgccaaatgtcctctggagggcaaaacagccctccagaactacgatattacagctatcaagactacaacagaaggaataactaacattataagtgtatgcccatcagtgcatttgacacttgccatgcaatatctccctcaaaagaaaaaagaaaaaaagcaggagagcagctttggcaacatgcttacctgaagaaagtgagcaggaacactacaacatgatgatggctgaactgggacagcagagaccctctttgaaaaacatttggccaggccatgttcttcctgaccttccttctcacctttgaccttaaggtttggatgagtgatttacatcatttcttccttctggaaagacaaaacacattatggacattattaaacataggcagagtatccaaaaactgtattatttagatttacagtcaccatataatcaggccttgtgggaaaaaaatcttatggcctagttgacaccagaaaactggattagtaattatgttaaagctattaggtagttcttaaaaaaaaaaaaaaaatcctggacaaaagattatatcttaatagaaagagctcatacaaactgataagaaaatcactcattcttatagaaaaaatgagcaaaggaaatagacaactcagaagaaatgaaatggctattaaacttgagaaataaaagttcaatcccactagtaatattagaaatgtaattaaggcaagaaagcgtttggatagttaaagaagattgtgctcaatgcagctcagggtataatggttcctgaactcccatatgctactgaaagaagtaaaaattagtataatatcataggaggacaatctagccatgttcatcaagagtgtttgacacaaaaattcaatttctgggctgctctctctatgcagtagctgcccttttattcctttacttttgaataagcttgctttcacttaaaaaaaaaaaaaagaatttccagggatctattccttaaaaaatacagatgtgtttaggcctataaacaaaagtatttttcacaaagtgttggaggagatttttaatattaaaagaaagaaggagctgggcacaatggctcacacctgtagtaccccagctactggagaggctgagacaggaagatcccttgagtccaggagttcgaggttacagtgagctatgatcacgccactgcagtcaaccctgggcaacaaagtgagacccctgactctaagcaaaacaaaacaaaatgattaaatacaatgttctaaatgatcttctattgccttgaggtgaggtcccactgcaagactctgggcaagctgcctaacccctgtctgccccccagtatctccccaaaatgaaaaaatttgtgtcaaagaaacagagaaagaggtcaggccaccccttgccatctccttccactacttccagtggctttttttttaatttttgagacagggtctcactctgtcacccaggctggcatacagtggcacgatctcgactcactgcaacctccgcttcccaggctcaagcgattctccagcttcagcctcccaagtagctgggactataagcatgagccgccatgcctggctaatgtttatattttttgtggaaacatggtttcatcatgttgcccaggctggtctcgaactcctgagctcaaagtgatctgcccaccttgacctccaaaagtgctgggattacaggcataaggcactgtgcctggccccaatgccttttcatttgactgtactctctaaaagctgcacccatgctctgatatccaagaacaattacgcataaagtaagcagctaaacttaatgtctccagttatgagtctgcagaaccaatccaaatatacaacaataggggaataattaaataaattatggtatgtctgaatggctgaatcatttataatcatttgtcacgaagactttttaatgacatgagaaaatgtcaagtgaaaaaaagtgggagccggttataaatctaattaactgtgttcacataatacttacaaataaatagggaatatagtagttctctccgggtagtgaaatgatggataattttaattttcttctatatactttcttaaaaagcctataataaacatctatataatttttataatggaagggaaacacccacagcattagaaaagtactatattttaggctgggcatgttggctcatgcctgtaatccccacactttggtaggccaaggtgggaggaacacttaagtccaagagtttgagaacagcctgggcaacatagtgagaccccatctctacaaaaactaaaaaaaaaaaacaacagccaagcgtggtggctcatgtctatggtcccagctactcaggaggctaaggcaggaggattgcttgagcccaggggttcaaggaggcagggagctatgatcgcaccattgcactccagcctgtaccacagggtaagaccttgcctgccccccgccgcaccaaaaaaagtaatgtaatttatcctcatattcaagggaaaaaatccacaaaatggcttgtatgataaatctacaacagtagtcaaggtagggaacacattcaagagctccaatactcaagaaagaatcacagggcttggctctcagatctatgttcactggaactgttacactacttattttcactagccacagctcaacagatgcacccaaaccttaaagactaagagacccagcagaaaggccattcttgcaacttgtagataaaagaaacaaagttgaggtggttacaattatgtacacatgacagttgttttccttactagctgttagcccctgggacaagccatgctctataaatcataagtggtcatccataaaatggcttatttcatttgagagttgtaaggctaaaagtaacaatgtatgtgacatattcagataattatattagccactgatctgccaaggattaattccaaatcagtagaatttagctaatttcattttaaagtcattcttcttgggaaatgttaataaaattacatgcagagtaggactataaaattccactcacaaaatgtaaataaacttcctgtctgtaattccaggaagttacaaaaacaagaactactagtgttatgactaaatttacttccatcctgaaaattaaacatgaaacccaagtggaaaaactcaaaactttaatcattctctatgaatcgtagctctttgaactggacaccttcccacctcaaaacactgtagtatgtactccaggaaagggcatgggatatgaaattcaatgatgtatcatgtaaaatcataattccaaaaataaatgctccaacagattgaaattacagtacattggcaatagagctgcataacctagggctgtacagttatattaatagctttaaaaaactaccaagacatttgaggccatttggatgtagtttctaaatagaccatcttttcctaagctataatgattggggagaaaaggcttaataagcacattggaaaagtaggctttattttcttctttcttttatttatttatttctgagacagagtctggctctgttgcccaggctggaatgcagtggcacgatctcggcccactgcaacctccaactcccaggttcaagagattctcctgcctcagcctctcgagtagctggcattgcaggcgcccgccatcatgcctggctaatttttgtatttttagtagagacggggtttcaccatgttggccaggctggtctcgaactcctaacctcagatgatccacccaccttggcctcccaaagtgctggcatcacaggtgtgagccaccatgcctggccttatttatttatttatttatttattgagacaaggtttcactttgtcacccagactggagtgcagtggcacaacctcagctcactgcagccttgacctctcaggctcaagcaattctttgggaatacaggcgcacatgccaccacatccagcttattttttgtatttatgttaagtcagggttttgccatgttgtccaggctggtcttgaattcctggcctcggggaatccttccgcctcagccttccaaagtgctgagactacaagcgtgagccacctcgcccaggaaaatagttttaaacattcacctgctgtgtgcataatgacatttaagacgaatactacgacatttggtcctatgcaattacaataataataataataataataataataccttgcacatgtatcctatctatcacagaagtgatttccaatcatccatgagctcagggaccctggggtgtacaggagtttttgtcaagtctgagtccatcaagcacatcctactttttgaagaatactctctttaccactctaaatacacactgaacaaatgtgtaacatttttcaagtatgtgtaaatgctgttataattaataaaaccaaatttcaaaaccaaatttcatttcagtgtttctgaattcactgtagcttgtcatttagtattttctcaatcggtgaatttttattttttaaagcctacagcacccggtattcccaggcagtgtcccacccaagcactaaccagaccccaccatacctagcttccaaagtcagacaaggcaggccatgttcagggtggtatgcaggtatggttgtagactctattaatgaatactgaatacacaattatcaaccgatatttgtcagcaacaagaattttaacattatagtatttttaattgacaaatacaattatatatatttatcatgtacaacacattttaaaatatgtgcacattgtggaatgactcaatcaagctagttaataaatccattacctcactacttattttttatggtgagaaaacttaaaatctactcttttagcaattttcaaaatcgagtacattgtcattaactatagtcaccggtagggcacagtggctcacagtggctcacaggcctgtaatatcagcaatttgggaggccgaggcgggtggattgctggagttcaggagtctcagaccagcctgggcaacacagcaaaaccccatctctacaaaaaaatacaaaaatattagccaggtcgggtgcagtgactcacacctgtaatcccagccctttgggaggccaaggcaggtggatcacttgaggtcaggagttcgagaccagcctggccaatgtggcgaaaccccatctctactaaaaatacaaaaaattagccgggcgtggtgatgcacgcctgtaatcccagctactcgggaggttgaggcacgaaaatcacttgaacctagaaggtggaggctgcggtgagctgaaatcacgccactgcactccagcctgggcaaaagactgagactccatctaaataaatatatatattatataaatataaatatatatattatataaatataaatatattatatataaatatattatatatattatataaatataaatatactatatatattatataaatatactatatattatataaatataaatatattatatatattatacataaatataaatatattatatatattatacataaatataaatatattatatatattatatataaacatatatatattagtcgggtgtgatggcacaagcctatagtcccagccactccagagactgagatgggaggatcacctgggagttagaggctcagtgagccgtgattgtgccactgcactccagcctgggtgacagagtgagggcctgtctcaaaaaagcaaaacctatagtcaccatattgtacaatagatctcttcaacttattcctcctaactgaaattttgtatcctttggccaacatctccccaaacccccattagaattattttaaaagacaaaaaaaaaatccttgttaaaaataagattctggacagacatggtggctcatgcctgaaattccagtaatttgggaggtcgaggtgggaggactacttgagcccaggagtttgagaccagcctgggaaacatggcaaaaccccgtttccagaaaaaatacaaaaagtagccaggtgtggtggtgcgtgcctgtagtcccagctactcaggaggctgagatgggagaatcacttgagcctgggaggtagcggtttcagtgagccgagattgtgccactgcattccagcctgcacgacagagtgagaccctgtaccaaaaaaaagagaaaggattcctttgcttccattctctccagaaaaaaaaaaaaatactggcaagattcttgccatcaaataaaatccagaaaaccattggccaggcatggtggctcacgtctggaatcccagcactttgggaggctgagacaggaggatcacgaagtcaggggttcgagaccagcctggccaacatggcgaaaccccgtctctaccaaaaatacaaaaattagttgggcgtggtagcgggcgcttgtaatcccagctactcaggaggctgaggcaggagaatcgcttgaacctgagaggcagaggttgcagtgccaagatcatgccactgcactccagcctgggcaacaagagcaagactccatctttaaaaaaaaaaaatccagaaccattaagccatcttctactttccaaagcaagttcacaatcactaacttgtgatttttatagtgaagtttttcttagtcctagaagactacccattaaaaatggtaatttccagaatggaacacaatagtgaaaccgcctttgcaaaactataactgaggaaattatgacagtgaaagaaatcagaactaactggctctagcttgcttttaacccttaaggaaggtccttgttcattcctgggcataggctgaactaactttaggaaggaattcagttcatggtttgacactgaaacaaaactgataacagacccccttcttgcctggggtccagtctgcctctgcaggactaacgaattagctacaagattagaaattacaatttaggggtcatgcaacctctggggtctgaacctccccaaattgctcctggggataacatcactattgtaaaacctaagatcagtgctggagatattttgtagaccctgcactcgatagatcagccgacaccacccagaccggtaatctggctcaaccagctctgccatcccaccagggaacagaagacagagagaaagactcacttcagcccccagtgactccttctccaacctgaccaatcagcactccctacttcccaagcccctacccgccaaattatttttaaaaactctgatccccgactgctcggggagactgatttgagtaataataaaactcccatctcctgcaaagccggctctgtgagaaccactgttttgccattgcagttcccctgtcttgataaattggctctgtctaggcagcaggcaaggtgaacccactgggcggttacaatagtgcgcaatcactgctaagtaaaagatgacttcgcactgcagcaacacgtccaggtggaaggcaacgctgccttctacaacgctgctttgggatataaaatttcccccaattattatttctaatttcactttctatagtggtatttagagtcctttccaacccaaattcaaagctgttcttcagaggccaaggcaagaggatcatttgaggccagtagttcaatatcagcctgggcaacagaccccgtctctacaacaaatttaaaatttcgccagatggggtggcatgcactgtagtcctagctactggggaggctgaggcaggaggatcacttgaggccaggccttcaaggctacagtgagctatgatgatgccaccacagtcctgcctaggtgacagaggaaaatcctgcctcaaaaaacaaaacaaaacaaaaaaacccaactgtctcgtattaggaactctctgaagaaagtctactgcagagtgggcaggggagtggtcagcagtaaaagagatgacatacatgaagctaccacatacccactctgccccattcatctcatctgcccagtcttcccacacaccccacccccagcccttttgaccatgctctctggaaacagagatacacggttagcaagcctcgtatctttcctctctagaaacctagttacatggttagcaggcactatatcctcacaagactccgggtgctccctataccttcacttcccctaaggcctttcaagaggtgcaatcttccctcccccaacctacatgcctcaaggacacaagcgttccatgttctctttgttccccaaggccgtttctgggccgctctcttcttgccaagaccccagcttctttgaaactcacaccttggggctctatagcctgctgttccccatagatgtcagggactgatctccctcgcactcccgtcccatggtcacccaacctccatccccaccgccaggtggataagctccctcctgggccttttcagttccggttctcttcaccaccacccttctcctccatcccccaataaaaacccacacaaggctgaagcctggtagctggatttcaaatcttctacttcctttccttgcagatcacttacctgaatataccacacctcaacagtcatctgacctcaacaaggctcccaattcagtagccttgtttttccctcatccatccccctcctgtcctcatttcctgccttaccaacttagaatctacagtgcccttccttgtctctgtcctcctccttccctgcaccaaagcagctgagttttgccacagaaaaatcactcaagcaggctgatttcactttttagattcaaaaccacaaacctcaaagggcatgcaacactgcccagcaagcctaccacacttcccagtaattttgctttctcaacctgtgacagcgatttcacacttctctttttaaacttccaacatctttctctcctccttcctctggtatcatacctttatgtcaacaattcccagattcatggctctaacttagaccctccaggatccaaatgaccaattaatatccctccaaaatctaaaacagaactcttaggccaggcacagtggctcatgcctgtaatcccagcactttgggaggccaaggcaggaagatcacttgagatcaggagctcgaggctagcctggccaacatagtgaaactctgtctctactaaaaatacaaaaattagccggttgtggcggcgtgtgccttgtaatcccagctacttgggaggctgaggcaggagaatcacttaaaaccgggaggcagaggttgcagtgagccgagatcaggccactgcactccggtctgggcgacagagtgagactccatttcaaaaaattaaacaataagataaaacacaactcttcatttctccctccaaatctatccctcccctgtggagttctaattagagaaaaaggagtcaggctggtgggatcaggggaaactaaaaagaataagcagataaactataagtctgcctttcttcgtggtccaggacatatacccctcctgagcaagtaactcacaatcttcctgcacccagtaatcaccagacactcagctgatagaaaaatgcaagttagctcaatgcaaccttattgttatctgtactgcacaaagccctcttcagcacacagcaccatcctataaaatctccagcaagcttttatctccttgcagtcagctcctctcttgctgacctgcctgttgcttccttgcaaacatactctcagaccttctctaataaatctgcctttctatacctataactgtcttggtaaattcttctcactgcctacaccaccagcccagatagtcactgatcacctgcaacattttggtggcctgtatggggaactctccttacggaaaaccctctcccctccctttctctttcccaacttggaactctcagtggacagcatctaagcaggaagataactgaaggtcctggctggagctatactccagtgggactgaaaggtgtccgtgtaacctccaccagcccagatagtcgctaaccacctgcaacaacccttggtattccctatctcagcaaaggtactgccattccttatagtcaaccaaggtaactatgaggtagcctttacttcttttcccttaacttctacatccaacccattactaaatccagtccttttcacctccaaaatatatcccaaatcccagcctccagatggataagctcactccccagcctctcggttctggtcctcttcaccgccaccctcttctctccatcctcactgccaccgccctaagataaaccaccagcagcatctcctacctgcctaccttgacagcttctgcttaaaaccctttactgccttcccaagactgagacaaaaagacagattctttgccacagcctttaaagcctgtctaacctctgcaggtaaataggacgcttagggctggggagggacagggctgacagatgggttggtacagatggaggaggagcctgcctgagccaatatctaaactgcagaggttgggttttgttttatttcattacttttcaactggtattatatgcctaaggtataaatcaaaagatatggctgggtgcagtggctcacacctgtaatctcagcattttgggaggctgaggtgggcggatcacctgaggtcaggagtttgagaccagccgggccaacatgatgaaactatgtctctactaaaaatacaaaaattatccagaagcagtggcatgcgcctgtaatcccagctactcaggaggctgaagcaggagaatcgcttgaacccaggaggtggaggttgcagtgagctgagatcgcgccactgtactccagcctgggtgacagagcaagactccgtcccaaaaaaaaaactcaaaggatacaacttcctcctgtgtcctcagtccaccctgatctcctaaccagtttctttcacatcttctctctttccttcaggggcacaatctgtgcctctgcacacataccaggcagagcccccaagatcacacatgcaagcacacagcacacactatctgttgtgcattttcttcacttgccagaggttggaggtccatccatatcagcacctgcagagctgaacacgtgcgccgtcctcactgacatgaaggaatctttagatatttaaccaggcccccactgggcagctgggtggttcccaatcctttgccaggccgcctggtgaggatctagcttgtctcctttctactgtgcccacctacctcccaccctcaccaacaccaactccccacaccaaatccctctcctgtccctgaacccatcaagcctcctcttgcttcgggctttgtgtttgttcttccacgagaggagtgtttttgtcctgcttcttggcaaatggcttgctccttccttttcttggctagtcaatgaaatgtcaccccctagagtgagctccctgataaccctatctaaaatggtctcccctggttactacctctctcatctctttcgccatttctttccttcagagcatctctcccagttatctggtttaattgtttccatgtctactgttcatctgtaagctccataaaagcagtggctctctgtgtcctgagtctcacagccacatccacaggacccagcagagcactgagaacgatcaataaagattttttgggccgggcgcgatggctcacacttgtaatctcaacagtttgggaggccaaggcagacagacggcttgagcccacgagttcgggaccagcctgagcaatatggtgaaaccctgtctctacaaaaaatacaaaaatcagcggggcatgctggtgcacacctgtagtcccagctactcgagaggtggaggcgggaggatcgcttgaacccggtaggtggagactgaagtgagccaaggttgcaccattgcactccagcctgggcaacagagtgagaccccatatcaaaaaaaaaagtttttttttgaatcaatgaattggttgactgacagcagaacactgaatgcttacaaagtactaggcaccatgctaggtacctaccatgcattactgcatttagttctctcaatgttttacagatgagaaaacagatattagaaagtaatctctaggtctggtccagtggctcacgcctataatcccagcactttgggaggccaaggtgggaggatcacttaagctcaagagtttaagaccaaccttggcaacatagggagacctcattcatctctacaaaaaatacaaaaatcagccagttgtggtggcggacacctgtggccctatctacttgggaggctgaggtgggaggatcacttgagcctgggaggctgaggcagcagtgagccatgactgcaccactgcactccagcctgggcgacagagcgagactccatctgaaaaaaaaacagggtctcgctctgtcgcccaggctggagggcagtggcgtgatcttggcttactgcaacctccgcctcccaggttcatgcgattcttctgcctcagcctcttgagtagctgggactacaggcatgcaccaccacgtccagctaatttttgtatttttagtagagacagggtttcaccatattggcaaggctggtctcgaacccctgacctcgtgatccgcctgcctcagcctcccaaagtgctgggattacaggtgtgagctactgtgcccagccctcataaaattttttaaaaaagaaagcaatctctctcaaacgatggagtgcacattccaactcagatctaattctagatcctatgttatatcatttaagggtaaaggttaaaatagaaaatactccaagctggataaaatacaatagttagaactatcacacccttcatgcattaaaaaagagctataaagccgggcacagtggctcatgcctgtaacctgaacactttgggaggccaaggcaggtggatcacgaggttaggagttcaagaccagcctggccaaaatggtgaaaccccgtctctactaaaaatataaaaattagccaggtgtggtggtgggcacctataatcccagctgcttgggaggctgaggcagagaactgcttgaacccgggaggcggaggctgcagtgagctgagatggtgccactgcactccagccttggtgacaaagcgagactccatctcaaattaaaaaaaaaaaaaaaaaaaaaaaagagctataaaaaaataaaaataggctgggtgcggtggctcacacctgtaatcccagcactttgggaggccaaggcaggtggatcatttgaggtcaggagttctagaccaccctggcgaatatggcgaaaccctgtctctactaaaaacacaaaaattggccaggtgtggtggtgggtgcctgtaatcccagctacttgggaggctgaaacaggagaattgcttgaacccaggaggcggaggttgcagtgaaccgagatccccctactgctctccaacctgggcaacagagcaagactctgtctcaaaaaataaataaataaataaataaaagaactagcacacctaaactcagaggtatataccaaggatggggaaaaaaaacatcttactggtaagagtggttctcttacacactcaaaggagaggggcattagatgggcaattactcacctcccagacttcagtttttatgtctgcacagtaaaaagattatgtgttttcaaagtgtaaagaagaatgtgggaaattattaaatgtatagttgagttcaccatttttacagtattgtatatgttgcagtttagcgtctcaatgctcacactcatacaactatctttttttttttttcagagacagggtctcactctgttacccaggctggagtgcagtggcgtgatcatagttcactgcagcctcaatctccttcctaggtttaagcgatcctcctgcctcagcctccaaagttgctgggactacaggtgggcaccatcacacctggctaattttcttagtttttgtagaaacagggtcttgctatgttaaccagtctggtcttaaattcctggccttaagagatagatcctcctgcctcagcctcccaaagccctaggattatgggcatgagccactgcacccagccacaagtatcttttttatcccacattatctcatacgaagccatttacttgaacctcataaatcctttttattcattaattcatccgtcttcctgtaatttttatctcttcttaaattatctcattaccacaggcataaaatacttggcatttatctgtaaatatctctcattttattccagggtttccaaaaccacattcttcctccctgtttttggacatgttccaaagacaactagttttcaagataaaaatctttccctcttctaccaaaggatttataatcaagttaatggtcactgcagtgacatgacattaacactgatgaacagagcacaaatcagaaccttaaacaatgaacaaggcagttgatcctgacagctagaaagcagcaagatactgttgacttaacttttataaaagtattgtttccgggtcaccttcttaggcagagactcgaaatcaaacactaatagaagaatggtgtcattcaagagacaagccaggtatggaatctaagaccctccacttaaaagtagcttctctgaatctcaatttctgtttttttttttgtttttttttttttgacagagtctgaggccgggcgcagtggctcacgcctgtaattacagcgctttgggaggccaaggcaggcggaccacgaggtcaggagatccagatcatcatggccaatatggtgaaaccccgtccctactaaaaatccaaaaattagcctggcgtggtggcgggcgcctgtagtcccagctactcgggaggctgaggcaggagaatcacttgaacccgggaggcggaggttgcagtgagccgagatggtgccacggcactccagcctgggcgacaagaacaaaaactcagtctcaaaaaaaaaaaagacagagtctggctctgtcacccaggctggagtgcagtggtgtgatctcggctcactgcaacctccgcctcccaggttcaagcgattctcctgcctcagcctcccgagtagctgggattacaggcatgcgccacgacgcccagctaatctttgtatttttagtagagacggggtttcaccatgttggccaggctggtcttgaactcctgacctcaaggaatccacaggcctcggcctcccaaagtgctgggattacaggcatgagacaccgcgcccaacccgaagctcaatttcctcatgtattaattaaatgagataatttatatggagttcttagtatagagcctagtatccaagaaacatcaaacaaactgaaaagaaatcatttaagcaccaaagcactgaagacattcccttcaacaactgttatatatatttatgtatgtataaatttgtgtaaaggtagaaataaaccggtggacaaaaagataacaactgaatgattttgctcaccccaggaaccactcctccctataaactataaacttttcagtaagagttaccacgagatagcctaccatcttacatttcaaaaaaacactaaaaactccggggacacattcccattatctcctgtcaaaactgagaataaacagaacacaccctgcgaagaataaggagggaatgacgaataatttgaccaaattccttgactgagttcatgctagttaccagaaaacaaaaccagtcactcactgagaccacgcttcttctctgacctctatacatcctttccaaagagcttccttccccacctacctgaaaagcatcccctctcccctggtccgaacgacaagcccttttctgatcaagtcagaatctcccagacccacggccggaggacaggcgggcgaggagcacaaaagcctctgccgcatggatcggggccgggccgcagggtcccccgggggtccttctcctccccatccaccccatcgcagcctccccgtgacggccgggaccccaggcccgggcccagggaggagaaggagggggcgagcggccgaccctgcctgggcgccccacccaaggggggccgccacctacatctccccaccgccctcccgacccgggaagcccctcggattggacccgcccccgccccagcaggtcttcggccccacgcatcaccgcttgcgcacccgagatccgcagtggtcgccgctctccagccccggctccgctcgccgggtcagcttggctccgctgcccgcctcccccgccgccagctcacccctggcggtgcgaccagggtttccggacgcccacgtgaccctcccgtcgcggggcacgctgggagttgtagtcccgccacgcggcctcacctgccggcgcggaggagggcgaggagggcggaggctgggagcccacagaactctgctgctgcggacctggccagtaatgttagctgcaaaagacgagaggtagagagaagaaatgatatggggagaactggtgcatcctttttttttttttttttttttttttttcaaaaaagcggtattcggtctttgtttttataaaaagtaacgtgctgctaagtgtgctactgaccggcctaaattttaggtgtctaattaaatgcaggccgggcacagtgggctcacgcctgtaatccaacactttaggaggtcgagaagggaggatcacttgaacccagtagttcaagaccagccttagcaacatagccagaccccatctctacaaaaaatgttaaaattagccaggagtagtggcatgtgcctgtggtccctgctactggggcgaccgaggtgcgaggatcgcttgagcccaaaagtttgaggctggcagctgtgattgctccactgcaccagcctgggcaacagaacgagaccctgcctccaaaaaaaaaaaatccaacacaagtgtctcacacctgtaatcctaacactttgggaggccgaagtaggagcatcatttgagaacaagagtttgagaccagcctgggcaaggtagtgagagccgccccccatccaccaccaccaccgccgccaccgtttcttaaataaagggaaaaaatacagacacttgttcgaattttaaagaaaaaaaacttctcttaatccagaaaatctccacaacaaccattacatacctgttctcaagataaacaatcactagtcttcaaataacagaacttgacaacaccttttgtcaaacatagttcctccttacttaatagtagtaattggggagaccactcatgttggctttatccagaagcaaaacaaacttcgcataactttttgttgttgttgttcgttttttaaacttcgcatatctttttgtttgtttgttttttgtttttgagacggagtcttgctctgttacccaggctggagtgcagtggcgtgatctcagctcactgcaagctccgcctcccgggttcaagggattctcctgcctcagcctcccgaatagctgggactacaggcgcccgccaccacgcctggctaatttttttgtatttttagtagagacggggtttcaccgtgttagccaggatggtctcgatctcctgacctcgtgatctgccctccttggcctcccaaagttctagcattacaggtgtgagccaccgcagccggccaaagttcgcatatctttatagcaggaggtagttttacaaattggagcaaggcgcccatacccactaatttagtctcttaccctcatgtaggaactggaagatacaggcactaactcacgtctgaatttcaaaaagatgacccccaagtccttgaggatacatttctgagttgtgatactggcaagaggctcatttcgccgttataaagatttgtgtacattcgaaaaggacagagaaagaaattttgaaggaacagagagaaggctgagaagtctctttattttcagcagaggaattaagcctgttatttttcatttttatttgcccttatacagtggtagttttgtttctagcccttatacagtggtagttttgtctctaggcatccaaggagaaatatgatgtcagggtgagcaaaaataaatgagccaaatatgttacttttatttttaaaaatatattgtgaatcgtttatttttcagcctaaaaaaggtagcaaattctgacacatactacaacatagacgaaccttcaaaaacattatgctaagtgaaataagtcagacataaaaggaccagtacagtacagttccacttatatgaggtagccagagtagtgaaattcatagagtcagaaagtagcatggtggttgcccatggctggagggaaggggaaatgagaaattgttgtttaatggctatggagtttccgtttgggatgccaaaaaagtcctggagatggatggtgatgttggttgcacaacaatgtatttaatgccattgaattgtacacttaaaaacggttaaaatggtaaatatatatacatagagtgaaatacatagttttttgtgttatatttacatatgggtgtatacatatatatgtgtgtgtgtatacttcaagtatataacctgtgtcaccaccactcagggctagaatgccttcttagccatgtggtggtgtgtatctttaatcccagctactagggaggttgaggtaggaggatcacttcagccgcacctttggaggctgcagtgagctatgatcgtaccactgtgctccagcctgggtgacagagggagacccagtctcttaaaaaagaaaaaacagtgtatatatacacacacatttatacatatgaatgccttctttcctgtagcccaagctatgctctttgtatttatagtgaccttggtggagagggttgggtggtagacagaggtaagatctctctccccttgacttccaaaaccatcaggatatttaaatatttgtaacatttgttttctacctgtagatgttctccaagtgctcagtgggtctgagtcaggtgactttttttttaaacagtaaccaccccaggtgcggtggctcacccctataatcccagcactttggaaggccgaggcaagtggatcacctgaggtcaggagttccagaccagcctggccaacatagtgaaaccccatctctactaaaaatacaaaaattagctggacgtggtggcgggtgcctgtaatcccaactactcgggaggctgaggcaggagaatcgcttgaacccgggaggtggaggttgcagtgagccaagatcgcaccattgcactcgagcctgagtgacaaaagctaaaccttatctcaggaaaaaaaaaaaaaaagtaaccattaccagaagaaagacaacatttggacactgaacttcatgacactgacacctaacaggttttatttcctgatcacacatttggggcgaatctttacctacactggatttccacattgtgctggtggttctcaccctgcagcaatatttggcagagtcttttgttttcttgctatacctgccagtgttgagtttatctcactcagaagagagtatcctgaaaatggatatgtaactggaattttgggtaagacaaatattttcaaatttatctgaagacatcatagaagtaatgttcttggacagtgaataaattgccctgtatttcagtgcttctcaaacgttgcggaccccagcctacagttaaaaagacatttcaggccaggcacggtggcccacgcctgttatcccagcaccttgggaggctgatgtgggaggattgcttgatcccaggagttcgagaccagtctgggtaacaaagtgaggccctggctctacaaaaaaatgaaataaatagctgggcatgatggtgcacacctgtagtcccagatatacaggaggctaaggcaggaagattgcttgagcccaggaggttgaggccgcagtgagccatgacggtgccactgcacttcagcctgggagacaaagtgagaccctgtctcaaaaaaaacattttttttttacatcaccctgtaaaatatgcatgtgtacaactgacccaaacattttgcaaaacagtagtcactgttactacacaagatacattctgaagttgtttcttaatcccttcttgtgaaaatgctggttgcaacccacaaaggttgatttcatgactcatttataggtctcagcccacagtttggaaacaggacaccgatgtaaatattttatccaacagggtgtctctgtttcaattttgcttattgtgtctataatgccatttaactgcctacatatcacatcctatgtagtggagaaaatctggtccctgtgatagacattgggaggcagttactgttctagactctggggaaaaaatagtaaggaaaattcacctcagctttatgcttctactgccagcatctgggactgataaacttgaggttttctggacgtcaacctttgctctatggtagaatttttgagggagtgaggcagacattttcttttcagctttttcttctcatataccttcaaagttcttttagttttgtttttgcttccttctctttgcatcatctcctttctctgactcctcacaaagagatattcagatctacaaaacaaagacttaaattacttacaatctggccaggtacggtggtttcatgccttgtaatcccagcacttcgggaagccaaggcaggaggatcacttgagcccaggagtttcttctctttttttctttttttttttgagacggagtctcactctgtcacccaggctggagtgcagtggcgcgaccttggctcactgcaacctccacctcgcaggctcaagcgattctcctgccagagtagctgggattataggctcaccaccagacccgggtaatttttgtatttttagtagagatggggttttgccatgttggccaggctggtctcgaactcctgacctcaggtgatctgcccacctcagcctcccaaagtgctgggatcacaggcatgagccaccatgcctggccaaacccaggagtgtcaaaccaccatgggcaacatagggagatcccagctctaaaaacaataaatagtggggcatggtggtgtatgactgtagtcccagctacttgggaggctgaagtgggaggcttccttgagcctgggatgttgtggctgcagtgagccataattatgcctctgcactccagcctgagccatagagcaagaccctgtctctaaaaaatatgtatatataataaaataaattacttaagatctatatcctcctttagttggtgttatctcaactaacaaccctcaggccagctgtagtcccagatattcaggaggctgaggcaggtggattgcttgagcccgggaggttgaggctgcagtgagccatgaatggtgccactgcacttcagcctgggtgacagagtgagaccttgtctccaaaaaaaaaaaaaaaattttttttttacatcacccagtacaatatgcacatgtacaactgacccaaacattttgcaaaacagtcgctgttactacatgagatacattctgaaattgtttcctaacaagggacaccaggacaaattgagagcaaaggacgcaaaagcccacaagacaaggtaaagtagaagaaaggagcaggggcagtgtcgtatgggccagcactggtttaattcactggctgttccttcctgtgagggctttccgctaggccggcgaaggctggtgagaaagccggctctgcgccctgccctgtgctggccgccctcacctggcgctttgtaccctgaggcagctccggactcagggcaggtgggagggattgcactttcctttcactttctcaggacgccaaacccgacacctggggccagaactacacttcccaccaagcagcgaggcaggaggaagaagggggcactggggggctgaaaagcaaacccagaagaaagcgaaaacattacctgctgaccagcagaggtgagagagcgagacaggtaagcgacaggtgaaccaggaaggcgaaggctgcgggatgccggcgggaggacatcatcggggtggacgctgcctgtgcctcccagcaaggcttgtaggctcaatgaaagggggctttagtggaaaccctgaggactcctgagggtggggggagacatggaagtaaagtctcagctcaagttacagtgataagaccaagacaccggaagtggaatggctgtctttagttgaaaagtcagacaggaaaaaagtggtttgattgtgtctgttgtctgctggatcatctacccatatgtgatttcagagaggtccaagagaggtatgggatccttcttcatcgccttaaagccctgggtttttgcatgcagattggacatttgagtgcattttaccttgtgtgatgagacagagtgtccttgtctatgactttagagaaaaccaaagtaaaacggagaggtgaagaaggatgtcacaaggcaggggcaatttgcagcacatcaaatgtaatcattaagtgggatcaggtttcagttacttttagagcaattggatgaggagtccgaacacactctcaggaagaacagttaaagaggatggggatattctccttgggggaatattcttgctgcttcaaatatctgatgggctgtcatgtggaacaggaatgtgatgtgtcttggcagagtaaggatagcacggagctagacagatggaaacctcatggagggaggtgtcaatcccacagaagtgagagctgcccagtgcaaaatggaaatttttcaggaggtagtcagttccttgtgatcagagatatttaagcataggtggacatttaagccagggatgctgatggtgggagtaagtttcaggtaggtgacttggtcgattggtgttttccaaacctggctcatcatcagaatcacctggggaagagacagagcaagaggggaggggaggggagggaagagagacagaggtttttggttttgtgtttttgtttgtttgtttgtttgttttttgaaacggagtttcgctcttgttgcccaggctggactgcaatggtgcgatctcggctcactgcaacctctgccctctgggttcaagccattctcctgccttagcctcccaagtagctgggattacaggtgcatgccaccacgcccggctaattttttgtatttttagtagagatggggtttcaccatgttggccaagctgatcttgaactcctgacctcaagtgatccgcctgcctcagcctcccaaattgcttggattacaggtgtgagccactgcccctggcctatttcttattattttaatagagatgggcggggagggggggcgcagggctctcattatattgcctagactactttcaacctcctggcgtcaagtgatccttctgcctcggcctgccaaagtgctaggattacaggcatgagcgactgcggcctggcgcactaaacatattttaaagttaaaaacacaaaacacaaaacctggcccagtgcagttttgagatcataccactgcactccagcctcggtgacagagcgagactctgtctcaaaaaaaaaaaaaaaaaaagaatactaagaaataatttttaaaagaacaaggtaaaatatgtttagcaagtctgggatgagctccaaaaatatattttttcaatgatattcccagataattctgataatcagttagtttgtgaaacactgtcattaaaaacctttattttccagccgggcatggtggctcatgcctgtaatcccaacactttgggaggtcaaggcgggcagatcacctgaggtcaagagttcctaaccagcctggccaacatggcaaaaccctgtatcgactaaaaatacaaaaattagccaggcgtggtggcaggcacctgtaatcccagctacttgggaggctgaggcaagagaatcgcttgaacccaggaggcggaggttgcagtgcagtgagccaagaccacaccattgcattccagcctgggcaagaagagtgaaactctgtctcaaaaaaaaaaaaaaaaaaaaaggaaatatatatttttcaatgatactctcagataattctgataatcagttagtttgtgaaacactgtcattagaaaccttaattttctggcggcgcgtgatggctcaggcctgtaatcccagcactttgggagactgaggcaggtaaatcacttgaggtcaggcattcgagaccagcctgaccaacatggtgaaaccccgtctctactaaaaatacaaaaattacctgggtgtggtagtgcaggtctatagtcccagctactcgggaggctgaggcaggagaatcgtttgaactggaaggcagaggttgcagtgagctgagatcatgccattgcactccagcctgggcgacacagcgagactctttgtctcaaaaaaaaaagaaaaaaaaaaacctttggtaaaatatgccataaccagcctttggtaaaatatgccataacattatagccatggttttaattttgaatattctcaaaatcctaatttcctggtcaaaaaaattaggctccaaacagaacaaaaaggtcatgtcactcttccccaagctgacttaccaatcacctcttatcagtcctcgttgctagctacctggatggtcagtagttttttgttttttgggtgttttttttttgaggtggagtttcgctcttgttgcccaggctggagtgcaaaggcatgatctcggatcactgcaacttccgcctcccggattcaagtgattctctggcctcagcctcccgaatagctgagattataggcatgcgccaccacacccagctaactttgtatttttagtagagatggggtttctccacgttggtcaggctggtctcaaactcccaacctcaggtgatccacccaccttggccttccgaagagctgggattacaggcatgagccatcgtgcacggcctggatggtcagtcttacagcagttgggaatctttctccccaggtgaaattgacactagtgggacctccaatggcaggtgagtcactgctgtgggcatttcctctgccattctcctgctctccgggcactctgatggagcatgtggcacctcgtctccaggcctaggatatatcactgcttttatctgatggtgttgaccgtccactggacccaccagagaatggcagtagaacctctttattccaagagcacccctaaagtaagatcaacacacgtagggcagatgtcagcttatggggacaactcctctgtgcccgactagcatcattagcatcgtcctctcacaaggatgtagcactgtgaaggtaatgacctcccttcgtcttgtcttgtactggatccccagttcctggtgctgaattccatcctttcttcctagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaaggtcagagggcaccgggacgggactggttccaccttttttttttttttttttttttttttccttgagacggagtctcgcgcgatctcggctcactgcaagctccgcctcccgggttcatgccattctcctgcctcagcctccagcctcagcctcccaagtaacaggaactacaggcgcccgccaccacgcccggcaaattttttttttttttatgtatttttagtagagatggggtttcatggtgttaccaggatggtttctatctcctgacctcatgatccacccacctcggcctcccagagtgctgggttacaggtgtgagccaccgcgcctggccagttccaccttttttagccagaattcccaacaacaaagcacatgtctgagcaataaaagatttcagtacaaaacatgaaatcatacaaatagtggaagaaaacatgggagtatttattttctcatcatggaatgggaaaatcaggctttaaatgagacacgaacccagaagccaataaggaaaatactgctgaatctaactgtgaaggtcaaatttatacatttctctaactatataaaggtcaaatttgcttttttgggggggtgggggagtgtagacagggctttttgtttttgtttttgttttcttgaggcagagtctcactccatcacccaggctggagtgcaggagcacagtttcagctcactgcaatctctgcctcctgggctcaagcaattctcatgcctcagcattccaagtagctggatttacaggtgcacaccaccacaccgggctaagttttgtatttttagtagagatagggtttcactatgttggccagactggtctcgaactcctgacctcaagtgatccgcccacctctacctcccaaagtgctgggattacagatgtgaaccaccacacccagcctgagacagggtcttgctctgtcactcaggctgaagtgcagtggcacaatcacagctcactccagcctccatctccccgactcaagcgatcctctcacctcagcctcctgaatagctgggaccacaggtgcaccccaccatgcccaactccttttttaaatttgttgtagagacaggattttcctgtgttgctcaggccagtctcaaactcctgggctcaaacaatcctcccacttcaccctcccaaagtgccgggattacaggcgtgagccaccaaacctggccttaaaaggtcaaattttctagtggccaggcaaggtggctcacacctgtaatcccagcacttcgggaggccgaggcgggtggatgacttgaggtcagaagttcaagaccagcctggccaacatggtgaaaccctgtctctactaaaaatacaaaaattatccaggcatggtggcgcgtgcctgtagtcccagttacttgggaggctgaggtacaagaatctctcaaacctgggaggcagaggttacagtgagccgagatcatatcactgcactccagcctaggcgacagagtgagactctgtctcaaaaaaagaaagaggtcaaattttctgtgtactcaaaaatgccataaactgccaggcacggtggctcatgcctgtaatcccagcacttttggaggccgaggcaggcggatcacccaaggtcaggagttcaagaccagcctggccaacggggggaaaccccatctctactaaaaatacaaaaaaattaaccgggcgtggtggcacatgcctgtaatcccagctggtcaggaggcttgaggcatgaaaattacttgaacccaggaggcagaggttgcagtgagctgagatcacaccattgcactccagcctgggagtcagagcaagactctgtctcaaaaagataaaataggctgggcgtggtggctcacgcctgtaatcccagcactttgggaggccgaggtgggtggattacgaggtcaggagattgagaccatcctggctaacacggtgaaaccccgtctctactaaaaatacaaaaaatcagccgggcctggtggcgggtgcctgtagtcccagctacttgggaggctgaggcaggagaatggcgtgaacccgggaggcggagcttgcactgagccgagatcataccactgcactccagcctgggcaacagagcgagactccgtctcaaaaaaaaaaaaaaaaaaaagataataaataaaaatttaaaaaattaaaaaatacttcaaagaaatcaacagaaagggctagatgaagcaagtaacaaaatctcattaattattgaatctgggtgataggtgtatgaggttctttttttatgtttttgagacagggtctcactttgttgcccagatggagggcagtggcgcatgatctcagctcgctatagcctcgacttcctgtgctcaaggaatcctcctgcctcagtctcccaagtagctgggactacaggcatgcgccaccatgcccagctaatttttgtatttttcttttttttttttttttttttttttgagacggagtctcgccctgtcacccaggccgaactgcggactgcagtggcgcaatctcggctcactgtaagctccgcttcccgggttcacgccattctcctgcctcagcctcccgagtagctgggactacaggcgcccgccacggcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttttgtatttttcgtacagatggggtttcaccacattgcccaggctggtctcaaacccctgagcttaagcgatccgccacctcagcctcccaaagtgctgggatcacaggcatgagccactgcacccagcctcatttttctattatctctagctttggtgtatgtttgcaaactttctctaaaaaataaattttatataaatagtatgagaatatgaagaaattgctaccctcagacactgtgagaggctgtgtgaattggtgctgccgcttgggtggctaatttgggaggtattattgtgagaacattccaaacatgaacagcttgagtgttcctttaaaatcagaacagttcggccagtattatcacctttgccagtattcagatccacgggcagactcaaaagatgagcccccaaatctggaccaagtgatgagtcaggagaaaaggcaaagaacacaagaccccaggataaaataggcccacctctcggccgggcgcagtggctcacgcctgtaatctcagcactttgggaggccgaggccagcagatcacaaggtcaggagatcgagaccatcctggctaacacggtgaaaccccgtctctactaaaaatacaaaaaaattagctgggcatggtggcgggcgcctgtagtcccagccactcgggaggctgaggcaggagaatggtgtgaacctgggaggcggagcttgcagtaagctgagatggcgccactgcacgccagcctgggcgacagagcgagactccatctcaaaaaaaataggtccatctctctgacagcagcatcccttaaatcggctgtccaagcttctggtttccctgggccatgttggaagaagaattgtcttgggccacacaaattacactaacactaatgatacctgatgagctaaaaaaaaaaaaaatgcagaaaaactcataatattttaagaaagtttgaaaatttgtgttgggctgcattcaaagttgtcctgggccaaatgtgtcccgtgggttgcgggttggacaagcttgtcttagatggtcgttccccaaccaaggaggatatccaagtcatccagggagcaactgaaagaatagatccctgggtcccaccccagatctactgggtctgaatatctagaagtgagacccagaaaactgtgtttttaagaagatgtaggtgaaggagttcccattacctgtgggaacccctgatttggactctccttcctgtccttctccagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggtatggcatttttgaagtttttaacttttgtttactctcctctgaggatgctcagctttctgcatgtttctaatgacagtggaaaatgaaatcttaaaagtgtaagtgatgcagccgggcacagtggctcacacctgtaatcccagcactttgggaggctggggcgggcggatcacgaggtcaggagatccagaccatcctggctgacacggtgaaaccccgtctctactaaaaatacaaaaaaattagacaggcgtagtggtgggcgcctgtagtcccagctactcgggaggctgaggcaggagaatcgcttgaacccaggaggcagaggttgcagtgagccgagattgtgccattgcactccagcccgggtgacagagcaacactccgtcggggggaaaaaaaatgtgtaagtgatggatagggcctcagaaagtgcctttaagctggatgccaccatgcccagcccatttttttttttttaattttttgtaaagacggggttttgccatgttgcccaggctggtctcgaactcctgggctgaagtgatccccctgcctggccctcccaaagtgctgggattacaggcatgagccattgtgcctggccctttatttttatttttgacatctctactgcagagtgaacaggtgagttttgttttttaattttttatgggtatctagtaggtatatctatttattgggtacagtgggttcttaaaaagaaagaagaggcaatttctaagtgtttaccaataatttacattaaaatacataaacatagatggggcgtggtggttcatgcctgtaatcccagcactttggagggcgaggcaggtaaattgcttgagcccagggtttcaagaccagcctaagcaacatggcaaaacctcatctctacaaaaaataaaaaaaattagctgagcgtggtggtgcacacctgcagtcccagctactcaggaggctgaggtgggaggattgcttgagcccagcaggcagaggttacagtaagctgagactataccattgcactccatatgggtatccagttttcccagcaccacttattgaagagactgtcctttcgccaacatatgttcttagcacctttgtcgaaaatgactttactgtagatgtatagatttatttctggattctggattctgttccattggtctatgtgtctgtttttatcagtaccacactgttttggttaccatagttctgtagtataatttgaagtcaggcaatgtgattcctctaggttggttctttttgctcagggtagctttgactattctgagtctttcatggttccatataaattttaggataatcttttctatttctgtgatgaatgtctttgggccaggcacggtggttcatgcctgtaatcccagcactttgggaagctgaggcgggaggatagcttgagaccatcctggtcaacatagtgagacttcatctctacaaaaactaaaacaaaacaaaatagtgagatgtggtggcacaggcctatagtcccagctacttgagaggttggggtggggggaatcacttgagcctgggaatttgaggctgcagtgagctgtgatcataccactgcattccagcctgggtgagaaagcaaaacctggtctcttaaaaaataaataaataaataataaaaggcaactgttatgtcctagtagagcaaagatgggagagctgtgccatggcatacaaacggccggggtggacaggtagatgcagcccatgccctccagggacaaaaggaaacccagcaatggtggctcccagagaaaggcggaatgcacgcatctcacttgggaatgaagcagttctaagctacatgcggtttccccaggaatgtggaccagatccacctttgtattaaggtcatgcatctcgaggacacagtggaggcagttcttcctcagggctgagtgggaagctgcccaacctcagatgcctccctctgtgctaccttctctctttttttgagacggagtcttactctgttgcctaggctggagtgcagtggcatgacctcgactcactgcaatctctgcctctcgggttcaagcaattctcctgcctcagcctcccaagtagctgggattacaggctcccgccaccacactcagctaatttttattttagtagagacaggatttcaccatgttggccaggctgatctcgaactcccgacctcagatgatctgcctacctcagcctcccaaagtgctgggattacaggcatgagccaccacccccggcccctctgtgctatctctgaaggcagcgacctgtctccagcccacaggatcccagctgcctctcccccagccagctccgtctttaatcactctgtgaaacagatgcatcagagaagggtgacagatgccaggatgttgcaggatttccaggaatctcagaatgtttgcttggtatttataccctagtctgtctttcataacaagcatctctgcctcacttcttccttggttctagaaatgcccccaaagatgatttggagtgtcctagtctcccagtttataaggtgtccatgccagagggctgacacagcagccttcctgttttctgttcgtggcctccctgcctgaatccagaaaaattcgtgttgtccctcacggaagtgtcccggcacacattgcctcatacacgtgcttctttctgtctcagaagtttatccccagctccttgaagccactttatcagcacaggaatgaccccggtgtcaggggttgattgcatgttgatttatacagctgttcctcctctagctggctacagggggcccagctcctcctaatgtccccatgtaaaaccctcagaggcccccatttcccttagaatgatgtacatattcctgaacatggttcacaaggtacttcaggtcccagccctgctttcttctgggggtgtctggcttcccatctttctcctaccctcactccatcagacctgacctctttttttttcttttcttttcttttctttttttttttgagacagggtcttgctctgtcgcccaggctggagtgcagtagtgcaatctcggctcactgcaacctccaccacccgggttcaagtgattctcctgtctcagcctcccaagcagctgggattacaggcacctgccatcacgcccagctaatttttgtgtttttagtagagacagggtttcaccatgttggccagactggtctcaaactcctgacctcaagtgatccacacacctcgcctcccaaagtgctgggattgcagggagccaaccttttttgtaggttatcctggatgctctgtctcataactttcttcaacatctgatatttgtccctctaaagatctcagccaaactttccacttaaagtcctgttatattacaggtccacaatcactcaacaaaaaccctcagggccaaatatttcagagttcagaatttgtcagattttagaaaaatgtactctgtgttacataacaccctcagcagggtctgggccaatgccgcatggccaaatacattactatttatgcagtcagatgtgtaaatagtcatacagagcaggttgaataaaatcttcaatgctgggcatggtggctcatgactgtaatctcagcactttgggaggccaaggcgggcggattattttgtaataaaaatacaaaaattagccagatgtggtggtgcacgcctggagtcccagctactcaggaggctgaggcaggagacttgcttgaacccgggaggcggaggttgcagtgagctgagatcacaccagtgcactccaacctgggtgacagagcaagactctgtctcaaaaaaaaaaaattattcaagccaggtgtggtggctcacgtcagtaatcccagtagtttgggaggctgaggtggggggttgcttaaggccaggagttcaacatcagcctgggcaacatagcaagaccccatctttatttttatttttaaaacaaacagccgggtgcagtggctcacgtctgtaatcctagcactttgggaggccaaggcgggcagatcacctgaggtcgggaattcgagaccagcctgaccaacatggagaaaccccgtctctactagctgggctttgtggtgggcacctgtaatcccagctactcagaaggctgaggcgggagagtcgcttgaacccaggaggtggatgttgcagtgagccaagatcacaccattgcactccagcctgagcaacaagaacaaaactctgtctaaaaaatcaatcaatcaatcaaacaaaaaaaaacttcaaatagctagtttagctcagattttactgtcaaatgaattatcaagaaatgcactggttacagctgcccaggagtggagtttcagagtttaggggatttgggggttgtataccagtactacaaacaactcatgcagctcaccgggtccatagcatatgttattttattgctgtcttggattggtacattcttgtctggccatttaatgttctgtgtgtctgtcttgcctccctaacaaaatgaagaagcccttccttggggcagggccgtctgtcactgtgcacttagcaaacttcagatcctttcccttcctccaggcacctggctcaccccagagtgtgcagccctggctgttggcgggtggacccgtggacatcagcactgttgatctagttgtggtggaggagcaggtggaaggagcaggtcataaaagttagaatccagctgggcgccgtggctcacacctataaatcccagcactttgggaagttgaggtgggaagattgcttgatgccaggagcttgagatcagcccaggcaacatagtgagacctccgtctctacaaaaaataaaaaattaagccgggtgcggtgactcacacctgtaatcccagcactttgggaggccgaggcaggtggatcacttgaggtcaggagtttgagaccagcctggccaacatggtgaaaccccatctctactaaaaatacaaaaaaaaaaaaaaatcagccaggtgtggtggtgagtgcctatagtcccagctacttgggaggctgaggcacaagaatcacttgaacctaggaggcagaggctgcagtgagccgagatcgcaccactgcactccagcctgggtgacagagcgagactctgtctcaaaaaaaaaaaaaaaaattagctggactcagtggtgtacgcctatagtctcagctactctggagactgaggtgggcacattgcttgaggctaggagttcaaggctgcagtgagctatgactgagccactgtgctccagcctaggtaacagatggagaccctatctcttaaaaaaaaaaaaaaaatcaaatccacagatggagtgggatgcagggagtagatcagattcctggctgcaggggttccttttcccaccacatcccttcttccaccagggactgtcattcctttcttctagaagcagagctcagcccagagcttcaggctcaccagctaaaaacacacgcatggttctcttgaaggtgcatgctatacgagcttcctgtggctgctgtaaccaactgccacgagctgggggctgaaaacaacagatgtgttcacccactgttctggaggccacaagtctgaaatcagtcctgcggggctgaaatggaggtgtcagcagggccgtgcccctctggacgctgtaggggagactgtccctcgcctcctctggcttctggtgccatctttggctctgtgtgcctcaccttttcctgcctgtgtgggatcaagtctccctctacctcccccttgtaaggttacttgtgattgcattcagggcctgcccagctagtccagaataatctccccatctcaagatcctcaaattaatcacacctgcaaagaccctgttagcattgacagctgcctgaggccagagcctggtctccatgggcccccgttcctagcctattgtagcactcaaatgtgctaatgtctgctgaaaatggtcttggatttaaacttctttggggatcattatgatctaagtccagctttgacactgggcaggttggtgacagtgactatgggaaaagattttcaaaatattttttattgggacatattaatgtatataaagaaaagtacacattaatttatctcaaagggaacagctgagcaaacaccagctgggtcaagacagagaatattggccaggtgcagtggttcacacctgtagtcctagcactttgggaggctgaggcgggtggattgcctgagctcaggagttggagaccagcctgggcaacatggtgaaaccccgtctctgctaaaatacaaaaaaaaaaaaaaaaaaaaaaaaaattagccgggcgtggcagtatgcacctgtatgtagtcccagctactcgggaggctgaggcaggagaattgcttgaacccgggaggcagaggttgcggtgagccgagattgcgccactgcactccagcctgggtgacagagacagactctgtctcttaaaaaaaaaaaaaaagaagaatattgactgggtgtgggctcacacctgtaatcccaacagggatttgggaggcagaggtcggaccagcctgaacaacatagggagacccgatctctacaaaaaaattacaaattagctgggtatgatggcatgcgcctgtagtcccagctacgcaggaggctgaattgggaggattgctttagcccaggaggtagagtctgcagtgagctgtgatcacaccactgcaccacagcctgggtgacacagtgaaaccctgtctcaaaaaaaaaaaaaaagaatattgccagcccactcttctcccccaccagctttcactttattactccacactccttctgccccaaaggcaagtgcttttatgataaacacttctttgcttttttcttttttaatcattttactacctaagcccacatccctaaatactgcagttttgttttggtgggttttttgtttgtttgttttgtggtttgttttttttttttttttgagatggagtctcactctgttgcccaggctggagtgcagtggcgtgatctcagctcactgcaaactccacctcccaggttcaagtgattctcatgcctcagcctcccaagtagctgggattacaggcatgtgccaccacgcccagctaatttttgtatttttagtacagatgcgttttactatgttggccaggctggtcttgaactccccacctcaagtgatccacccacctcagcctcccaaagtgctgagattacaggtgtgagccactgtgcctcgtcttgttttgctattgttttgtacgttatatataaacaaaatcatacctttttgcctaagtttctttccctcaatattgtttaacagtttcatccatcgttgcatgtggctgtaatctattcttttgtataattcgtatactattcctttgcaagaacaccctacagagtatttctctgttctcttggcaatggacatttgagttgcttctattttggggcaactaggaaaattgctgctccgaacattctggtatatgtttattgatgccgatgggcacacatctctgttgagtaatacccaggagcaaaattgcatggtcatgcagctctagataatctcaaaccacttgccagagtggtcgttctagtgtgtactcccatcagcagtgtgtgtgggtttcagttgttctacatcctcaccaacatctggtgctattagtccttttacttccatgcatcctgagaagtgtgtcatgagatcactagtgtttttcatttgcatttccctgtttattaatgagattgaacaccttttcaggtgtttgttagctattcggatatcctctgttgtgaaatacttttcaagtccaaggcctatttttctgtttgttatctttttcttgtcaattcctaacagtagcttatatcttctgaaaatgagtctgtgtcagtgtgggtcctccaggaagcagatgttgggacaggatgagatagacatgcaagagatttactgggagaaacagctgtgagggataaagaagaaggagcagggctgggcacagtggctcatgcctgtaatcccagcactttgggaggccgaggcaggtggatcacctgaggtcaggagttcgagaccagcctggccaacatggcgaaaccccgtctctactaaagatacaaaaaatagctgggcgtggtggtgggcgcctgtaatcccagctactcaagaggctgagccaggagaatcgcttgaacccaggaggcagaggttgcagtgagctgagatcgcaccattgcactccagcctgggcaacagagtgagactccatatcaaaaaaaaaaaaaaaaaaagaagaagaagaaggagcagaaggaggcagggagtcttctatgagatgtagacctgcccctgggaaggagagaacggaggaaggatggcttagtaggtaggaagagtcttagactaagcacaattcaaagaaagtttatttttcaggcagtggggtgctcaaaagccaaggttgcctgatagaggaatcgaatcctgcatcctgcagcatggatgtgcatgagtgccctcatggtatgggggatggggtgctgtccccactagggcgctgcactagggtcctgttgggctgtctgtgacctgcattctgggcactaggttctcttgaaggaggccccagccctttgtcagttacatatgttgcaaacatcatcttccaccctgtggagtaacttttccctctctcttcttaaaaatacctgaaggaaggaatattttggttttcttattttttattttatttttatttttttgagactgagtcttgctctgtcgcccaggttggagtgcagtggcgcgatattgactcactgcaacctccacctcccgggttcaagcaattctcctgcctcagcctcctgagtagctgggattataggcgcccaccaccacacccagctaattttcgtatttttaatagagacggggtttcaccatgttggtcaggctggtcttgaacccctgacctcatgatccacccgccttggcctcccaaagtgctggggttacaggcatgagccaccacgcctggccttttatgttttattttttatagatagggtccaactctgtcacccaggctggagtgcaatagtgccatcctagcttacagcagcttcgaactcctgggctgaagcaatcctcctgcctcaatcttccaagtagctgggacgacaggcacattccaacatgtccagttaggttgttttgttttgttttttgagacagagtcttgatctgtgacccaggctggggtacagtggcccaatcttgcttcactgcaacctccacctcctaggttcaacgattctcatgcctcagcctcccaagtagctgggattacaggcacgtgccactacgcccagctaatttttatattatgagtaaagatgaagtttcactatgttggccaagctggtctgaacctggcctcaagtgatccaccaacctcagcctcccaaagtgctgagattacaggtgtgagccaccatgcccagccccagctagttttttattatgttttgtagagatggggtcttgctgtattgcccaggctggtcttgaattcctgggctcaagtgatcctcttgcctcggcttcccaaaccactgggtttacaggcatgaaccactatacccagccttttcgtctcttgatggtgtattgtgatgaacagacactcttaattttaatatatttcaatctattgatcttttctttaataatgattgcttcctgtgtcctatttaggaaattttttcttaattgaaatcatcaagattatattaccttttaaagtttaattgattgattattatcattactctgccttttacatttagatctacctgtaattgattttttgtgtatggtgaaaggtatgggtccaaaatttttctgtataaagatctaattgtctcagtaccatttactaaaaaggcaaccttagccaggcacagtggctcacgcctgtaatcccaacactttgggaggctgaggtgggctgatcacctaaagtcaggagttcaagaccagcctggccaacatggtaaaaccccatctctactagaaaaatacaaaaattagctgggcgtcgtggtgggtgcctgtaatcccagctactcgggaggcggaggcaggagaatcacttgaacctgggaagtgggggttgcagtgagccaagatcatgccactgtactccagcctgggcaacagagtgagacgctgtctcaaaaaaaaaaggcaacattttccactgctctgtggcaccatctttttgtagagtacacatttatacatgagtttgtttctgagctgtttttcctctccattgatctagtccattcatgctcttgggagtgaaaatatcctcaatattacaatggtttatggccctccaaagggccatacacagtacatctgtggtattacattttcataggccaagatcactccactgcactccagcctgggcaacaaagtgagaccccatcaccaaataaaaaaaaattagccatgggtggcggtgcatgtctgtagtcctagtgatttgagaggctgactgcttgagcctagaacgttaacgctgcagtgagctatgatcatgctactgcactccagcccaggtggcaggacaagaccctgtctcaaaaaaaatgaataaataaaggccaggcaccgtggctcacacctgtaatcccagcactttgggaggccaaggcgggtggatcacttgaggtcaggagttcaagaccagcctggctaacatggtgaaactctgtctctactaaaaatacaaaaattagccaggcatggtggtgtatgcctgtaatcccagttattcgagaagctgaagcgggagaatctcttgaaactgggaggcggaggttgcagtgagccaagatagcaccactgcactccagcctgggcgacagagcaaggctctgctcaaataaacaaataaataaataaggtagatggttaaacaaatattggtccttggctgggcgtggtggctcacgcctgtaatcccaacattttgggaagccaaggtgggcagatcatctgaggtcgggagttcaaggccagcctggccaacatggtgaagctctgtctctactaaaaatacaaaaattagctgggcatggtggcatgcgcctggagtcccagctactcaggagactgaggcaggagaattgcttgaacctgggaggcagaggttgcagtgagccaagatggtgccactgtactccagcctgggtaacagagagagactacatttcaaaaaaaaaaaaaacacaaatgttggtccatgcatactatggaatactactcagcaataaaaactactagtggtatacagaaaacaaactactgatttatacaacaacttgaatggatctcagaggaattatgctgagtgaaaaaagacaatctcaaaaggttacatatatgaatccatttatataatattctggaactagaatagattggtggttagcaggggcggaggaccgggggtggtgagagttataaaggaatagcatgaaagagagctttgtgagaatagaactgttcagtgctttgactgtggtggtgattgaaggaatctacgcatgtgatcaaattgtgtataattacaaacatacacacaaataagtgcttgggacatttattcatttcatgacaagaaacttttttttcctttttttttaagacagaattttactcttgttacccaggctggagtgcagtggcacaatcttagttcactgcaacctccgcctcccgggttcaagtgattctcctgcctcagcctcctgagtagctgggattacaggcgcgtgccaccatacccagctaattttttgtgtttttagtagagacggggtttcaccatgttggctgggatggtctcaaattcctgacctcaggtgatccacccgcctcggcttcccacagtgcagggattgcaggcgtgagccactgtgcctggctgataatttttttttttttttgacatgccgtttcgctgttgtcacccaggctggagtgcaatagtgcgatctcagctcactgcaacctctgcctcctgggttcaggtgattctcctgcttcagcctcccaagtagctgggactacaggcatgcaccaccacacccagctaattttgtatttttagtagaaatggggtttcgccatgttggccaggctggtctcgaactcctgacctcaggttatccacccacctcggcttcccaaagtgcagggattacaggcatgagccaccaagcctggcctcatgacaggaaatctgattaaagtctgtggatagcaccaatgtcaatttcctggtattgataatgtgctatagttatacaagatattaccattgggggaaacagggtgaagggtaaactggacctctccctctctctctctctctctctctctctctctctctatatatatatatatatatatgtgtgtgtgtatatatgtgtgtgtatatatatatatatatatacacatatctatatatacatatataatgacttcccatatatctataattgtttcaaaataaaaggtttaaacatgttttatggaagaagggggaattatggaaaaaaatatctacagaggctcttgtggggacaggaatgaaaaccaggttgagaaacaatagtctagcttgtcttaattactacagttttgtaataaatcttgatgtctggtagaagaaatcctgtgggaaagtaattttatctttagattcctgcctcagggaaatcaaaggcaaacttttattgtatgtaaattatagctttctcagaaagtcctttaggccaggtgtggtggttcatgcttacaatcccagcactttgggaggccaaggtgggcagatcactggaggccaggagttcaagaccagcctggtcaacatggtgaaaccctgtctctactaaaaatacaaaaattagccaggcgtggtggcattggcctgtaatctcagctactcgggagtctgaggcacgagaatcgtttgaacctgggaggcaaaggttgcagtgagctaagactgcaccactgcactccagcctgggtgacagagtgagactccatctcaaacaaaacaaaacaaaacaaaacaaagtcttcccttatgcacctccaatccagcaaatcctgatcacagtctactcagctaaatgagctccatctcacacagcatccaacactctgctgtttgagggggagaaaaagagagtaaaaagaggagcaagggccgggtgcagtggctcatgcctataatcccagcactttcggaggccgaagcaggcgatcacctgaggtcaggagtacaagaccagcctggtcaatatggcaaaacaccttctctactaaaaatacaaaactagccgggcgtggtggcaggtgcctgtaattccagctacttgggaggctgaggcaggagaatcgcttgaacctgggagacggaggttgcaatgagccaagattgcgccattgcactccagcctgggcgacaagagtgaaactccatctcaaaaaaaaaaagaaacaaaaaaatgtgccctcaatgaccatttgtgaatgaatgcatgcatgcctattgaagaactaaaatgttacttgtaaagttcattttgaaagaaaccagattaagttactcaatggaatatcggcttatcttttccttccaggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaaagacccactgcacttgctaagatgtttgcaaagccagttgcacccaccaaagaggccgcctctgaaaccaaaggtagccaggataccgtagtgttgccccagtggcgctttagaccccagcgtggacttgccgctcacccctaatcctcccagtctggatgggccacacttctcccttgactcacaccacaggtcatagctgctgactctcaggaaaaccagcaccattgttttcactgactcttgactcctggagaaggcaggacttcaggctaggagagggaggacgaagtgtactcttctcccctttcacttttctgtctccctagagcttctgctgctttctactgaattttgtttcttgcttgaagaagagggtagtgaaggaaaggaggaaggcaaaacagcaagagagagaagaggctgtttggaacattctggaacagtttgaaacagctcaggcagggagaatggaacgaaagcctgcaatgagaaaccagaatgctgctatcattttgttcctgacattcacacctcaggtcttcactttggggagcgaagccttttagcagaaataccagaagtaccatcttgccaaatggtcaggaactgtctgatagagatggaactggaattcactctattctagcagggctgacttggccaccctcttgggataggggaagacacctgcaattttttttctttcttttttttttttttttttttgagacagggtcatactctgtcacccaagctggagtatagtggtgggatcttggctcactgcaacctctacctcctgggttcaagaggttctcccacctcagtctcccaagtggctgggactacagacacacgccaccactcctggctaatttttgtattttttgtagagacaaggtttcaccatgttgctcaggctgatcttgaactcctgagctcaggtgatctgcccaccttggcttcccaaagtgctgggattacaggcatgagccaccatgcctgttctttttttttttttttttttttgagactgagtctcactctgtcactcaggctggaatgcagtggcatgatctcggctcactgcaacctcaacctccacctcctgggttcaagcaattctcctgcctcagcctcccaagtagctgggactactggcactcactaccacgcccagctcattttttttgtatatttagtagagactgggtttcactacgttggtcaggctggtcttgaactcctgacctcatgatccacccgtctcggcctcctaaagtgctgggattacaggcatgagccaccatgcccggcccttttttttttttttttgagacagagtttcgctcttgttgcccaggctggagtgcaatggtgtgacctcggctcactgcaacttctgccttccagattcaagtgattctcctgcctcaacctccctagtagctgggattacagcctcccgccaccacgcctagctaatttttgtgtttttagtagaggcagggtttcaccacgttggccaggctggtctcgaactcctgacctcatgatccacctgtctcgtggcctcccaaagtgctgggattacaggtgtgaaccaccgcacctggcctttttttattattattattgtagaaatgaagtcttgctacgttgcccaggctggtctccaattcctgagctcacaggtttctcccacctcagcctcccaaagtgctgggattacaggcatgagccaccatgcctggcacaatttctttctagaacccaaatcatctgccagatcagaagtcatttttaaattaaaattaaattggttcatagatgaatatcaagccagtgttgtactgccccttctgtaagatatggccagagagcagctggtgccttctgggatggagtaactgcggctttcagaactaaacacgtaagaggaggctggaagtcaccaggcacccctcgtttccaggactgtgttaggggacatcagggcaggcagcaggagcaggccacggagcccctccagggtcccagggaactgtggacactcacctggggcttccggaggacaaacaccacttatgattgcagctgacatttactgagctgcttctcatggccagaagttgtgtgaggtctggggaaagcaaatggtccctttggtttgtgatgccagtggaggggaaaagaggtaccagccgcattctgctgctcctctttttttttgagacggagtctcgctctgtcacccaggctggagtgcaatggtgtgatcttggctcactgcaacctccacctcccaggttcaagtgattctcctgcctcagcctcccgagtagctgggattacgggggtataccaccacacctggataatttttgtatttttagtagagacagggtttcaccatgttggtcaggctggtcttgaactcctgacctcaggtgatccacctgcctcagcctcccaaagtgctggaattacaggcttgagccactgcacctggcctgctgctcctcttaacacccttggacttcctggcatcctctcatccagcagtagctctcagttccccctttccctgcgccacattttttttttttttttttgaggcagcgtctcactctgttgcccaagttagagtgcagtggtgtcatctcagctcactgcaacctccacctcccaggttcaagcgattctcctgcctcagcctcctgagtagctgggactacaggcgcatgccaccacacccagctaattttctgtatttttaatagagacggggtttcaccgtgttagccaggatggtctcgatctcctgactttgtgatcctccccccttggcttcccaaagtgctgggattacaggcgtgagccaccgtgcccagccctttttttttttttgagacagagtttcgttcttgttgcccaggctggagtgcaatggtgcgatcgtggctcaccacaacctccacctcctgggttcaagcgattctcctgcctcagtctcctgagtagctgggattacaggcatgtgccaacacgcctggccaattttgtatttttagtagagacagggtttctccatgttggtcaggctggtcccgaactcccgacctcaggtgatccgcccgcctcggcctcccaaagtgctgggattacaggtgtgagccaccgcgcccagccccctgctccactcttagcatctgggtatcagggccccaatcacagcctatctgcctttcagtgagaggaaggcagtctttagggctctttccctggactggtcttctccttggccttaagttattctcctgctcctttatacatttcttggtctgcaaggagtccttaggtaggagccagaatttaaattctgaccttcggaatatatccataaactaagccaaccacagagaagaagagcaaagctaggagacctacgaagcacaagcctcctcccggttctccaccatcatcaggaagcactcttaatttttctcagttaaggtgccttttagaaatttcttgtcttgcgacagagttttcattctttgttgattagtctattcttgaggaatggatccatcaatctgttcagtgtgtgtcccagagccgactcagggcgggcaccgatcaagatgaacagcctgccgagcctcctgtgggggctagccctctcctgttctgaggagcagccacgcagcctcccctgaaagcaaacctcgccctctttcccctcctccttcacccccaggaggagatctcaggtcagagaccaatggcagcctggagtactagtgttccctgacacatccgtattttgatgggaatcaaacacacaaacctagagataaagctgtaaggttggaactgtagccaggacttcagctcgcaggatcacaggaaaagaaaggcatctagagagaaggtggccttctgggaacccctaagatcaccgctgggacagccatcgtcctggtgtgggacatccccactgggagattgtttttctattcacaagtatcctccactccaggcctcccagacaggtgttgaagggatggagatggctgcttggtgccgggtggagggagggctctaaggctggctttgggaggagagagctccacacaaagacaccagctgcctgagcagctcccctaaacaagctgcaccccagaggagtcatgtgagtccctcatttttgctggagtgtctgcccttcctcacagaaccctcctctcctcactttgttcacaaagggcaagctctgagaccagctgccaaaccctggcttccacagtccagttaagaatttgcattaggccgggttacctgaggtcaagagtttgagaccagcctggccaacatggtgaaaccccatctctaccaaaaatacaaaaattcgccgggtgtgttggcgtatgcctgtaatcccagctactcaggaggctgaggcaagagaatcacttgaacctgggaggcagaggttgcagtgagccgagatggtgccactgcactccagcctgggtgacagagtgagactccgtctcaaaaataaataaataaataaacaaataagaatttgcactaaagttccgagaggtacggcagccatatccacaggtccttcctcactcaatcaactgtctctaccaggacaccttctaccagaaagtgtccaacttctgccagtttcctaggtctgtcaccaatatagtggcctcctgtgtttgggggcaggtacttggcagcgtgtgtgcatgtgcccagccccactcagtcaacaagccaagagcgacaagagtgtgccattgtccctctccctctccctctccccacagtctccctctccctctcttgccacggtctccctctgatgccgagccgaagctggactgtgctgctgccatctcggctcactgcaacctccctgcctgattctcctgcctcagcctgccgagtgcctgcgattgcaggcgcgcaccgccacgcctgactggttttcgtatttttttggtggagacggggtttcgctgtgttggctgggctggtctccagctcctaaccgcgagtgatccgccagcctcggcctcccgaggtgccgggatggcagacggagttgcgttcactcagtgctcaatggtgcccaggctggagtgcagtggcgtgatctcggctcgctacaacctccacctcccagctgcctgccttggcctcccaaagtgccgagattgcagcctctgcccggccgccaccccgtctgggaagtgaggagcgtctctgcctggccgcccatcgtctgggatgtgaggagcctctctgcctggctgcccagtctggaaagtgaggagcgtctctgcccggccgccatcccatctaggaagtgaggagcgtctctgcccggccgcccatcatctgagatgtggggagcacctctgccctgccgccccatctgggatgtgaggagcgtctctgcctggccgccccgtctgagaagtgaggagaccctctgcctggcaaccgccccatctgagaagtgagaagcccctccgcccggcagccaccccgtctgagaagtgaggagcccctccgcccggcagccaccccgtccgggagggaggtgggggtcagccccccgcccggccagctgccccgtccgggaggtgaggggcgcctctgcccggccgcccctactgggaagtgaggagcccctctgcccggccaccaccccgtctgggaggtgtactcaacagctcattgagaacaggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctccttaagagtcatcgccactccctaatctcaagtacccagggacacaaacacttcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaaaaaacaaaaaaaaaaacaagccaaggcaggggcccacagctctctgtgacccacctgggcagacctggcccgtgatagaaggagagggtgatggtatgagactcaaacccctgggcttgggcactacgtatccttggacaagtcacacacctctatgaattccctttgctcaagcatatgatgcagttgcttaattaaactcttgtgaggaccaagagagggaatggctgtgaaaatgctttgaaaatataaaaccaggccagtcaatatggctcacgcctgtaatcccagcagtttgggaggctgaggcgggaggatcgcctgaggtcaggagttcaagaccggcctggccaacatggcgaaaccccatcgatcctaaaaatacaaaaacttagctggacatggtggcgtgggcctgtaatcccacctacccaggaggctgaggcaggagaatcgctggaacccgggaggcagaggctgtagtgagccgagattgtgccactgcactccagcctgagtgacagagcaagactccatctcaaaaaaaaaaaaaaagaaaagaaaatataaaagcaagacaaaggcaatagggaatcatggtcatgttgttcagcagccatcagggaactgaagctcagtttctggacacttggtttggtatttaaggccttgtcacctgggaagaggtggaaaggggtgcattttccctgtggcctactagttccttgagaataaagcccttctctactccatgtgttggcacaaatactcttgatgacataaggaaattcttgaaaaactcacattacctgaaaatgcacatgtcaaagcactgtcctcacaagaagcgatggtaaaggacttcattgtccatccatggagcaaacagccctgaactaccaacacccagcctcacagagcccctgtggctggtgcctgcccctcagcctgcccagggaagagttatggtgggggatgtgaagttctggggtggtgtctcttcagaaagacggtttgcaaaacccttcctgccactattccaagccctgtgcccttcagctccagaaagaacctttttacagcttcttggtgccagcatgttctgacaaacgccatttctagaataatttcctaacaggttccaagatcaaatcacacatgggtaatgcagcaaaatttccagggcataggaacagagagatcagggagatatgaaattgactgggtgttggagggaggctgtgtgtcactcatgatgaggaatcctggagaggcctcgggttgcctggcccacagcagaggccaaggtagtgctccttaggttctctggactatcttttttcttccttcctttctttctttctttttttagagatatggtctcactctgccacccaatctggagtgcagtgacacaatcacagctccctgtagccttgacctcccaggctcaagtgatcctcccacctcagccccctgaatagctagctgagactacaggcttgcactaccatacccggctcatttttgtattgtttgtaaagatggggtcttgtggctgggcgtggtggctcacgcccataatcccagcactttgggaggccgaggtgggcagatcacgaggtcaggagttagagaccagcctggccaacatagggaaaccctgtctctattaaaaatacaaaaattagccgggcatggtggtgcacacctacagctactcaggaggctgaggcaggagaattgcttgaacctgggaggaggaggttgtggtgagctgagattgagccactgcactccagcctgggcaactgagtgagattccatctcaaaaaaaaaaaaaaaaaaagatggagtcttgctatgttgcccaggctggtctcaaacttctaggctcaagcaattctcccgcctcagccttccaaagttctgggattacaggtgtgagccaccacactgggcccctggactatcttctcacttggtcatgggtgaagcctctggggaaagtggtctccattatgaaccccaggaaagtgagaagagtaagatgacatttgcccgcccagctcagacctactaaaacctgcagaagggttggggtgaagagcagggttcaaacaacttcagtacagaaaaccctcctacatttcttgatgaatccactgaccaagatgtaatcttcaaagaaaactccctctttggagagactcctaccttattccatttaaaaattctaggccgggcgcggtggctcacgcctgtaatcccagcactttgggaggccgaggcgggtggatcatgaggtcaggagatcgagaccatcctggctaacacagtgaaaccccgtctctactaaaaatacaaaaaattagctgggcgaggtagcgggcgcctgtagtcccagctactcgggaggctgaggcaggagaatggcgtgaaccccggggggcggagcctgcagtgagccgagatcgcgccactgcactccagcctgggcgacagggagactccgtctcaaaaaaaataaaaaaataaataaaaataaaaattctaggggccaggtgcagtggctcatgtctgtaatcctggcactttgggaggccaaggcagacggatcacttgaggagttcaagaccagcctggccaacatggtgaaaccccatctctactaaaaatacaaaaattacccaggcgtggtggtgcattgcccaggctagtcttgaactcctggactcaagggatcctcctgcctcagcctcctgcgtagctgagattacaggtactaaagttggtggctcaaactcctctgggctgggggtgggcagaggtgaacaggaaagcggtttgggagaggcagatatgggtgtgggcctgggttcttgctgaccgagggagttgggagggcggcctgggcctcaggctgggtggctgcggctgtgctggcgccgtgcccagctcaccaggtccctgctcgggagccacagcgggatccatctccgagccccttccacggagttgcttgcctggaagaagttcctgctgatgtgggcgctgaaatctccctgtatggtcccggggcgcgggaccacactggacccttcgcaggccttgggtagcagggcttcccccgcgggccctcgcgggccctcgcggtgcccggcaaggacgcgctgtgcgcctgcgtccttccccaccagcgtgaagccacctctcaaagcgctggatcccgtcccccacgagccgccgctgtgccccatctggcttcaccacgatgagggtccgctccagggtccaggagggccctcctgagctagggcgcacgaaggcttggcctggggcccacaggccgcagcgaaacccgcagcgcaacgcgcccggaggagccgcctgtgacgcccggtccgcgggccgccggctgagcgctattatcagttaattctacaacatcacaacatgcagcttggagcagccagccaccctgtagtcccatttctcgcaggctcgtgcagcagcgtgtcattggcattcttctctttggggtctatgtgtgtgtgcgtgtgtgtgtgttaacagtgcctcaggccaggcgcgatggctcatgccagtaatcccactttgggaggccgaggcgggaggatcgcttgagctcatcagcctgggcaatatagagagaaaacccccatctctacagaaaagtttttttaattagtcaggcctggttgtgggagtctgtggtcctagctaattggaaggctgaggtgggaggatcgctttagcctgggaggcgaaggttgcagtgagcccagatctgcaactgcactccagcctgggtgactgagccagaccctgtcttaaataaataaataaataaataaaaataaataacaggatcttgctaggttgcccaggctcaactaggttgctcaaactcctgggctcaatcaatcctccagcctcagcctcacgagtagcagtagctgggatcgcaggtggcaccagggcacccggctttagcaccacaatgtactcctatgcttctcaggctgttggaatgaggtggtttaagacgaggttcttcttcagcaggatgaggttctttatgtagtcacacaagaaacttgtgatgaaagagctgggaacctgggtggccatcattaattctctttgatcactatttataatataatgccaacttggcttatattagccagcacttcatctttggatttcttcatttccctggcttttatgcagcaactccccgacccccacccatgcacgcaaacatccttctagttccccagcccctcagtgccttctgctgccatggactgcagagtttccaagctttttcccttcctgactgtattctagatacctagtgagatgtgaaaaaataacatttctcttctttttttttttttaatttttgagacagagtcttgctttgttgcccaggctggaatgcagtggtgcgatctcagctcactgcagcctccgcctcctgggttcaagcaattctcctgccacagccttctgagtagctgggattacaggtgcccaccaccattcctggctaatttttgtatttttactagagacggggtttcacctgagctctgtcgggagttcaccagacggggtcttgaactcctgacctcaagtgatccactcaccttagcctcccaaagtgctgggattataggcatgagccaccacacccgacgtctcctaactttttattatgaaaaacttcaaacacagaaagaagttgaaataatagaacaatgaatgtctacccatcacccacatacctagatttgaattttgttataattttcccatatttgatatatagtagatatcacacttcagccccccaaattttaacatgcatttcctacaaataagaacattctcctactagctgggcatgatggcccacgcttgcaatcccatctacttgggaggcagaggcaggaggatcgcttgaacccaggaggtggaggttgcggtgagccaagatggtgccactgcactccagcctgggcaacagactgagaccctgtctcaaaaaaaacaattttttttaaaaaagaatattctcctaaatacaatgatcacatccaaggaaatttacagtgattcactaataccatctaatattcagtccaaaatgtctttggtaattttactttttttttcttttttgaggtggttttgcccttgttacccaggcttgagtgcaatgatacgatctcagctcactgcaaccttcgcctcccaggttcaagcaattttcctgcctcagcctcccgagtagctgggattacaggcatgcaccaacacgcccggctaattttgtatttttagtagggatgggttttctctatgttggtcaggctggtctcgaactcctgaccttgtgatccacccaccttggcctcccaaagtgctgggattataggagtgagccactgtgtccggcttacatttttgtattaaaacaaaaacaaaaacaaaaaaaaaacaacagaattccagcacctgtaattccagctactcaggaggctgaggcacaagaattgcttgaacccaggaggcagaggttgcagtgagccaagatcatgccactgcactccagcctgggtgctggagcaagactctgtctcaaaaaagggaaaaaaggccgggcacagtggctcacacctgtaatcccagcactttgggaggctgaggtgggcggatcatgaggtcaggaaatcgagaccatcctggctaacacggtgaaaccccgtctctactgaaaatacaaaaaattagccggatgtggtggcacacgcctgtaatcccagctactcaggaggctgagcaaggagaatcgcttgaacccaaggaggcagaggttgcagtgacccaagatcacgccactgcactccagcctgggcaagagagcaaaactctgtcgcaaaaaaaaaaaaaaaaaggaggccgggcgcggtggctcacgcctgtaatcccagcattttgggaggccgaggcgggtggatcacgaggtcaggagagcgagaccatcctggctaacacggtgaaaccccgtctctactaaaaatacgaaaaaaaaaaaatagccgggcgtggtggcgggcgcctgtagtcccagctacttgggaggctgaggcaggagaatggcgtgaacccaggaggcggagcttgcagtgagccgagatcgcgccactgcactccagcctgggtgactgtgcaagactccgtctcaaaaaaataaaaaaaaggaaagtaaaataatatatatttcaaaatagctaagagtaaatttcaaatgactcaccagtaaagaaagggagatggttgttaattaacttgatttaatcattccatggtatatacaatacattgtatcctataaatgtatataattatgatttttcaattaaaaataatattaataaaaataaccaggatccagtcacgtgttttcatcttacatttagttgtcgtctttctccagactcctcactttttcccataacgctggctgtttgaagataaaggaattgtcttttagaattctgaatttgtttcttcaaggttaatttctttttttttctttctttttttttttttttttgagacaggatctcactctgttgcccaggctggagtgcagtggcacgatcacagctcattatggcctcaatttcctgggctcaagtgatcctcccacttcagcctcccaagtagctcggaccacgggctgctctggaactcctgagctcaagggatccttctgcctcagcctcccaaagtgctgggattacaggcgtgagccactgggccggccaaggttaatttcttatacccactattttctccatctgctggaagtcaggtctagaggcttgttattagggctaaacattttgggcaagaccatgacctggggtgatgctccacgcttgctgctgtatcaggcctgaaggtcatctcttcttgcaaatactgggttcactcacttgttggaagtggagactgaagatctctctgtgaaaaagcacatttcctcctttgcagtaagatgtccttattgagctgatactttggactatgcaaatactgacatttcactaactggtttcaccacccactgatgatacctgtctgaatcagtttcatcaagggttataaaatggtgcttttcaaattctatcgtttctgctacatttgttaactgtcactcttggtaaaaaagagctttccctcatcaactgggaatgaaccacagaggcagtaacatgtcatatttgcgtgcctagtagaggtaaagctctttttcattttcaaaactgtcacttgagatagctactattcacattttacaaagagattaaggttaaataacttgcccaaggtaacattccaataagtgacaggagacacttggctccaggattttgctgattaggtaacctgaaatcttcttactatatatacctgaaaacactggataaaatatttataaatgggccaggcgcggtggctcacgcctgtaatgccagcactttgggaggctgaggcgggcggatcacaaggtcaggagttcaagaccagcctggccaacatggtgaagccccatctatactaaaaatacaaaaagtagctgggcatggtggcacacgtctgtaatcccagctactcgggaggctgaggtaggagaatctcttgaacccaggaggcggaggttacagtgagccaagatcacgccactgcactccagcctgggcaacagagcaagacttcatctcaaaaaagaaaaaaaaatttataaatggttgtaaattcatagtcaaactcacaaaataattaaggcaatcccgaggagctgagaatgaattggtaaggcccagcatggtggcccacatctgtagtcccagcattttgggagggtgaggtgggaggatggcttgagccaaggagtttgagaccagcctgggcaacatggcaaaatcctgtctctaccaaaatacaaattagctgggtgtgatggtgcatgcctgtagtctgagctactcgggaggctgaggcaggaggatcacttgagtctgggaggtcaaggctgcagtgagccaagatcatgctactgcactccagcctgggcaacagagtgagaccttctctcaaaaaaaaaaaaaaaaaaaaaaaaaaagcaaagctctttatgcactgccttgtcaggggctggatgatttgctcctggaggaaaagtaaggctttgaactatatggcccacctggagacaaaagaggtcttcagcttctatgaggaggcagctgaaactgagctccctctcttaacaatgaacttcagatgactcaacaatctgagacactaaaatgtttatttttttgagacacagtcttgctctgtcacccaggctggagtgcaaatggcatgatcttggctcactggaacctctgcctcccaggttcaagcgattcttctgcctcagcctcccgagtagctgggattccaggtgcgtgccaatatgcctggctaaagtttgtattttttgtagagacagggtttcaccatgttggcaaggttggtatcgaactcctgacctcaagtgatccgcctgccttggcctcccaaggtgctgggatttggccaccatgcccagacaaaaatgtatgtttcaattacacacacaaggcgggacgcagtggctcacgcctataatcagcactttgggagaccaaggcgggcagatcacctgaggtcaggagttcaagaccagcctggccatcatggtgaaaccccgtctctactaaaactacaaaaattagccgggcgtggtggtgggtgcctgaaatcccagctactcgagaagctgaggcaggagaatcgcttgaacctgggaggcagaggttgcagtgagccgagatcacaccattgcactccagcctgggcaacagagtgagactctgtctcaaaaaaaaaaaaaaaaaaaattacacaaaagaaggaacacaaaacttgaggaacaaatacaaccctaatggcacacatcaatccacctgcatttatctgcacatgaatcccaataaatattttgaaaatctcatcaatttctgggatcgtgtactttatgggattatttaccactgaaattgtcctaccaacaagttacacaacaggagaacatggtcacctgaaaaccatcgacctgtaattaaccagcctttgcttctgttgaaattatagtgtgcacttgaaagggacccataaaatctaccaatttccctgaattagaggccacagggtcttgtctgctgtaaaaacagggacaacttctctgaagtttaccacagtcccataactggcactgtgaaactgcctcaggcaggctttgctttatagatatggtactgtgtgttaattaattctagcatttttttcacatcctcaaaattgtataattggtaacaagtaaatgatatgaaattaagtgagggccaagcatggtggctcacgcctgtaatcacaacattttaggaggctgaggtgggagtattgcttgagcccaggtttttgagaccagcctgggcaacatggtgagaccccatctctataaaaaatttaaaaataaaaaattagccgggcatgatggcatgaacctgtagtcccagctacttggggtgggggggaagcctaaggcaagagtatgcccaggagatcgaagctgcagtgagccatgatcgaggcactgaactccagcttgagcaacagagcaagaccctgtctcaaaaaaaagaaagaataaacaaaagttccaagaggaaatttgggttttttggtgtgtgcatgtttgtgtgctttgttttttactttttttttttttttttttgagatggagtcttgctttgtcaccaggctggaatgcagtggctcgatctcagctcactgcaacctccgcctcctgcgttcaagcgattctcctgcctcagcctcccgagtagctgggactgcaagtgcctgccaccacgcccagctaatttttgtattgttagtagagatggggtttcaccatattggccaggctggtctctaactcctgacctcgtgatctgcccacctcagcctcccaaagtgctaggattacaggcgtgagccaccatgcctggccgcttgttttttactttttaacccaacataaatatttctgaacaaaatgtacattttggaagaatacaaaaattacattataaaacgtcttaatattttatcttgtctgctggtgtcaaatgcactttcacatgtgagggaatctttcagttaatatacctatgttcataaattttttctgaatctcccccactttcttacttttaagacctattggctggggaggtggctcacgcctgtaatcccagcattctggtaggccaaggcaagcggatcacctgaggtcaggagttcaagaccagcctggccaacatgatgaaaccccgtctctactaaaaatacaaaaaaattagctgggcgtggtggtgggcgcctgtaatcacagctacttgagaggctgaggcaagagaatcacttgaactcgggaggcggaggtttcgatgaactgagatctcgccattgcactccagcatggaccacaagagcaaaactccatctcaaaaaaaaaaaatctattagtattaatagtaatattagtacaatagtaataatagtgacaaacacatatagcagttactatgtcccagcactgtagcaaatacttaatttatcaactatattttggagtgtgtactgtttatcattcctattttttaaaatgaagctatgagacacagagacattaaggtcacacagctagtgaatggcacagccaggactcaaaccccaccaatctgattccagagtccacttttaacaattatgctagactggaggtggtggctcacacctgtaatcccagcactttgggaggctaagacgagaagatcacttgaggacaggagtttgaaactagcctggccaacgtggtgaaaccccgcctctactaaaaatacaaaaattagccaggcatggtggtgcctgcctgcaacttcagctgctgggtaggctgaggcaggagaatcacttgaatccaggaggcggaggttgcagtgagccgagatcgcactactgcactccagcctgggtgaaaaagccagactctgtctcaaaacaaaacaagcaaataaagaaacaaaaacaattatgctaaactccctctcagataatggccagcaccagatttgggctccatcatattaacccctcatcattctcaacacacacacacacacacacacacacacacacacacacacacacacacgacagagagagaaatgtatccattccaagatatacctctcatacatgtatttcagtgtcttccaaagtaaaattgtgcagctgtctgtaaaagaagctaaatagggaggaggaggtggggtggagaagggctagatggctgggtggagtagcccaaacccatctaactgcaggaaaatcagggggaagctgtgcttgaaatgtgctaggcccggcctgtgtacactttctcttagatcatgaggaaactccagttcactcagtgcaaggttatttgggtgagccagggcaaatcaggttgagctccaccctatcatccgagtccaggggttggaatagacactggaagggaacgagaggtggggaaggatgcagcaaggcaagcacagatcagcgccccctgcaggtggttagcaaaactccgggtcattgagacgagtttctgaggattcattatcgtcaaaggcaataatagaattggtttggctgggctccgtggctcacacctgtaatcccagcactctgggaggccgaggcgggcggatcacgaggtcaggaattcgagaccagcctggccaagatggtgaaaccccctctctactaaaaatacaaaacttagccaggcgcggtggccagcgcctgtaatcccagctactcgggaggctgaggcaggagaatcgcttggacccgggaggcagaggttgtagtgggtcaagatcgcgccactgcactctagcctgggcgacagagcaagactccatctcaaaaacaaaacaaaacaaaaattagtcaggtgtggtggcgggcgcctgcagtcccaactactcaggaggctgaggcaggagaatcgcttgacccgggaggtggtgattgcagtgagcccacattgcatcactgcactccagcccgggcaacagagcaagactctgtctcaaaataataataataataataataatgataaagataataatagaatctgcttcaatttttcattttcaaatatcaatatccaggctgggcggggggctcatgcctgtaatcccagcactttgggaggctgaggtgggcggatcatctgaggtcgggagttcgaagccagcctaaccaacatggagaaaccccgtctctactaaaaatacaaaattagccaggcatggtggcgcatgcctgtaacccagctactcgggaggctgaggaaggagaattgcttgaaaccgggaggcagaggttgcggtgaaccgagattgcgccactgcactccagcctggggaacaagagcgaaactctgtctcaaaaaaaaaaaaaaaaaaaaaaaaaaatcaatatccaggccagtggttcgtacctgtaatcccaacactttgggacaccaaggtgggagaatcacttgagctcaggaattcaagatcaacctgggtaacacagcaagactccatctcaaaaattcaaaaagtagctgggtgtgatgtcacatgcctgtagttctagctacttgggaggctggggcaggaggatcacttgaaccactgtgtttgaagctgcagtgagctatgactgtgccactgcactccagcctgggcaacagagcaagactccatctcaaaaaaaaaacccaaatagaacaaatcagcagccccccaccaccgcccccagtatttttcaagagacagggtctcactatgttgccaaggctgaagtgtagtggctattcacaggcgtaatcataggacactgtgggcctcaaactcctggactcaagtgatccttccacctcagcctcccatgtagctgggattacaggtcaccgtgcctgcccatcccctgaaatcttgaggtttaggactccacagggtcaaaagaaaacagataagccatagacaattgataacaggcatagtacagcgaggaagaatgtaaatctactaacatcacccagaaacgtgagataggtccacaaaggcagccaacagtagctgatctatgtaaagaaacatagatttggagtccaaagctgtagcacttacacactagctgttagacagggttagttgtttaacttctaaaccttagttttttcatttgcaaaataagactaataagggcttaacttctttacagaaatgtgaggatcaaataagacagccatgaaaatggtttataaagcatcacacaagttctcatttgaagacagtggtataagaccgggccctgtggctcacgcctgtaatcccagcattttgggaggctgaggcaggagaatctcttgaacctgggaggcagaggttgcagtgagctgagatggcaccactgccctccagcctgggcaacaagagcgaaattctatctccaaaaaaaacaaaaaaaaaaagtggagaaattagaactctcactcattgttgacaggcatgaaaagtggtacagccactttggaaaacagtttggcagttcctcaaaacgttaaacagttaccatatgacccagcaattctactcctaggtatacaccccaaagaatctgaaaacatatctttacacaaaaacctgtacacaaatgttcatagcagcattattcataatagccaaaaggtggaaatgacttcagtgtccatcaagtcatgaatcaataaacaaaatgtggtatatccatacaataaaacagcagtccccaaactttttggcaccagggactggttccctggaagacaattttttccatggacagggggtggcagggatggtttcaggaagaaaccatctcagatcattaggcatgagattctcataagcagcatgcaaccgagatcccttgtacgcacagttcacaacagcggcggaaccctggtctgactgaaggtggagctctgggagtaatgcttgcttgccgctcacatactactgtgcggcccggttcctaacaggccacggattggtactcgtactggtacttgtacacggtccgagggttgaggacccctgcaataaaacactgtccatccattgaaagaaatgaagtactgataaatgctacagcatggatgaaacaaaaacattatgctaagtcaaagaaaccagtcacaaaaagccgcagattatacagctccatttatatgaagtgtccagaacaggcagatccatagacagaaatcctgtctctatggagtagtagcatgggttagtggttgccaggggatagggaaacagagaaatagggactgactgctcatgggtgtaggggttttcaggggggtggtgatgaaaatgttctcaacttagtggtgagtattgcacactctttttcttttgttttgttttgtttttgaaacggagttcagagttttgctcttgttgcccaggctggagtgcaatggtgcgatctcggcttaccgcaacctccacctcctgggttcaagagattctcctgcctcagcctcccaagagctgggattacaggcatgcgctaccacgcccagctgattttgtatattttagtagagatggggtttctccatgttggtcaggctggtctcgaactcctgacctcaggtgatccacccacctcagcctcccaaggtactgggattacaggcgtgagccactgcacccggcctgttgtttttttttttgagactaagtctcactctatcatccaggctggagtgcagtggtgcgatctcggttcaccacagcctccgcctaccgggttcaagcaattatcctgccttagcctcctgagtagctggaactataggtgcgtgccaccatgcccggctaatttttgtatagttttagtagagttgggatttcaccatgttgaccaggctggtctcaaactcttgaactcaggtgatttgcctgccttggcctcccaaagtgctgggattacaggcatgagccactgcgcccagccaacattgtatttttaaaaccactaaattgtaccctctaaaagggtgaattttagggtatgtaaattagatctccataaaaaagagaagtgctggcatgagaaatagatcaagactaaagtttagctcatagatggtctctagggtgtgatggaaggaggcagtcaacaagccttgatggggagaagaacaaagggattgaagggggacatatgcggcacccagcagtatgcatagtggtgaaagataatggggctgcgattaggagcaaaaagttctacattcaatgcttttgaaatcgcatgtttcctctcaaactcaaccacttccctgacgccacccatcacaccagaaatatgtttactgaagacttactggcttaagtaatagaataacagctgttattattagaatacttcaaaaatcagactaaagaaaggactgggcctttcaacgtcgcatccatgatggtttattgaccactaccttgctagattgtactggttactgaacgccagcaggataaaagggtgtctgtagttcttttaccagtacccttgctacacctccttacctcttaatacagtctgcacttccatatggtcgtttacagttgtaaattatttcaaatcttaaatcaaaattcctctacatgcatttgcctgcaggatttgctcttactggttttggcctatggaaccaagtttgaatttttttttttaattggctgggtgcggtggctcatgcctgtaatcccaacactttggagaccgaggcgggcggatcacgaggtcaggagatcaagaccatcctggccaacacgatgaaacccgtctctaataaaaatacaaaaattagttgggtgtggtgatgcacgcctgtagtcccgggtacttaggaggctgagacaggagaatcgcttgaacccgggaagcggaggttgcagtgagccaagatcgtgccactatactccagcctggcgacaagagtgagactccgtctcaaaataaataaataaataaataaataaataatttaattagctgagcatggtggcatgtgcctgtggtcccagctactcaggaggctggggcagaagaatcccctgagcccagggggtcaaggctacagcaagccacaatggcaccactacactccagcccgtgacagagtaacccagtctcaaaaaatacaaataagtgtcttgtgcctattccagacccactgaatcagaatctgcattttaacaagaacctcctcctctcattcatttgcacgttaaaggctgagaagccctgctgtggagactggttccaactgcagcaggtcatgatcaggtgagtgtgttgcagtttagtaaagcattaaattgtaggaagaatgtttttggtattttaaggcaatccaacattattcctataaatgttagacattgttataatgttactgacttgcatgtatacttttctgaaagtaaaagctatacctaacacaggaaattcaatgtgtcctgtaggccatcgagtgtccttaatggtgatgtcaaggaaaagctgttggatgtcttgcctttgcctgcctcaggctttaacacaggatgtcttgtctgcagggcactttttctgccattcagatctcaattcaaatgacctttccatggccacactagcccaggccccctatcgaaagcagtcaccagttttatgaagggccacaactgccttattaggatatttcatattaggctactggcaaaacaaaacaaaatctcccaaatctcaatttatctcttgtttatacaaaatctgattttgggggtgggagctctccctctatccatgacacagagatccaggatccctcctgtcttgtgactctgccactttaacacatggcttccaatacctccatgaaacagagacgatgacaaggagggcacacggcacatgacgtgagttagccatgcagcaccaaccaaactgcaaagggcctgggaagtggaagggaccaagtgggctagtttgatgagcacttctgcaaactgtgttctgctcacagcatctctagcactagtacagtgcctgtatgcacaaggactcaaatatctgtaaaatatgtggataccttcattttactaaaaaggtcatccattaacagttttaggccgagcgtggtggtgcctgtaatctcagcactttggaaggcaaatcacctgaggtcaggagttccaggctgaggtcaggagttccagactggcctggccaacatggcgatatcccgcttcttctaaaaatacaaaaattagccaggcgtcatggttggcgcctgtaatctgagctacttgacaagctgaggcagaatagcttgaacccaggaggcataggttgcagtgagccgagattgtgccacggcactccagcctgggtgacagagcaagactctgtctcaggaaaaaaaaaaaaaaatggggaaaccccgtctctactaaaaatacaaaaattagccaggcgtggtggcgtgcgcttgtagtcccagctacttaggaggctaaggcaggagaatcgcttgaacccaggaagcagaggttgcagtgagtcgaaactgcgccactgcactccagctggggtgattggagcaaaatcccacaaaaaaagctcatcactagaacctaaaaaatgcttttatttgctcaggtactgtgtggtgttatttcttctatacactgatgaggggctgagataaagacctagtgaactaaacaaagtgcccaggctagttctggggaagtaagatctgaggcatattctattatcagcaatggatctcttcctgtcattcaatacaaaggaataagcgctgtcttaagacaatttgcaacagagcacttcctttatcaacactgtaaacttgtttaaaggtttgtgaaataagtcctggacactgaaaagtaataaaatacggccactgcatgagagtgagtttgtattaaccacttcagatgaacaagtatgtttttaaaaattatttctcagccgggcgaggtggctcatgcctgtaatcacagcactttgggaggctgaggcaggcggatcatgaggtcaggagatggagaccaccctggccaacatggtgaaaccccatctctactaaaaatacaaaaaaagtagctaggcatggtggcatgcacttgtagcccagctactcaggaggctgaggcaggagaatcacttgaatccgggaggcagaggttgcagtgagccaagatcgcgccactgcactccagcctgttgacagagcaagactccgtctccaaaaaaaaaacaaaacacaaaacaaaaaaaaggattttgcttaattttccttataaaatgacagcttaaacaagatttcaagacagggcaggctgtttggctcagtggcttctcaccccaaaggtttatgggttgctcatattccatgtccctcatgggttaactaagtgtaccagcatggtgacccaggctggtagaacagccactttgcaaaatttaccaattgcctggaaagaggatcacgtatgggatcttaaactttcatctggcaatgacacttctcacatttcagcctaggtaagtcagctgggccttgcaattgaaccacgaagccacaaagcagggttggaaatctgttgccagtactatgactaccatttcaatatctacctttatcaatatcaagcctctttctcctcctttatcaactacctttattaatatcaagccccttctctcccccaaatcactggcatgatgtgaaatcacttattgtgtacagtggcagggaagaggctgaaattgtagttttgtgcaaatgagaaggtgagacgttccacccatcaatgtttacacctcagcttcttttgcaacaggcaattaacacttggggaaagaagagaactcgctctcaatgcagccattgagggtagcaatccacattacagactactcggactagtacagaagcttccactgccttttccaagatacaaaagagttgctctaaacatacacttctctccatcccagaagtgaccaactgccactccctggaccttgctatccccctctccctgttgcagattcagatatgcaaacgatgcttcttcctactttccagaattgctcaaggctctctccacctcctagctccagcactcccaacccattctcaggctcttccccatccctctgcatgtccccagcatagcctgactggtacacctgagggtggacttaactcccctgggagttagctgctgggctacaagcttacagaaacagaccagactactcagtggatccccagttgttatcatgaccacagtataagcccactcagaaatgattcctagatgtttaaacattttccgatagcattttttgagttggagtcttgctctttcgcccaggctagagtgcagtggcgagatcttggctcacgccactctcctgcctcagcctcccgagtagctgggactgcaggggcccgccaccatgcccagctaattttttgtatttttggtagagacagggtttcaccatgttagccaggatggtctcgatctcctgacctcgtgatccgcccgcctcggcctcccaaagtgctgggattacaggcgtgagccaccgtgcccggcccccatagcacaaattctttatttttttcactctattgcccaggctggagtgcaatggcatgatctcagctcactgcaacttccacctcccacgttcaagtgattttcctgcctctgtaatcccaaagtgctgggattacaggcgtgagccaccgcacccagccataaattcttaacataaatactaaaatcgaggagcagttatttttacaagtgtggaaaaaaggtcacctgaaggtcttccatgggagtagcagaatggttcttactcacaaaaaattcacaataatgaaaactccttaaaaattcacgaaataattatgcagaacaataagctttcaaaatacaattatattatgaccttcccccgttatctaagggcatgaagcaagttcaaccgcaagtgcatggtagcagaaaactgccagtgccttttgctcaacaggtggcccagcgttagtcttgaacattttcaagtataggattgtttgatgaccccggctagttaaggtttccctttctctctcacacacatttctcaaagtacctatcctcccgaatatccgacaagggaccgatcgaagagtcagtgaaagaaaaacatcattattctttgacatcggcacatttcaaaaacagctcattacacagaacagccaactttttttttaattgttttatttgggaaaagtgcttcttacaaaagggcagctgcaaaatacagagacctctgcaacaattatttgttttttcttaaagtgaaagaatgggtgggatccaaggaatcaaagcagtagatggacaaaccaggagcatccccgagttattttcaggaaacagagcaacaaaacacaaaggtacaatttccaatcaaggaattcttccaacaacttaactttagctaatctcagggattcccaagccctccctttcggtggaaaagtatgacttatcactgcaaacccattactccactacaataaacaccttagaacagagttttgaatcacgtctgtctacctgaaagctcaggggtggaatgaggcaaatacccacaaaaacaaacacaaaaacccgacaacaaaatgcctcaagtgaggacaaaggtttctcagaaagtgcctgtactggaaaggctagatcgtaaaacattaaatacaactgtgtatccaagacccagtttgtgttattatatgggataaccaggtagttttaacctctatggctaaccccatttctctatttatatagacagagctagcactgctatattgacaactaccaatatactgctttgccctttaagatctatctgccacacaaggcttaaaccactaaaccaggtttttctactaaggctaagaatactgcatctatgcagggatgagaagcttatcacacacccacacactcacaccatgtcagcccttgggagccaacttccaactctgcattgatgttatgcctctctatcttttatacgtattctttctcaattttcctatcatgcaaaacagtaaaaaatctcaacacattcacacctgattctggttacccagtagtattacttgtgtgcaattaaacaagagaccaaaaccacagaacaagtgcacgtggtagggattacagggtagggaacagatataaaaacacagatgtgcagatttcaccagaaacctcaaggatccacatcccatgtctggggcagagggctattggccagcttaggtcccttcacccatcactcctattcttggaccccaaagcagggccactgcttttacttttgaacctggggtcctcaaaatgagtgtgtgaaaagtccataaatgcaatctggttgaaaacagatgacgcaacacacctacactaactgtctgacagttaaattcgtgttacaaaaaactaactttaagatttatttttgtaacttttttcaacagggaaaacaacacactcctcagggaaaggtgaggggttgagaagacaggccctgggtaaaaattcttaggacagcacctggagttgagaggcctgcctaggagagaacacaggcactgccacaccaccacaggggacagctgctgtctgaggtcagcagaccagttcacacgccacgcaaggttgctatagatccaagtcataaaaatcttccagctcatcatgaaacaagtcccactcatcttcagagtctgttagttcgtcgtccccacctgcagccaaaagcataagcaacatctcgcccagctcaaaggtgacaacctcttcttcatcgttgtcaaaggggttgctgttctctctttcctcaatgagttcccagaagtggttccttcgttgggcctgtaaaaaacaaggccatgatagggatggcactgtcgagcagtatcttctatcctgttgtttataaggcaaaacgtccagcacaccagagggcatgacgaaccagacttcttagttagggtttccatttaccacttcctcccctctggttacttcatggaaatcgtttaggctagagctttaacacacattttttcttcctttcctatccctcccagttttctgaggtttgtttcctcctttaatactctacactttcgctcccagacctgagcgttaaccttctccttcccctaccccaatatgtgcaggactcaactgataccttggaatttcccctcctttaaaaaaacagtgagagttacccggtatctgcttgatgttcccactttctgtctctgtggctcctctctacggccatcagggtacgcatgcttgtaaaaacagttccctccaaatgggcagctcccacgtccttcatcaaaatacctgcacgccttgttgctggaaaggaaaatatcgcaacccttattcacagtggatttcaggtctgtatttgactatcatccggggtttctttaaacaggtagggatagaaccagtatgtcagcttacagccctccccaagatgtgttcttataaacatgtgtgtgccaatgcaagaaacactaactagaaaccggtaactctgttcaagtctatgctggttaatagctctagtacaagcagatgccatagagagaaaatcttctagaaagccaacacatgagaacataggacagctatgacacggattcagaataaggtagaaccccactcatggggccttacttgtcaacagtagagacctctttataacacagtcccttggcatggaccccaaggactgtgttatagcaagatatatactggatgttatcagggtgacaaaataaactgtcctgggaagtcaaagaagggtaggaaggaggtaggagtgtataatgcagcaccattcttttcaaagtgaacccaagctctgttgggctcttcgcttgagaaaaggctgcagtgctcatacctcattgcctccttgtatttcagaatgagtttctgcttctcttctttctcctccacccagtactcacttggaatgacaaagttagatgtgatccggcattctgggcaggacctgggaaacaatgaacaggctgcaatgcaaattccccttttacaggcccactcttcaaggacacaccctggtgtgtcgcctccagacttaaagacttaactgaaaggcacgtgggcatttcctgaaagggttccacatactgtcacacaactgaccatttctttcaagcaaggcaacctcctttataaatccaactcaagggctagccagttctttttttttttttttgaaaaatataacttaggtaaaaaacaaaaacaaaagaagacatttcacacagactcctttttctttcgtttaaataaatttatttcttgtagctttgctctgtttagattatgtggtttttgttcagttatgagaacaatctttaaaggatggtggattgttggctagcttaatgaatggaataggaaagtggaaatgtaaaacgtcaggaaacatacattcagagctagatcagtttgttcactgagcctaaactggctaataatccattaaacacaatctcctcagaaaaagcacgaagattctaactgatacacagggtttcctcattcaaataaaagtagatagaccaactaacctagaagctagctgaaatacaaagaagaaatccccattagaatatcccagtttcaagataaaatgcatgcatttaaatgcggtccatctggttgaaagttggcacaagttactaaattcttccccaaaagagaaagcacaaatgaagactggggaggagtctcactttatgatcttgctctcaaattgcttagcactcctccacttgcgaatgcacttgagacagtaggtgtggttgcagttggagaggatcccgaagcggcgctcactggggttggctttctcatagaccacctccatgcagatcccacacaccatgtccttgctgcgctgcacggcaaatgagagctccatgtccttctcatgggcctcaatgcacgactagagaaggtggagagagaacaagtggaatccagtcattgaaccctgaaaaacttgagcaacagttaatgattcacagtcaaagaatcaaatagtcaactgaaaaaacaatgttcccaagctgacacgaaaattagctttgctgacaagtaaacacaggtgtggtgttttttttttgtttgtttgtttttgcggtggtacttaacaatactagaaaatcaaactatgaggactcaacttcgggaactgaaaaattacccaattttctctaccccaaacctggagctcaactacattaaagacggttttccatactgtttgttatttctggtttctacatgaggttaagaccctagttaaaacctgtcggaaaataagggtgacaggcacgtaaactctcttatgcctttaaagaaaaacaacttcatcgagatttttcaactactcagcttgatagactgatgcacacttaggttaggttagattagcccactttggggctattataaataatgctgccaagaacattcatgtaccaatttttgtgtggacatcatattttaacttataaaaaacatgattataggaaacataaaaatgcagaaaactcccagcactttggaaggccaaggttgggtggatcacatgaggcctggagttcgagaccagcctggtcaacatggcgaaaccccatctctactaaaaatacaaaactgaggcaggcgtggtggtgcatgcctgtagtcccagctattcgggaggcagaggctgcagtgagccgagactgcactgctacactccagcctgggggacaaagcaagactctgtctcaaaaaaaaataaaaataaaaaaaataacactgcagaagagcaatgtcatccataatctcacatcatcactaaacatgtcttttcctaaacctttaaaagaaaaaacatatatacatatattcagaggtaggttctactacctcaatatatagatataacgtatagagatttatcctgcctaaattcacaaaagtacgctgaagatagggatcaaattatgtctaccttataacatgcctcacaccctaaaaccacatttaaaaagatggaaatttaaaagagatggaaatgattagaagcaaactttgctccaataaagttaaagtttctaacacaatgtcttctgaacctaccctggctcccatacactgctgctggaaatgtaaaatcctgcagccactgtggaaaagtatggcagttcatcaaaacgtaaagcagagttcctatgtaacccagcaattccactcctaggtaacggaaaacatatcttcacagaaaaacctatatacaaatgttcctagcagccttattcataatagccaaaaactggaaatgatctaagtgtccatcaactcatgaatggaaaaacaaatgtggtctagccatacaaagacaataattcagccatcaaaactaagaacggctacacgcaaccacacaaagaaccttgaaaacactatgttaagtgaaagaagtgaagtcaatcacaaaggaccacattacaggattccatttacatgaaatgtccacaataggccaatccagagacaaagcagattcgttattgccaggagctggaggaaggctggaataaagagtgactgctaatgggtgtaggatgatcaaattatcctaaaattagtaaaatggtaatggttgcacatctctgtaaatatactaaaaaccaatgaaatgtgcattttcaaaagattaaacatattcaatgtgaatctcagaaacattattttttaaaagaggaaaaaaatgttagaagtctatagtctgagtttctggaagtaggacttctttttttcttttgcctcaacctcctgggcttgagcgatcctcttgcctcagcctaacaagtagctgggactatagacacatgcctccatgcccagttaattttgttcactggaaatatgacttcttgataaagcatccaagaagcccaagaaaggaaaacttccctactcactgataaccattcaattcatcaaatgtttctctgaaataaacccacaatgctgtgaaagggcaaataatgattctcacatctaataacacacacatctccctaaagacttactttgatatgctgcgatctctgggcagcatccattggatgcaggacctgcagcccacacatgtcacaagaatctccgtggagatacacacagttctccccgtatcggcactctcccactgcagcataggggcacagctgcttctttgtctccacggcggtttgctctttctctgattcttccttggtcactgagccctgcaggggtgcttcagtgcaggaaggcgcagctgaaaatgtgtaagagggtggtaaaggtccaaatagataaggcatgaactataagagaactgagaatctaaccgcaaaaaatgaaaataaaactgcaatgaaataccaaaacagtctactgaactaacttcttcacttgaaagaaaggaattttttctaccgctgttatttccaagattagacttgtaaaaaaaaaaaattgcttctttatctatgtcttgggtaactgaaatttaatttcaaaaagtactcgaaaggattcagtttttcaaaacattctgaattcatttcactgggattaaaaatttccttcactctatctgtaaatcttaggtaatccaaattaaagtactgtactaagattaaactaaaaaaggaatagaagcagaaaggggaaagttgtcaaaactaagcaaatggatgaactgctatccagccctctaactcttattttcttcttcagaatacttactacggccacagtagggttgcccaggaacaaactcaatagcattcacccagtcctctgaacctgctcctacagttgcaaagtttgaatttcttgactcagcttcgcctgtattcatttcaacaagtggtccaactatcgatgagagacttgaggaagcagcaagggatgactttgtagttagctctgtagcagttgcttcttcctgtttcaatggtttgctatgttcatatctaagaaaaaattcaaaagtaagcagtcggccagtcgtggtggctcaagcctgtaatcccaacagtttgggaagctgaggtgggtggatcaccagagaggttgggagttcgagaccagcctggccaatgtggtgaaaacccgtcactaccaaaaacgcaaaaattagctgggcatggtggcgcacctgtaatcccaactactcgggaggctgaggtaggagaatcacttgaacccaggagacagaggttgtggtgagccgagatcatgccactgtactccagcctgggcgacagagtgagactccgtctcaaaaaaaaaaaaaaaaaaaaagtaagcactcactgcctaacttcatatatacctttttcttttctttttttttttttttttgagatggagtcttgctctgtcatccaggctggagtgcagtggcgtgatctcagctcactgcaaactctgcctcctgggttcatgggattctcctgcctcagcctcccaagtagctgggattacaggcgccagccaccaaggctggctaagttttgtatctttagtggagatgccgtttggccaggctgatctcgaactcctgacctcagatgatccacccacctcagcctcccaaagtgctggggttacaggtgtgagccaccacgtacggccatatattcctaatacattccttggattctctttgagcatcaatgtgcctgtatttgtgagtgcagagagaagcctatgattctgcatatttagttataccatgtgtgatgccaagactgctggtccagagaccatacttttgagtaggaaggcaatagactgggggtcaccaaagtttaaagcatcaaatacacaaatattttaggctttgtaggtcatacaatcaacatcacaactacaagtattcaactctgaaactgcagtgcaaaagcaggtgtaggcactatttaaaggaatgtgtaactgttccgatcaaacttgatttatgaaaacggcctttggccagatttggcctgtaggcccatacccctggctatataccacttattacttcaaattccactctaattaggagtttcagatagttgacagtctatagttcccatggtaactctgccagaaaccctgcaggcaaaactgactgatttcaaagcaaggctgacacaaggtcaataagcagacatgtggaacattttaccaacacatcaaataaaatgctgtcactattaaaaggtagagacaatatttatacaatacacaatatgtacattctttttctaagaaaatccatccattcaccatttccccttccaaattttgcccctatgcattctctccttttcatctgtaaacattaaaccaccaccatctccaaatacgtggggaaaatacatctatttccttcaagaaccttctttctggcctggtgcggtggctcacacctgtcatcccaacactttggaagtccaaggaggccagatcacttaaggccaggagtgtaagaccagcctggcgaaacctggtctctactaaaaataaaaaattatccgggcatggtggcgcacacctgtaataccagctactcaggagaggctgaggcataacagttgtttaaacatgggaggtggagggtgcagtgagccaagatcaggccactgcattccagcctgggcaacagagtgagactctgtttcaaaaaataataaaaaaaaagcaaagcatagcaagcatctttctgcctgagaaaattctcacagttcctgctggacgtggtggctcaggcctgtaatcccagcactttgggagggtgaggcgggtggatcacctgaggttgggagttcgagaccagcctgaccaccatggagaaaccccgtctctactaaaaatacaaaattagccaggcatggtggcgcatgcttgtaatcccagctacttgggaggcagaggcaggagaatcacttgaacctgggaggcggaggttgcagtgagcctagatggtgccattgcactccagcctgggcaacaagagcaaaactccatctcgaaagaaaagaaaagacaattatcacaattcttttagcattttacactaagaaattgactgattttcagagactcactctatctcctaggctggagtgcagtagcgtgaccttagctcactgcagcctcgacctcctgggctcaagcaatccgtctgccttagcctcctgagtagctgggacgacaggtgtgtgccacaatgctggtctaactttttttattttttgtagagacaaggtttccctatgttgtccaggctggtctccaactcctgggctcaagcaagcctcctgccttagcctcccaaagtgataggcatgagccaccgtgctcggcacaccgagttttattcagatgctatgtattaattatgcatatagtaaatttaactgtgctacataatttatagtttgttatcaagtggttcttataatgaaacattactaactttgggtcatctgtgttataggtgcctatgtttatacgcaaaaataaagtaaaatctaactaaaggctctactccagcttatggcaaacattttactgagctggtctttaatcattgttattattacctcaaacattcatattctagcactctgggaggctgaggtgtgggtggattgcctgagctcaggggttagagacaagcctgggcaacatggcaaaactccgtctctactaaaaataaaaaaattaggcagggcgcagtggctcacgcctgtaatcccagcattttgggaggctgaggtgggtggatcacgaggtcaggagatcgagaccatcctggctaacacggtgaaaccccgtctctactaaaaaatacaaaaaaattagccgggtgtggtggtgtgcgtctgtaatcccacctacttgggaggctgaggcacaagaatcacttgaacccaggaagcggatgttgcggtgagccaagaacgcaccactgcactccactctgggtgacagagctagactccaactcagaaccaataaagactatgcgcggtggctcatgcctgtaatcccagcactctgggaggccaaggcaggtggatcacttgaggtcaggagttcgagaccagcctggccaacatggtgaaaccaccatctccaaagacattcatattcctcctcttaagccttaggtaaactacctcgccttgcagcaaaagtaagctgagtatcctgctatcatccacaaaaacccaatgcattgttctatagagtggaatcctataagctgaaggataagggaagaaactatcatgaatatgctctttcactttcactcatgaactgtggggaagtattctatcattttagagatgacctcactgtcctactaagtgatggggttctaggtctaatgggactctaaagctgctctatacagtacagccaaccactgcccacatctaactcttcagacttacatacaattttaaactcagttcttcagtccttcctctagctatacctgcaagtgttcaaaagctacatggagctagaagctaccgttagatagcaacatgaagaacatttccagtactgcatgaagttctactggatggcagtattctgaaatgttagagcagcaagtatccttagaaatccagcccaggctggacgcggtggctcacgcctgtaatcccagcactttgggaggccaaggtgggcggatcacaaggtcaggagatggagaccatcctggctaacacggtgaaacctcgtctctactaaaaatacaaaaaattagccgggcgtggtggcaggcgcctgtagtcccagctactcgggaggctgagggaggagaatggcgtgaacctgggaggcggagcttccagtgagagagctgagatcgcgccactgcactccagcctgggcgacagagcaagactccatctcaaaaaaaaaataaaaagaaatccagcccaaagcctcacttttcattttacttttgttttgttttttgagacagtctcactctgtcacctggctagagtgcagtggtgcaatctcagctcaccggcttcaagtgattctcctgcctcagcctcccaagtagctgggattgcagatgcggcaccaccaagcccagctaatttttgtatttttagtagagacggggtttcaccatgttggccaggctagtctttgaactcctaacctcaagcaattcactggcctcagcctcccaaagtgctgggattataggcgtgagccaccgcgcccaggcccaaagccttacttttcagattaagtaactcccttggagccaagcttcatggctccagcctataattccagctagttgggaggctgaggtgggaggattacttgagcccaggaatttgaggctatagtgagtcacgatcacaccactgcactccagcctggatgacagagcaagactatcctgtcccttaaaaaacaaaataagccaggcacggtggctcacacctgtaatcccagcactttgggaggccgaggtgggcgatcacctgaggtcaggagttccagaccagcctgatcaacatggagaaaccccgtgtctactaaaaacgcaaaagaattagctgggcatggtggtgcatgcctgtaatctcagctactcgggagactgaggcagaagaatcgcttgaacctgggaggcggaggttgcagtgagccaagatcgtgccattgcactccagcctgggcaacaagagtgaaactcagtctcaaaaaaacaaacaaacaaaacaaaactccctggtttaaaagataatttccaaaaaaaaaaaaattagttatttttacaagctttatattttttgttttctttgagacagggtctcactctgtctcccagactggagagcagtggcacaatcacaattcactgcgcccttaacctccctgggctcaggtgatcctcccacctcagtctccccagtagctgggactacaggtacacaccaccacacccagctaatttttattttgtaggtacgtagttttgccatgttgcctaagttggtctcctgggctcaagccatcttccccgcccagcctagtacaaatgtctaaggaagtttaatcaatttttctgtctctgtaagagaaaataaccctttccctggttggtttacaactcccaccccattgcttctgtggcctttagtattttaaagtattggattcttcagttggtccaaaaaccaaaactccaaacaagaagtcaaccaaaccaggccaggcacggtagttcacacctgtaatccccagcactttgggaggccgaggcaggtggattacttgagggcaggagttcaagaccagcctggctgacatggtgaaaccctgtctctactaaaaataacaaaatttagccaggcatggtggcacatgcctgcaatcccacctactcgggaggctgaggtgggaggtggaggttgtgacattgcaccactgcactctagtctgggcgacagagcacgactccatctaaaaaaaaagaaagaagtcaaccaagccaatattgcccctttccccagagggtgtccagaaacaaagactgggagttctaatggcattctgggaaaatactagactagatatctgcaatatgcaaaacagtcccgagcaacaaagaactggcctcactaaacaaaagcaccaccattacgaaacactgatgcagaaaatcctctcaactgttggggctatgatgctatccttcattatcaatgatctactccctctgtgaagagggaaatccctgggctttgagcaagttacataaagagatcccaacactaagagtaagaggtaggtggccgggtgtggtggctcacgcctgtaatcccagccctttgggaggccgaggtgggcggatcaggaggtcagaagatcgagaccatcctggccaacatggtgaaaccctgtctttactaaaatacaaaaaaattagctgggcatggtggtgcgcgcctgtagtcccagctactcaggaggctgaggcaccggaatcgcttgaacccaggaggcggacattgcattgagccgagatcacgccactgcactccagcctggtgacagagcgagactccatctcaaaaaaaacaaaaaaagataaggttgaagttcctagatatcattctaacaggaaaacaagcagtcatagagcaagcctctctttaagattctttctttagctagtccacaatcaaccttttaataatcacctatatcagcctgtactcaacaattatcaccaaactttcaagtagactactatagtttctctacttcctttcactttatgctaagagatctaaacccagctcaattctggctcatcctctaaagagttctagaaaagaggcagctacatccttattaaaaggaaaattaagaggccaggcccagtaggctcacacctatgatcccagcatattgggaggcaaaggtgggagcatcagttgaggctgggagtttgagaccaacctcggtgagatagggagaccccgtctctacaaacagaataaaaaaacttaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacgtgggaagcggagcttgcagtaagccgagattgcgccactgcagtccgccgtccggcctgggcgacagagcgagactccgtctcaaaaaaaaaaaaaaaaaaaaaaagaataaaaaaacttagctggaggtggtggttgcagtgagtcgtgttcacaccactgcactctaacctgggcaagagggcaagaccagatctcaaaacaaagaaagaaacaaacaacaaaccaattaaggttcctttcaactttttctttttttttttttttgagacagagtttcgctcttgttgcccaggctggactgcaatggtacgatcttggctcaccacaacatccacctcccgggttcaagtgattctcctgcctcagcttccagagtagctaggattacaggcatgcgccaccatgcttgggtaattttgtatttttggtagagacggggttttccacaggtcaggctgatatcaaattcccgacctcaggtgatcctcctgtctcagcctcccaaagtgctgggattacaggcatgagccaccaagcccagccgccccctcccccactttcttttaagacgaagtctcactctttgcccaggctggagtacagtggcacaatcaaggttcactgcaaactctaccttcccaggttcaagtgattctcccacctcagcctcccaagtagctgggattactgacacgtgccaccatgcccagctaatttttgtattttcagtagagacgaggtttaaccatgttggccaggctggtcttgaaatcctgacctcaagtgatccgcccacctcagcctcccaaaagcgcggggatgacaggtatgagccactgtgcccagtccctttcaacttggagccatctgcatctgcctcaacgtcagaggctcaccaaaatagggaacctacctaatttcctctggtctcaaactatttggggcgggcaaagttgcctgaaaaataagatggttaatacacagagcccaggcagggggctgtggctcacgcctgtaatcccagcactctgggaggctgaggcgggcggatcacctgaagccaggagttcaagaccagcctgaccaacacggagaaaccccgcctctactaaaaatacaaaattagctgggcatggtggcacatgcctgtaatcccagctacttgggaggctgaggcaggacaatcacttgaacccgggaggtggaggttgcggtgagccgagatcatgccattgcactccagcctgggcaacaagagcgaaattctgtctcaaaaaaaaaaaaaaaaaaatgcagaggcttagcacagatttcttcaatttaaccttcatttttttcattcactccatctacacagtccattcagatgagcacttcttctgaaataaggaccaactgctaattatctatagctttctgattctatctcacagtctattctcatccctctgcttgggaggttggattcttcactctcatcaatattcaactcctcctgccccagtcacagttggcagtaactctcaaaagactagaacccagttcaaggaacacagctcccttacaattagcctcaatacctgcagagactataccactacaaagattcgtccattcaccattgcagtgtgaagttctcatgactctgccttttatattgggactgcaaaagacatgcctggtggagaggccaggtgcggtggctcacgcctgtaatcccagcactttgggaggccgaggcaggtggatcacctgaggtcaggagtttgagaccagcctggccaacatggtgaaaccctaactctactaaaaatgcaaaaattagctgggtgtggtggcacatgcctgtaatcccagctactccggaggttgaggcaggagaattgcttgaaccagggagtcggaggttgcagtgagttgagatcatgccacagcactccaacctggcgacagactgagactctgtctcacaaaaaaaaaaaaaaaaaaaaaaaagacatgcctggtggagagtttgagaataatgtcattgtgtcattttccccctttttcagcaataatgcaatgacaaattagcaaagggcaaaatgagtagcaactaaacaaagtttctatgagatcaacttctgaacttctacacagtcatttgaaaaagatcttctctttcccctcatccttactggactcttaataaacagatgtgggatgacttaacattaatatcccacaccatcaataatgtcaggttctgaactctatttgaacccagtggctcacactacattttctgataatgacattaaaattgactatgactatggcacagtggctcacgcctgtaatctcagcactttgggaggctgaggctggcggatcacgaggtcaggagatcaagaccaccctggctaacacagtgaaaccccgtctatactaaaaatacaaaaaattagccaggcgtggtggcgggcgcctgtagtcccagctactcaggaggctgaggcaggagaatggcgtgaacccgggaggcggagcttgcagtgagctgagatcccaccaccgcactccagcctgggtgacagcgagactccatctcaaaaaaaaaaaaaaatttactatgacactgtcaaaagtcttaccgagggtagtggtttaaagtacatacaaaactctttgatatgccttccttcaaaaggtagagcccaatcctctccctttacatgtgggctggacttagtaacttagtccagaatcagtggaaataacagtatatgacttctgacactaggtcataaaaggcattgtggcttttccttgcctcctctgttaaattgtttgctctggggaaagctagctgccaagctgcaaggatactaaagtatccctatgaaaaggcccatgtgggccaggcggggtggctcacgcctgtaatcccagcgctttgggaggcaaaggcaggtggactgcctgagctcaggaatttgagaccagcctggccaacatagtgaaaccccgtctctactaaaaatacaaaagttagtggggtgtgggccgggcgcggtggctcatgcctacaatcccagcactttgggaggctggtgtgggctggtcaggagatcaagaccatcctttcaacaaggtgaaaccccatctctactaaaaatacaaaaattagctgagtgtggcggtgcatgcctgtaatcccagctactcgggaggctgaggcaggagaatcacttgaacctgggaggtggaggttgcagtgagctgaggctgtgccactgaactccagcctggcgacagagctaggctctgtctcaaaaaaaaaaaaaaaaaaaaaaaaattagccaggtgtggtggtgcatgcttgtaatcctagctactctggaggccaaggcaggagaatctctcgaacgcgggaggcagaggttgcagtgagctgagatcatgccattgcactccagcctgggtgaccagcaaaactccgtcttgaaaaaaaaaaaaggccaagtggtgagaaaccaaagtctcctgccaacagtcatgagagtaagacctcttaaaaacaatactgggctaggcaccatggctcacggctgtaatctcagcactttgggaagccgaaccgcgtggatcacctgaggtcaggagttcgagaccagcctggccaacatggtgaaactccgtctctactaaaaatacaaaaattagctaggtgtggtggcgggcgcctgtaatcccagctactccggaagatgaggcaggagaatcgcttgaacccaggaggcggaggttgcagtgagccgaaattgcgccactgcactccagcctgggcgacaagagcaagactccatcctaaacaaaacaaacaaaaaaacccaaacaaacaaacaaaaaacaatgctggctgggcactgtgtctcacacctgtaatcccagcactctgggaggccgaggtgggcagatcacttgaggtcaggagttcgagactagcctggccaacatgatgaaaccctgtctctgccaaaaatataaaaaattagccgggcatagtggcacgcagatgtaatcccatctacttgggaaactgaggcaggagaattgcttgaatctgggaggcagaggttgcagtgagccgagatcttgccactgcactccagcctgggcaacagagggacaagactcggtctcacacacacaaaaaatatcctggagtccccatcaagtcttcagatgacttgctaaaattttgactgccatctcataagtgtctctgagatagaaccatccagctaaggcactcacagaatccggaaccccagaaactgagataataaatgttcactgttttaacctactaaatttggggatgggccagtttctggggctcatgcttgtaatcccaacacttttcggaggccaaggcaggaagattgcttgagcccaggaatctgagaccagcctacgcaacatattaagacccccatctctacaaaaaactaaataaatgaggtggtgcatccctgtggtcccagctacttgggaggctgaggtgagaggatcatttcagcctggtaagttgaggctgcagtgagaagtgaccacaccactgcactccagcctgggcaacacagtaagaccctgtctcaaaaaaataaataaaaaataaatttgagggttacttgtttaacatccacagataatacacctagtcatttctgaactaggaggatagaaaagccctacccaatttttttttaaggtggagtctcgctctgttgcccaggctggagcgcagtggcgggctcttggctcagtgcaacatccacctcccgggttcatgcaattctcctgcttcagcctccgaagtagctgggattacagacgcacaccaccatgcccagctaatttttctatattttgtagacatgaggtctcactaggttacccaggctggtctcaaacttccaagatcaagcaatcctcctacctaagcatcccaaagtgctgggattataggcatgagccactgcccagccaagagtcattttcaaagcattatttttaatcagtgacatataaagctatcagaagtatgtcttttacctttttcctccaacccacccctgaacaaatttataaacaaattcttacctgcagcggtctccataaatacagtaccctcgctgaaaatacttgcacactacactatacggactgtcagagaggtcatgcgagtagcgacagttgtctccttccttacaaaccccatgcataaaatacctgtgagacgaaagaccacaaaactggattaaaaccaatccttgaaaatattaaaactaattagtattcatgactaatatattcaaccagtaaatacacaaacatacgaaataaacacaaagaaagggccaggcatggtggctcatgcctgtaatcccagtacctttgggaggctgaggtgagtggctcacctgaggtcaggggtctaagaccagcggttcgagaccagcctgggcaacatggtgaaaccccgtctctactaaaaatacaaaaattggctggtgtggtggcacacatgttaatcccagctactcaggaggctgaggcaggagaactgcttacacgtgggaggctgaggtttcaatgagccgagatcgcgccattgcactccagcctgggagacagagcaagactccatttcaaaaaaaaaaaataaaaagaaggtgataagaaaacaggagtaaagcaagtgtattagtccgtttttgcattgtgtttttgctttgtagctgggactacaggcgccgccaccacgcccggctaatttcttgtatttttagtagagacagggtttcaccatgttagccaggatggtctcgatctcctgaccttgtgatctgcccacctcggcctcccaaagtgctgagattacaagcgtgagccactgcgcctggcccttgtttttgcattgttacaacgaactattttgacattccagcctgggtgatggagcacgactatgactctgtctcaaaaaaatgtaataataatacgccttagattatgaaaactgtttaacttacataacaaaaagaaaaaaaaagggccaggcgtggtggcccacacctgtaatcccagcactttgggaggccaaggcggatggatcacgaggtcaggagatcaagaccatcctggctaatatggtgaaaccccatctctactaaaagtacaaaaaattagccgggcatggtggcaggcacctgtaatcccaactactcgggaggctgaggcagggattgcagtgagccgagatcgtgccattgagccactgcgctccagcctggacaacagagagactccatctcaaaaagaaaaagaaaaagaaaaagaaaaaaagatatagtctacgtcaaagaatttctcctccaaacaaaaaccaatgaatataagtatatgtcttgtttttaaatgataccaccaaaaaaaaaaaaaaaaacatcatccagattcaccccaagttgagtttgccttcggtgaaaacctgggccatatattatttctgaagttccttccactgtgcagactctgtctccatgagacactgtgcagtaaaagacaaaatttactagaatccccctactgctgtgcctcttagaaacctaatagtggcccccaacatagagaacaagaaactgccaagttaccctgtaagggtacaagagaaccaaacagcaccctcagagtatctctaggcatcttaacaacctctttaggaatttctacaaattatagaatagataaggcatttaatcaattcatctgcagtgacacttcttactttgatatttaacttttaatgagtgagtataccatttatcaaactagattataaattcctgatgggtaaagactggtttattcccctttttatctccaactatctgtgcacataatatatacttgttagaaaaaggtagaaagccgggttcggtggctcatgcctgtaatcccagcactttgggaggccaaggcgggtggattacctgaggttgggagtttgagaccagcctgaccaacatggtgaaagcggtacctactaaaaatacaaaaattagccgagtgtgatggtacaagcctgtaatcccagctactctggaggctgagagaggaaaatcgctggaacccaggagatggcgattgcaccgagccaagattgtatcactgcactctagcctgggcaacaacagcgaaactccgtctcaaaaaaaaaaaaaaaagaaagaaagaaagaaagaaagaaagaaagaaagaaagaaagaaagaaagaaagaaagaataaaagactgtagggtgggcccggtggctcacacctacaatcccagcactttgggaggcagaggcaggtggatcacctgaggtcaggtgttcaaaaccagcatggccaacatggtgaaacccactatctaccaaaaatacaaaaattaggccaggtgcggtggctcacacctgtaatcccagcactttgggaggctgaggcaggtggatcatgaggtcaggagctcaagaccatcctggctaacacagtgaaaccctgtttctactaaaaatacaaaaaaaacaaacaattagccaggcatggtggcacacacctgtagtcccagctacttgggaggctgaggcagaattgcttgaactcgcagtgggttggggggggcccagaggttgcagtgaaccaggatcacgccactgagactccgtctcaaaaaaaaaataaataaataaaaggctgtagaagacagctagatgtgatggtgaatcatggtagcgatagcaaattaatttttctttcccagttgcataatctttttaataccatttaatatttattacttatttcctctcacaaccactatgtagtttccaagtaataaatttcactatggacgtcacagcactcagataaagaatttctgaaggatttccttctttctttttttttttttttgagacgaaatctcactctgtcacccaggctggagtgcagtggtgcaatcttggctcactgcagcctctgcctcttgggatcaagtgattctcccacctcagcctccagagtggctgggattacaggtgcccgccaccacgcccagctaatttttgtatttttagtagagaacgggtttcgtcatgttggccaggctggtctcgaactcctgacctcaagtgatccacctgccttggcctcccaaagtactagaattacaggggtgagacaccacgcccagctgatctttaagttacgttaaccacatttttaaaaacttttgaggccaggtacgggggctcatgcctgtaatcccaggacttcgggaggccaaggtgggtggatcacctgaggtcaggagttcaagaccagcctgggcaacatggtgaaaccccatctctactaaacgtacaaataattagccgagtgtgatggcacgtgcctgtaatcccagcttctcggaaggctgaggcaccagaattccttgaacccaggaggcagaggttgtagtgagccgagatcgtgccactgcactccagcttgggcgacacagactccatctcagaaaacaaacaaacaaacaaacaaaacacaactttcaaggccaagcatggtggctcacacctgtaatcccagcactttaggaggccgaggcgggtgaaacacttgagcttaggagttcaagaccagcctaggcaacagggtgaaaccctgtctctatcaaaaatgcaaaaaaaaattagcctggggtggtggcacgtgcctgtaattccagctactggggaggttcaagcaggaggattgcttgagcctgggaggtggaggctgcaatgagccaagacactgccactgcattccagcctaggggacagagcgagaccctatctcaaaaaatacaaataaatacaaataaaaatcaagaaaagagttttttgaaaaattaaaaattaaacacttgtttttttgtgtattatttcaactaccagaacacttatctgccattatagaagcactctaataaagaggggtctaaattcaaattacaacttctctttaagtattaactgttctaacctcacacactcaaggtaactcaaggtagcagatgcaatgagcatttctgtttcttagtattgctctaataaaagatatgaaaaacagcctggtggtggcagcataacacagtttctgaggaaaggtataaaacacaatgaaaaccccaggagaaacattagaaaaaatgtaaccagtaggaaaatacaggtgattccgagcaattaaaaacattctaatcaaaacttctaagtgaagaaaatagctttagtcaaattcctagatacaggagtgatgtgctatagggagaaatgagcacaaacactaaaacacacctctacctgattctttaggtgatgtttacctagcaaacatattgaaaatgtttatttataatacagtacatacatctgcactctcttgaacacctaatattgtgtctcccattgctggcgtgcaatgtttacttactgaatgattgaataaggtagttccagaaaaaatatacatgtggccgggcgtaatcccacctactcaggaggctgaggcaggagaatcgcttgaacccaggaggcagaggttgcagtgagctgagatctcgccactgcactccagcctgggcgacagagcgacactccatctcaaaaaaaaaaaaaaaaaaggaagatacacatgtgttctgttaagtactttgtctttggtaatttacaagttttgttttttttttttttaatgaaagcagaggaatcttacaaagttcctgttaaagtgggtaattctaggtatatgactttatcaacatcactcaagcatttactcagtatctgctcaggatactcagtaactgagtatcctgttcatgatactggaactgaggaaagaaactgaggaactgaggaaagaaagccctgcagataaaatagggccctactcttctcagagagctcaaagtgaacgataaggatcatagaccgggtgcggtggctcacgcctctaatcccagcactttgggaggctgaggccggcagatcacctgaggtcgggagttcaagaccagcctgaccaacacggagaaagcccgtctctactaaaaatacaaaattagtcaggtgggcatggtggtgcacgcctgtaatcccagctactaaggcatctgtaatgccagagactgaggcaggagaatcaattaaacctgggaggcgggggttgtggtaagtagagatcacaccattgcactccaacctgggaaacaagagggaaactctgtctcaaaaaaaaaaaaaaaaaaatgatagttgacattcctctatctaaaggagaaaatagttttaagtaagagatcatgttggtacctagaacaaccgaaaacaatgtcaaacactaaaaccccagacctatcaaggaatctgcacaacaataaaaaactgtctcaagcaaaagctatacaaaaaacccccaaaaactagtaaatctaagctctttcttttctttctttttcttttttgtttttcttctgacagagtttcactttcgcccaggctggagtgaagtggtgtgatattggctcaccgcaacctctgcctcctgggttcaagcaactccctgcctcagcctccggagtagctgagattacaagcgcctgtcaccacgcccggctaatgttttttgtattttcagtagagacggggtttcaccatcttggccaggctggtcttgagctcctgacctcgtgatccacctgccttggcctcccaaagtgctgggattacaggtgtgagccactgtgcccggcctaatttttgtattcttagtagagacagggtttcaccatgttggccaggctggtctcgaactccttacctcaggcgatccgcccgcctcagcctcccaaaatgctgggattacaggcgtgagccaccacgccgacctagccaccccgacaggccggtttcaatcttttaaaagatgtaactagcacatatagatcaactgtagcattgtaaaagggaaacagatattcaaataatttgctccatgagtagaaactttaaaatcatcattcctggcaatattccacttttacaatccaccgatgaataagacaagtgacctgaaattgcgtttatgctttctacatcccattatgtaaaataattaagcttatccttcacaccttaaatgtatcatatcaaaggctgagagaccttcgaaggtcgccaggataaatgtatcacatcaaagactgggaaggtttcaaatttcacccttaatactacaagttctaattaggaatcatttttacatacttgcatataaattataccacccaggtgaaaaccggcatttcagttgatttattcaactgatagaaaaagaaaagcttacagtcgctactgatcactatttaaaaaccggaaaataaaaaacgtacaattaaatgccctcttctgcgtagagctaggtagttttttacaaccatacacatccatacaaccgccatcccttaatttttctaatattttcgtctcgcatatcaaaccaaaaccaaacctctctctcttccgggagcgaagagccctttcactcccttcggaagatgcgtaaatttcaaaagaggaacatagcgctgggggagggtaataatctgcagctcaaaaaaaccgcgggtggagaagacgaccccggcccccgaacgcctgcttctaagacaaagctcagcaccgccaacctcgacaaacatacaaagaagaaatacaaaagcttcttctcacagttgggcggaggatggggggcggagggacggagggacgtgaaaagacgttacaaacggatggcacggagagaggagagggccgggagccaggcaagctcgctggggccctcggcggggtgtctaggcccggagaggatcgctgggagaccggcctcaagtgaccacctcccgagccccgggagccggaggcagcggcgggggcatccttccagcggcaggggaggagccagcccacctctccccgatgcgctcgcagccagctcaggcagcgctcagggaagtgtaagcggcggtgcagccccgcggctccgcagtaatcgcgcaccgccaggcctccgcggacagcgctgagggctccgcggcccagcgggggttgacgcagtgactgggggaacgcggcggcagcgggggccgcgagggctgcagagatcgagacaacgccggtccccgccctcccgcgcctctagccgcaggccggccgccctcctccctcccgcgccgcaggcttggcccgcggccccctccccgcgcccggcgctccgccgcgcaacgtcctacctgcaggtgacctgtttagtccagccgccgccgctgccgtcgctgccgccgccccctccgcccgcccccagggacggggcggtgactgtggggatcggggtgggggaggctgctgccgccgtcgccgctgccgctcctgctcctgatgttgtggctgttgttccgggagttgcagcctccgccattactgtttatcccacacagcaaaggccccggaacttccgggatcacatagttccggtccggctgcggggagaggacggcgaggccaggcgaggggaggggaaggacactgaggcacccgttcggtccccgcctgctacgcgtcgcgtatctgagcgctctcgccacttcaactgcgggcccagagcatgcgcgcccgcggcccgcccacggcgccgctcattggtggaggggacgtctcctccggaaaggggcggggcaaacgggggtctgtacaggtgtgtcctaggctcgaaaccccggcgacgaaagtccatagttagcggctttcttcctagcagaggctgatatagtggagctggggctggggactagggacttgcagtcggaagacctgggtttgaatctgcactttcccatttctctagtaatatttgagctaggtacttgttctatctgagcctccgtttcagcctctctcgaataaggatgacagcagacccacatatggttgctgtgaggattatatgatgtccttagaaatcactgagcttagtgcctggtacatggtaaacacttaataaaggttatctcattcctggtatcagagatgtgatcttggccaagtattttggctgagcaatgctctagagggctggtccccttatctccaggcttccctttctaagccatgggtcttctagcaaattatcctacctcttggtgctcctgctttctcctctgtaaaaacgacaataataataataataggccaggcgcggtggctcacgcctgtaatcccagcactttgggaggctgaggtaggcgaatcacctgaggtcatgagttcgagatcagcctggccaacgtggtgaaaccccgtctttactaaaaatacaaaaattagccgggtgtagtggctagtcccagttactcaggaggctgaggcaggagaattccttgaacccgggaggcggaggttgcagtgagccgagatcgcgccactgcactccagcttgggcgacagaatgaaattccgtctcaaaataataataatagtaatagataatagtacctacttcagagatggctgtgaaagttaaatgagaatctgtttaaaaacctttgtactggccgggcgcggtggctcacgcctgtaatcccagcactttgggaggccgaggggggcggatcaccaggtcaggagattgagaccatcctggctaacacggtgaaaccccgtctctactaaaaaatacaaaaaaattagccggtcatgatggcgggcgcctgtagtcccagctactccgaggctgaggcaggagaatggagtgaacccgggaggcgaagcttgcagtgagccgagatcgcgccaccgcactctagccactgcactgcagcctgggcgacaaagctagactccatctcaaaaaaaaaaaacaaaaagcaaaaaaaaaaaaaaaaaaacccctttgcattgtgcttttcacactgcagtgaatacataatgagtaacaaaatatgtctggaatatcctagctttttttttaatgcgtctttaaaattgtatgtatttaaggtgtaaaacattgttttaatatacatgtacctagtgaagtgattactacagtcaagcagatttagcatatcacctcacatgaatattttgtgtatgtgtttgtggtaaaaacccaagctctactcttagcaattttccagtatacaatacaatattatctattaacattaatcatagtcttccgccgggcacggtggctcacacctgtaatcccagcactttgggggccgaggcgggcggatcacaaggtcaggagatcgagaccatcctagctaacacggtgaaagcccgtctctactcaaaaaacacaaaaaattagctgggcatagtggtgggtgcctgttgtcccagcaactcgggaggctgaggcaggagaatggcgtgaacccggcaggtgaggcttgcagtgagctgagatcacgccactgccctccagcctgggcaagagcgagagtccgtctcaaaaaaaaaaaaaaatcatagtcttcatgtggtacattagatctctagacttattcatcctacacagctgcaactttgtcccctttgacctgatgtccccattccccactccactcctggtaaaccactgttctactctgttgctatgtattcaactttttcacatcttcacgtataagtgagataatgtagtattgttctttgtgtctggcttatttcatttagcataatgtcctgcaggtttatccatattgtggcaaataaaggctaccacacaggtagtaacctttagagacacaataggtggtaaatgtttctttcagacttttcaagttgtcagactctcagttaatctctctcaggtctggggaagggagagcccgaaagaaggctcttgtaaatagagccttctattttaaggctgagaaataaggaatatcctagcttctgaggattacttttttttttttttttgagaccgtcttgctctgtcaccaggctggagtgcaatggcgcgatctcggctcactgcaacctctgcctcccgggtttaagcaattctcctgcctcagcctcccaagtagctgggactacagacgtgcgccaccatacccagctaatttttgtatttttagtagagacaggctttcaccatgttggccaggctggtctcaatctcttgacttcgtgatccgcccgcctaggcctctcaaagtgctaggattacaggtgtgagccaccacgcccggcctggattacttctaaaactatgaaaagtaaagtgtagttaatttttaattttgtttagggatgaggtctcactatattggccaggctggtctccagcacctgggctcaagtgatgctcctgtcttggcctccctaagtgctgggattataggcataaactaccatgccgggcctcagagtgtatttaattatttttccccataaggcctactgtccactcagatgcaacatattaaactctgagtttccataggcagtttttcataagcccttaagttcgacttttctgtagtctctacgttgaaagtgaaaatcagcctattaatcatcagaccccgatgtgcccaacacaggcaaacaaggaaggtggcaaaaacaacagaaaagaatgcatctcctaaggccacaccacagcaagataactaacaatcccctcgaaggaaaccaaaatatttcacttcacctcaaaatatacacttctggccaggcgtggtggctgacgcctgtaatcccagcactttgggaggcagagttgggcggattgcatgaggtcaggagttcgagaccagcctaggcaacatagaaaaacccccgtgtctactaaaaatacaaaaattagctgggcttggtggcgtgtgtctgtaatcccagcctggccaatatagtgagaccttatctctaaacaaaattaaaaattaactacactttacttttcatagttttagaagtaatccaggccgggtgtggtggctcacacctgtaatcccagcactttgagaggcctaggcgggcggatcacgaagtcaagagatcgagaccagcctggccaacatggtgaaaacctgtctctactaaaaattcaaaaattagctgggtgtggtggcgcacgtctgtagtcccagctacttgggaggctgaggtaggagaatctcttgaacccgggaggtggaggttgcagtgagccaagatcaagccactgcactccaacctggacaccagagtgagactctgtctcaaaaataaataaattaattaattaaacttctttgacgtattttaagataccacttcataataaaaaagaaaaaaaacaaataagatacctctttggaagggttggaaatacaagaatagaaggaaagctgtcttttgtgggaaagatttgcatctgcagagaaaatctacactgaggcagcccggctttctttggagccctcccttccccagatctaggaaacattagctgagagtctgacaacgtttgaagcctgaaggaaacatttactacctattgtgtctctgaaggctgctacctgcatggtttcaatgacctaacaagaccactgtggctagccaggcttctgcttctctccatcccataactgctggccaccatatgatttacccttatatcctgttttgggatatgttccccattctttcagtaacctcaagatggaatatgagcttgccctccccgttgaggggttgggatcatcactctcttgttctccctgtgcacattaataaatgtgtatgccttttcatcaataatctgccagggtttttgtttgtttctttgtttgttttgtttgttttgagacagggtctcgctctgttgtgtaggattaagtgcagtggtgcaatctcagctcactgcaatccccacctctcgggctcatgcgatcctccttcctcagtcttccatgtagctgagaccacaggcacacacccttacgtccagccaattattgtatttttggtagagacagggtttcgccatgatgtcctagctggtctcgaactcctgggctcaagcaatcctcttgtcttggcctcccaaagtgctaggattacaggctcttggaggactgggatctttgcagagatgtatcccaagtacctagaatagtgtctggcatatagtaggtgctcaatctctgacgttatcaaaattacccagcaatactatgccttggctcaccatccataccaaacaaaaataacaacatgttgtattaaaaggaaacaaaagccatctctcctttagtgtgctggggtaaacatgcagcaaaagggcaattcgttcatttctttcctaccaaactatttattagggaccctactgtgccagcactacacagccaggtgatttttgttgctattgttgttgtgtatgtgtatgtgtttgtgggatggaatctcgctctgtcgcccagactggggtgcaggtgcgatctcggctcactgcaatctttgcctcctgggttcaagtggttcttctgcctcagcctcccgagtagctgggactacaggcgcccaccaccatgcccagctaatttttgtatttttagtagagatggggtttcaccacgttggcaaagatggtctcgaactcctgacctcaagtgattggtccacctcagcctcccaaagtgctgggattacaggcatgggccctgcccatgtttttgtttgtttttttaatagaaatcaggctggtcttatctccccttccctccccaggccttggcctcccaaggtgctgggattatagccttgagccaccatgcctggcccaggttcttaattgtaggcagagtaaaggcttggtgtgacgtgagggtacccagaactttctccaattactaatgccttctcagatgccagagtccagaggggggtgcctgtatgctgggaaggactccagtaggagcagaagatctttgcctcatccatctctactgactggggttaaggccagtgaaggaacacaggaaacttcaccccaaaatgtgactccctggtataatgagtgttttgaataaaatgccctagagatcaacagggttagaagaggcttcctcaatctacataaagacccaaggaccctccaagaacaattgttcttcctccccctgtctattatcttatgatcttttgcaggaaggaagaccaagaatgtaatcacatcagaacaaattcttttacaagacaatgtgtgtctttcaggctcattcagtttccaaagagaaccatttacaagttagtctctgttcccttatccgttcattctgccttgtaatcatttattgccccttaacagaactactgtttttctgatctctccctcccctctgaaataaggctatacaactatctgggccccactgggatattgggtaattactgtgtcattcgccccacccataccccgtgcatgttaataaatgtgtgtgccttttctctattaatctgcctttgtcagttgatttttcagcagggacacttggtagagaaaggaggaataacgaggcggtggtgggtatctgcttcacaactttgcatgaaactatagtcattttcagagtgtggtgatcatacttagaacaaaagttgcatggcttggcaaggagtgttcaatagaactagtcaggataacagaaaagttaaaatcatgactatgcaggaaatctgagctatataggagtcacatgggcacttttgttcctgcacatagtggctgtgtggcattgggcaaattaccacctcagtttccttgttgatgaaataaagccaaaacacaccgggcgtggtggctcacgcctgaaatcccagcgctttgggaagcctagccagtcgtgtaaccacccaaggaattcaccttgcccgctgcctagacagagccaattcatgaagacgggaattacaacagagaaagagtaattcatgcagagccagctgtccggaagaccagagttttattattactcaactcagactcctggagcattcagagagcagagtttttaaggataacctggtggggcgggggaagggggaagccagtgagccaggagtgctgattggttggtcagagatgaaatcctaggaatcagagctgtcttcttttgctgagtcagttcctgggtgggggccacaagatcagatgagccagtttattgatctgggtggtgccaggtgatccatcaagtgcagggtctgcaaaatatctcaagcaatgatcttttttttctttttttcaccaaggctggagcgcaatggcgctatctcagctcactgcaacctccgcctcccgggttaaagcaattctcatgcctcagcctcccgagtagctgggactacaggtgcccgccaccacgcctggctaatttttgtattagttttttccaagacggagtcccactctgttgcccaggctggagtgcagtggcacaatctcggctcactgcaacctctgcctcccaggttcaagcgattcttttgcctgggattctctttcctgggagcagctgggattacaggcacccgccaccacgctgggctaatttttttgtattttcagtagagacggggtttcgccatgttggccaggctggtcttgaactccagacctcaggtgatcagctcacctgggcctctcaaagtgctgggcaccaatcttaggagaagtttagggagggtcagaatcttgcagcctctagctgcacgactcctaaaccataacttctaatcttgtggctaatgttagtcctacaaaggcaatctagtccccagccaagaaggaggtctgctttcggaaagggctgttatggtctttgtttaaactataaagtataaactaagtttctcccaaagttagttcagcctacacccaggaatgaaaaaggacagcttggaggttagaagcaagatggagtcagttaagttagatctctctctgtttcagtcataattttgcaaaggtggtttcagttggatcacttgaggtcaggagttcaagatcagtctggccaacatggtgaaaccctgtctctaccaaaaatacaaaaatgagccagacatggtggtgtgtgtctgtagtcccagctactcaggaggctgaggcaggagaatcacttgaacctgggaggcagaagttgcagtgaggcaagataacgccactgcactccagcctgaaggacagagcaagactccatctcacacacacaaaaaagaaaagaaataaagccaaaagcaaaaaacaaacaaacaaacaaaaagccacacacaaaaaaaccttccttgtaaatattaaaggagttaatggatgcaaaactcaaaggacattcacttcatttaataactgctagatataggctgggcgcggtggctcatgcctataatcccagcactttgggaggccaaggcgggcagatcacaaggtcaggagatcgagaccatcctggctaacatggtgaaaccctgtctctactaaaaatacaaaaaattaactgggcatggtggcatgcgcctatagtcccagttactcaggaggctgaggcaggagaatcgtttgaacctgggaggcagaggttgcagtgagccaagatcatgccactgcactccagcctggcgacagaacaagactctgtctcaaaacaaaacaaaacctattagatatgtgtttgctattgttttaattgctgttgttacatgacattagaatagggttgtcaaacttagcaaataaagatgtagaatagcaggtgaccctggctcatgtctgtaatcccagccctttggcaggctgaggcaggaggatcacttgaggccaggagttctagaccagcctgggcaacatagtgagacctctatctctacaaaataaaaattaaatttaaaaattaaaagaaaatctggatgccaagttaagtttgaatttcagctaaataatcagtacttagtataaatatattccaaatatgacatgagatatacttaaaaattattcattgtttatctgaaattaaaatataactagtgtgttggctttgcacagtggctcatgcctgtaatcccagcactttgggaggccaaggtgggtggaacacttgaggtcaggagtttgagaccagcacggccaacatggtgaaacccccatctctactaaaaatacaaaaaaatttagctggtcatggtggtgatgcatgctgtaatcccagctactcaggaggctgaggcaccagaatcacttgaaccctggaggcagaggttgcagtgagccaagatcacgccactgcactccagcctaggccacacagcaagactccgtctcaaaaaaaaaaatacacgtagtgttaaaggaaaataaatgttggggcctgtaaattactaagctaaagggaaaagtcaagctggaaacttctcagggccaaactgtctcccattctattcaaagtcacccctctggtgactgagataaacgcatatctgattgcctcctttggagaggccaatcagaaactcaaaagaatgcaaccatttgcctgttatctacctatgacctggaaaactcctcccggcttggaatcttcccttttttggcttcaagttgtcctgcctttccagactgaaccaatgttcatcgtgcatatgttgattgacggctcatgtctccttagaatgtataaaagcaagctgtgatctgaccaccttgggcacatgtaatcaagaacctcctgaggctgagtacagtggcttatgcctgtaatcccagcacactgggaggccgtggtgggcagattacttgaggtcaggagttccaaaccactcaggccaacatggtgaaactccatctctactaaaaatacaaaaattagccgggcatggttgtgtacacctgtaatcccagctgcttgggaggctgaggcaggagaatcacttgaaccctggaggtggaggttgcagtgagctaagatcatgccattgcactactgcctgggggacagagtgagactctgtctcaaaaaaattagctgggcgtggtggggcacacctgtaatcccagcttctccaccacactccagcttggtcagcagagcgagactccatctcaaaaaaacaaaaacaaaaacaaaaactaaaaacacctcctgaggttatgtcacagatgcacatccttatataagaaccacacttgattttcaaaggccttacatctacattatctagtttgggtcccacaatggcctttagaagtaggagaagtacagagtactttgccattttaaggcccggaaaatgaggttgtcgagtcatgcacaaatgttgcctgtaatcacatagcccataagtgagcttggagcttgaggaatttaaacttctgctttattgcttccctgagctggtgctggaggttaggccttgccctaaaggagtttttcctttgaaagaaaaggctacggccaggcgcggtggctcacgcctgtaatcccagcactttgggaggccaaggcgggcgtatcacgaggctaggagatcgagaccatcctggctaacacggtgaaaccccatctctactaaaaatacaaaaacaaaattagctgggtgtggtggtgggggcctgtagtcccagctactcagaaggctgaggtgggagaatggcatgaacccaggaggcagagcttgcagtgagccgagatcgcgccactgcactccagcctggacgacagagcaagactctgtctcaaaaaaataaaaaaaaaagagaagactacaaataagacacaatcactttaagtgctgcaaagttaaaggataagagatttgtctggcatcttcccaagccagtgtggaatattttattgtcagcagatgtagtttgtactatgttacacaagttttgacaaccttaatctggaaactgtagtctacacaataaacataatgttgatctatgtgttattttctttccaaagggagtttaattaatgatttgttccctgtaaaaacagtctatattctcttatagaccagtggttccctgccttttaaatcctcctcaatcaatgctcctgactgggcctccctttgtaatcccataatgctaagattgcaggtgtgagccatcagccccagctatgagttattttattttatttttattgttatcttatttattttattttattttatttttgagatggagtttcgctctgctgcccaggctggagtgtagtggcatgatctaggctcactgcaagctctgcctcccaggttcacgccattctcctgcctcagcctcccaactagctgggactacaggagcccgccaccacgcccagctaattttttgtatttttaatagaaacggggtttcaccgtgttagtcaggacagtctcaatctcctgacctcatgatctgcccgcctcgtcctcccaaagtgctgggattacaggcgtgagccaccgtgccgggcctattttatttttatttttagagatggagacttgctctgtcacccaggctggagtgcagtggtatgatctcagctaacttcaacctctgcctcctgggttcaagcgattctcctgcctcagcctcctgagtagctgggattacaggcatgcaccaccatgcccagctaatttttgtgtttttagtagagacagggtttcgccatgttggccaggctggtctcaaactcctgacctcaggcaatccacccccccaccccccttcagtctcccaaagtgctgggattacaggcatgaaccaccacacccagcccatgagttattttatttttattgtatttatttatttttgagtcggagtcttgctgtattgtccatactgcagtgcaatgacgcgatctcggctcaccgcaacctctgcttcccaggttcaagtgattctcctgcctcagcctcccaagtagctgggattacaggcgcgccaccacacccagctaatttttgaaatttcagtagagacaggatttcaccatgttggccaggctggtctccaactcctgacctcaaatgatccgcccacctcagcttcccaaagtgctgggattacaggcatgagccaccacgcctggccgagttatttttaatattaaatactgtgttaatttttggtacatttatatatatatatatatatatatatatatatttttttttttttttttttttttaataagcaatccagtttggccaggtgcagtggctcatgcctgtacttccagcactttgggaggctgaggtgggaagatcgcttgaagccaggagctcaagaccagcctgggcaatatagcaagactccatttctagaaaaacattagaaaattaactggaaccaggagaggtgtcttatgccttgtaatcccagcactttgggaggccaaggtgggatgattgcttgaggccaggggttcaagaccagcctgggaaacatggcaaaaccctgtctcattccttcaatcctagcactttgggaggctgaagcaggtgggtcacttgaggtcagttcaagaccagcctggccaacatagtgaaacccccgtctctaccaaaaatacaaaaatgagctcttggccttggtgccatcttcttggaaacctttgtgctacaagagccaagtggaggaagaagcacatgaggaggctgaagcccaaaagaaagatgaggcagaggtccaagtaaaccactagcttgttgcacccgtggaggccacagaagcagaaacatggaatgccagaggctgggaatgctggtacaagttgttggactgcatgctactgtctagagctttctcaatggacctggaactttatcgccaactgatcgccaagaccacctctgagacccaccttggtaataaccaaaactgtccatgttggtcctttgtcctggatctgtgacattctgaactatttatttatttattttttgagacagaatcttgctctgtcacccaggctggagtgcagtggtgcgatctcggctcactgcaatctccgcctcctgggttcacgcgattgtcctgcctcagcctcttaaatagctgggattacaggtgtgcgccaccatgcccagctaatttttttgtatttttggtagagatgggatttcaccaagttggtcaggctggtctcgaactcctgacttcatgatccgcccgcctcggcctcccaaagtgctgggactacaggcataagccaccgcacccggccattctggactatttctgtgtccacttgtggctgagtatagcaaccatacaataaaacccctcttccactgtcttagctgaagaactaaaaaaaaaaaaaaaaaaaaatgagtggtgcatgcctgtagtcccagctacttgggaggctgaggcaggagaatcgcttgaacctgggagacggaaggtgcagtgagctgaaatcacgccactggtgccactgcgagcccagcgggggcagagcgagattacagccccaggggacagagcgagactccatctgaaaagaaagtttgtcaagtaaacaaatgaatgagtccaggtgcagtggctcacgcctctaattccagtacctcggcaggctcatttgaggccaggtgttcacaatcagcctggacaaaatagcaagactccatctttatgaaataaaaaataaaaagccgccgggcgtggtggctcatgcctgtaatcccagcactttgggaggccgaggcgggcagatcacgaggtcaggagatcaagaccatcctgattaacacagtgaaaccccctctctactaaaaatacaaaaattatctgggcgtggtggcgggcgcatgtagtcccagctactcgggaggctgaggcaggataatggcatgaacctaggaggcggcgcttgcagtgagctgaaattgcaccactgcactccagcctgggtgacagagcgagactccgtctcaaaataaataaataaataaataaaaataaataaaaagccaaatgaatggatgacacatgaatcaatgaatgcaaatatgaatttgtggggccttaccctatctctaagctccccttctccctcaaaagggttaggaacaaaaggattttaggaaaagaacaggaaaacttagagcagttcctctctagaaatggcaagatatctcagctctcccaccccagccctcacccctggaggggattatgctgaccaaatagtttatgctgctggagggctctctttagggaggggcaaaaatgccaataaggttatcttcctctgttctgtaccctgctaccaaatctgatctgaaatcagcccataggtgtcctaaagtatggaaatgtgctagggccacctgccggtgggaaaaagataaattagatttcagaaaagggctgatagtaagcatttaaaatacaataccttccagcgcagtggctcatgcctgtaatcccagcactttgggaggccgaagcgggcgaatcacctgaggtcaggggttcaagaccagcctgaccaacatggagaaaccccgtctctactaaaaatacaaaaaaattagccaggcgtgctggcgcaggcctgtaatcccagctactctcgagcctgaggcgggagaatcacttgaacctgggaggcggaggttgtggtgagccgagatctcgccattgcactccagcctgggcaacaagagcgaaactgtctaaaaaagtaaataaaataaaataccaagaagctatatttagaaaactcttacatgcttgaacctttacttccttgacttttttgttttgtttttggtttaaaatccatttacaggccgggagtaatggctcatgcctgtaatcccagccctttgggaggccgaggtggacaaatcatttgaggtcaggagtttaagaccagcctagccaacatggaaaaccccatctctattaaaaatacaaaaattagccgggtgtggtggtgtgcctgtaatcccagctactggagaggctgaggcaggagaatcccttgaacctgagaggcagagatcacagcactgcactccagcctgggcaatagagtgacactcagtctcaaaaaaaaaaaaaaacgggtgcagtgtctcatcccagcacattgggaggccaaggcaggtagatcgcctgacgtcaggagtttgagattaccttggccaacatggtggaaccccatctctactaaaaatacaaaaattagctggctgtggtggcaggcacctgtaatcccagctcctcgggaggctgaggctggagaatcgcttgaacccaggaggcggaggttgcagtgagctgagagcacgccactgcaccccagcctgggcaacagagtgagactccgtcttgaaaaaaaaaaaagataaataaataaaatccgtttattactgaggagttcttgattttgtgtgtgtgtgtgatttaaaagttataaatgggccgggtgcgatggctcacgcctgtaatcccagcactttgggaggccaaggcaggcggatcacgaggtcaggagatcgagaccatcctggctaacacggtaaaaccccatctctactaaaaatataaaaaattagctgagcgtggtggtgggcgcctgtctacttgggaggctgaggcaggagaacggcatgaacctgtgaggcggagcttgcactgagctgagatcacaccactgcactccagcctgggggacagagagagactccgtctcaaaaaagaaaaaaaaaagttataaatggaggccgggcgcggtggctcacccctgtaatcccagcactttgggaggcagagttgggcagatcgcatgaggtcaggagttcaagaccagcctgaccaacatggagaaaccctgtctctactaaaaaatataaaattagctgggcataggggtgcctgcctgtaatcccagctacttgggaggctgaggcaggagaatcgcttgaacccagaggcggaggttgtggctagccgagattgcgccattgcactccagcctgggcaacaagagcgaaactctgtctcaaaaaaaaaaagaagttataaatggaactacgtgtattcacgtgcacgagtttgcactgcagtttgatagaaagcctgactgcattgtgtggtaagcttgtgtgagtgatgtgtgtgctctttgaactaatgctgcttcagctctcctctgccatagcggaacccagccttccaggaaagaaaagccaggaagggcagcctaatctctgcaaaaactaggaagtgaatgctgagaatgaattgatgaacttcctaggcttatttggtgaaaatatagcttgctttataaagaaaggcctcaggccaggcacggtggctcacgcctgtaatcccagcactttgggaggctgaggcgggtggatcacctgaggtcgggagttcaagaccagcctgagcaacatggtgaaaccccgtctctaccaaaaatacaaaaattagccaggcgtggtggcgcatgcctgtaatcccagctactcaggaggctgaggcaggagaatcacttgaacccaggaggcggaggttgcagtgagccaagattgcaccattgcactccagcctggacgacagagcaagactccatctcaaaaaaaaaaagaaaagaaaagaaaagaaagaaaatgtctcttccaggtgcagcctaaatgagccacagtcttaggggataatagcatcagcggattccttcattccttcattcaggtacggtggtcagggaaggcccttctaagacaatatttgaaagtagtcctaaaggattggaaagaatgagccatgtgaagacatgagggaagagcgcacaggccagagggaacagcaggtatggcccggaggctgggccctgcttggtgtgatccaggacctgctgacgccactgtggctggacccagggagccaggccaaggttggtcagagataaggccgactggagagcgaaggggagatggaatcacctgatgggttcttcctgcctgctgcacagacaaaatcaatcctctgagaccatggcacagcagtaaagaacagtaaagaacgctgaattgacagaagctggctacaaatcaatctccttgaaggctctgaggttaaggattttcttttgttttcttttttttgtttttgtttttgccatatcaatacctggtttaattttttttttttttttttttttgagacggagtctcactctgtctcccaggctggagtacaatggcgccatcttggctcactgcaacctccgcctcctgagttcaagcgattctcctacctcagcctcccaagtagctgggactacaggcgcccgccaccaagcccggctaattttttgtatttttagtagagatgggatttcaccgtgttagccaggatggtctcgatctcctgacctcgtgatctacctgccttggcctcccaaagtgctgggattacaggtgtgagccactgtgcctggccagttttaattttttttagaggaaatactataatcttttttttttttttttttagatagagtttcactctgtcacccaggctgaagtgcagtggcatgatctcagctcaccataacctccacctcccatgttcaagcaattctcctgcctcagcctcctgagtagctgggattacaggcgccagccaccacacctggctaatttttgtatattttttttttagtagagacggggtttcaccatgttgatcaggctggtctcgaactcctgaccttgtgatccacccgcttcagcctcccaaagtgctgggattacaggcatgagccactgtgcccagccggaaatactataatcttaaaaaagagttccaaaaaacttaacagcatttccagccatgactatttctgaaatgtaaagatttgaaacctaatttatacaaaactaaaaaccagaaagattcattcttgctttttcttttttaaaaaatccagatagtttgtcacaagaaagttcggcaaattgccaggcacagtagctcacgtctgtaatcccagcactttgggaggcggaggtgggtggatcacctgaagtcaggagttcaaaaccagcctggccaacatagtgaaaccccatctctactaaaaatacaaaaatttgctaggcgtggtggcatgcctgtaatctcagcttactcgggaagctgaggcaggagaatcacttgaaccaggaggttgaggttgcagtaaaccaagatcacgccattgcactccagcctgggcgacaagagcgaaactccatctcaaaaaaaaaaaaaaaaaattcattctactcagtgtctgcgttgggggttctacatcttatttccaatcgctcaagccagttgcgccacctgaggttaggggttttcaaggatagtttggtgggcagtggactaggggttggggagtgaatgttggggatgcagtcatagggctgtggaaaatggagcttgtatgctgagttcccctctgggtgggtccacaggactgggtgagtcatgagtcacaagtgcaggtggagccatcaggtagccagaaatgtaaaagtgtgaaaggacatctcagaaggccaatcttagcttctacaatagtgatgttatctgcaggagtaattggggaagtcacaaatcttgtgacctccagaacaatggctggttaccctttaacgatgcctatatctcagcaaaattcaggctcctctcataatcctaaacttatggcttttcattagttttacaaaggcagtttggttttgggaagggccattatcatcctcactttaaggttaaattatttatttattttttttgagatggagtcgggctctgtcacccagactggagtgcagtggcatggtcttggctcactgcaacctccacctcctgggttcaagcaattctcctgtctcagcctcccaagtagctgggattacaggcacatgccagcatgccaggctaatttttggtatttttagtagacacaggggtttcaccatgttggccaggctagtcttgaattcctggcctcaggtgattcacccgcctcggcctcccaaggtgctgggtttacaggtgtgagccaccgcgcccggcctaaggttaaactataaactaaatttctctcaaagttagtttgacctactcccaggaatgacccaggacagcttggagattagaagcaagttggaggcggcaacaatgtcaggtttctcttactgtcttaattttgcaaaggcgcttttagagacacagtgagagctagtgttcctgctgagcagattcctcctccccagttcacagcgcactttagtgtatctttgggtggtactctaccagccatgcagaaattatcagacccagtgagactgcagcagactcaggcggccaggatgagagtgtcctgagcggtggggtagagggagaacagattccttttccacacttggataatcccaggtgcatagtgtctctttggcttcatggctgctgctggtcctggcctcacatttgtctgggggcttcagtctgagggactgcagcagtgcattctggattcggtagttagctaacatagagctcagtgttgtgtgcctactgtccaaaaaataaaattgcatgtgtattgatggctgaaacctgttgataaaaagagccaaactctaggggttgggctcagctgctcacgtctgtaactgagcactttgggaagctgaggagggaggatcacttgagcccaggagttcaagaccagcctgggcaacattgtaaaaattaaaaaaaattagctgggtgtggtggcacgtgctcatagtgccagttcttgctctttgttttttcattaaaaaaaaaaatcttaggcctggcgcagtggctcacgcctgtaatcccaacactttgggaggccaaggagggcgggtcacgaggtcaggagatcaagaccatcctggctaacatggtgaaaacctgtctctactaaaaatacaaaaaaattagccgggcgtggtggcgggcacctgtagtcccagctacccagctactcaggaagctaaggcagcagaatggcgtgaaccccgggaggcagagtttgtagtgagccaagatcgcaccactgcactccagcctgggcaacagagcgagaccacctttttttttttttttggtgcaatctcagctcactgaaacctctatttccatggctcaagcaatcctcccacttgagcctcctgagtagctgggaccacaggcatgctccaccacacctggctaaagtcccagcaacttgggaagctgaggcaggaggatcccttgagcccaggagttcaagaccagcctgggaaacatagcaagaccctgtctctattgatttatttatttgctttttaaaaaaattatttatttattcatttttgagatggagttttgcttttgtcacccacgctatagtgcaattgtgcaatcttggctcactgcaacctctgcctcccgggttgaagtgattctcctgcctcagcctcccgagtagctgggattacaagtgactgccaccatgcctagctaattttttgtatttgtagtagggatggggtttcaccatgttggtcaaggctggtcttgaactcttaacctcaggtgatccacgtgcctcggcctcccaaagtgctgagattacaggtgtgagccaccacgcctggccaatttttaaattttaattaaaaaaattttttttttgagacagagtttcgctcttgttccccaggctggagtgcagtggcgggatctcggctcactgcaacctccacctcctgggctcaagcaattcccctgcctcagcctcctgagtagctgggattacaagcatgtgccaccacgcccagctaatttttttttttaattttattattattatactttaagttttaggatacatgtgcacaacatgcaggtttgttacatatgtatacatgtgccatgttggtgtgctgcacccattaactcctcatttagcattaggtatatctcctaatgctatccctcccccctcccccgaccccacagctaatttttgtattattagtagagatggggtttcaccatgttggccaggctggtttcgaactcctgacgtcaggtgatctgcctgccttggcctcccaaaggggtgggattacaggcgtgagtcaccatgcctggccttctatttaaatatgccaggcacagagcaaagtggccaactttgagatagatctcatgagtaaaaatgccaggacttgggcaggtttcttgctgggttgttagagtggcctcctaactggtctgtcaacatccactctgaccccttccattctattgtctgcattgcagtctgtgattttctaaatccgaaggtacttatgacattctcctgcatacaatttttttttttaaattttttgagatggagtttcgctcttgttacccaggctggagtgcaatggcacgatattggctcactgcaacctctgccttccggtttcaagcgattctcctgcctcagcctcccgagtagttgggactacaggtgcccgccaccacgtccggctaaattttgtaattttttttttttctgagatggagtctcactcccttgcctaggctggagtacagtggtgcaatctcagctcactgcaagctccacctcctgggttcaagtaattctcctgcctcagcctcctgagaagctaggattacagacgtgcaccaccacactcagctaatttttttgtatttagtagagacagggtttcaccacattgaccaggctgatcttgaactcctgacctcgtgatctgcccacctcggcctcccaaagtgctgagtgagccactgggcgcttccaatttttgtttttttagtagagatgggctttcactatgttggccaggctggtctcgaactcctgacctcacctcgtcctcccaaaatgctgggattacaggaatgagccaccacgcccagcgtgtgagccaccgcgcccagcaaaattttttcatagtttcagattcctttcatcttatttttaaatttttatttatttatttattttttgagatggagtctcattctgttgcccaggctggagtgcagtggcgcaatctcagctcactgcaacctctgtctcctgggttcaagcaattctcttgcctcagcctcccgagcagctgggactatgccatgtgccaccatgcctggcaaatttttttttttttttttttttggtagagacaaggtctctttatgttggccaggttggtcttgaacttctgggttcaagtgatcctcctgcctcagccgcctaaagtgttgtgattagagacttgagccaccacgtccagcttctgattaattttaaagttaaaattaaaatccttaacatgatctacagagccttacgaaatttgaccctgttatgggctaaattgtatcccgcacccctaaattcatgtggagtcctaaccccctttacctcagaatgtaactgtatttggagacagggtctttaaagaggtaattgaattaaaatgagctcattaagatgggccataatccaacatgattccttagaagaagaagagattaggacatagacacccataaagacccataaagggatggccttgtgaggacacagaagactcctctgcaagccaaggagagagatgttaggggacacttgccctgccaataaaaccacctttgccaaaattataactgacagaattattacagtgaaagagatctgacttaactgactccatcctgcttctttttttttttttttttttttttttaagaccaagtcttgctctgtcacccaggctgcagtgcagctcaatctcagctcattgcaacctccgcctcccgggttcaagagattctcctgcctcagcctcccgagtagctgggattacaggtgcctaccaccacgcctggctaatttttgtattttagtagagatggggtttcaccatgttggccaggttggtcttgaactcttgacctcaggtgatccgcccacctcaacttcccaaagtgctgagattacaggcatgagccaccgcacctggcccgacctgtgcatttattgttggagcataaaggcctaggcagccagggcagcttgcagccagctggtggctggacttagtcctgcaggccatggggagcccctgggtggtttcaggcagaggactggcatggtcagattacattctagctgtggaagaaaggcagctctgggccctgcagctgccggttttgctggtgttatctacccttctaactgggatgtttccaagttctactcaaggtttctacacacaagctgttctgaaaaacaaatcaaccctgttaattgagtcaagtaaacaagtcctgaccatttatcggagaccttagcgcctgccttgcagtctgtctatgccaagccatatcaaaattctggacagctttaaaatccacatgtgggctgggtgcggtggctcatacctgtaattccaacactttatgaggccgaggtgggagaatcgtttgagcccagcagttcgagaccagccagggcaacatagtgagacttggtctctacaaaaaacaaaaaattaggccgggcggggtggctcacgcctgtaatccaagcactttgggaggctgaggtgggtggatcacctgaggtcaggagttctagaccagcctggccaacatggtaaaaccccgtctctactaaaaatgcaaaaattaaccgggcctggtggcaagcacctgtaatcccagctactcgggcaggggggccgaggcaggagaatcgcttgaacccgggaggcggaaattgcaacgagccgagatcacgccatcgcactccagcctgggggacaagagtgagactttgtctcaaaaaaaaaaaaaaattagccagtctggtggcgcacacttgtagtcccagctacttgggaggctgaaatgggaggatcacctgagcccaggaggttgacactggaggaaactatgagctcaccaatacactccatgcgtgacagtgagaccctgtctcaaaataaaataagaaaaatatgtcaaattaatagagacaaaaagtagaatggtggttgccaggagttggaaaaagggggaatgggggttgtttaatgggtatagaattttggaagataaaaaaaattctggagatggatgatggtaattgttgtattaggttggcacaaaagtagttgcggtttttgccatcactttcttttttcttttttttttttttttttgagatgagatggagtttcgctcttgttgcccaagctggagcgcaatgacatgatttcggttcactgaaacctctgcctcctgggttcaagcgattctcctgcctcagcctccctagtagctgggattacaagcgcccgccaccacgcccagctaattttttgtatttttagtagagatggggtttcactatgttggccaggctggtctcgaactccggacctcaggcgatccactcacctcagcctcccaaagtgctgggattacaggcatgagccaccacacccagctttgccatcactttcaatggcaaaaaccgcaattacttttgcgccaacctaatacaatacttaatgccactgaactgtttactttaaattgattaaatggtaaatgttacattacatatattttaccacatttaaaaaaaagatgtatagtgtaagccgggcccagtggcgcatctctatagtcccagctattttccagactggacaacataattaaaaaaaaaaaaaaaaaaggacggtgtgtggtaaaatgttcccttcaatggtgggccttcaccacctggaaccagggaagaccagcttgttttatctgagtttcttcctcaggaaagactttcagcctctcaaaaaaaaaaaaaaaaaaagaaaagaaagaaagaaaaagaaaaataaagaaaaaaaaagaacaaaaagaaagaaagtatcaggtcaggcatggtggctcacacctgtaatcccagcactttgggaggctgaggtgagtggatcacttgaggccaggagtttgagaccagcgtgaccaacatggtgaaaacccgtctctactaaaaatacaaaaattagctggccgtggtggtacatgcctgtaatcccagctactcgggaggctgaggtaggagaatcgcttgaacctgggaggcagacattgcagtgagtggagatcaccccattgcactccagcctgggcgacaaagcaagactctgtctcaaaaaaaaaaaagtatcaaaaaactgaaattcaccagatcactatgtccagacaatatgatgtgtgatccctcattcatcatgattgcttctttacccctccatagttcctgttttttttaacacatggttacatttcttccctgctatataaatccctgcctttagtccatcagggagacggatttgagactgagctcccatctcctgggctgcagcaccccttgtaccccccactccaacaccaattaaaaccttcttcttggcaatacttgtagtctcagttatcgtcttactgtgtagttagcagcagaacttagaaccagcttgtccaagccatggcccagcctggccaacatggcgaaccccatctctactaaaaatacaaaaattagccgggcgtggtggcatacgcctgtattcccagctactcgggaggctgaggcgggagaatcacttgaacctgggaggcggaggttgcagtgagccgagatcgcgccactgcactccagcctgggcgacagagtgagagcaagattctgtttaaaataaataaataaataaaataaaatcggctgggcgcagtggctcacgcctgtaatcccagcactttgggaggctgaggcgggcagatcacctgatgttaggagtttgagaccaggctggctaacatagtgaaaccctgtttctattaaaaatacaaaaaattagccaggcatggtggcacgtgcttgtaatcccagatactcgggagcctggggcaggagaatcgcttgaacctgggaggtggaggtggcagtgagctgagatcgtggcattgcactccagcttgggcaacaagagcaaaagtctgtctcaaaaaaaaaaaaaaaaaatcttccccactaggtgggatgtctcctgaggacaaggaatgggtcatttttcttgtgccattgcttgctggagtctccggcccatagacgatactaaaggaacatgtgttgagtggaatctcaatggataattcttttaggggtggactgtgatctggggaggggtggaaggactcaggcctgtgaagcatggtgtcttgattcatggtctatgctaaatgtgtttacatagacatgtgtctatgtgaaatgctgcctcactggccacagcctctactggggaaatcctcatggctaaaatgaggcctgggatgcttggtttgaggtgggacccgtgtgaggtgggcaagttggaaggccgtcagagctaggaaagggtagcggtgacattggctcctcgagaaagcagcaggggcctgtgggaagaggtgtctgtccagaggtcccgggaatccaggagtgtctgtgctgtggaggattgaggagggtgagcctcaaaagcccagccaatgcgttgccacttgaacctctctttgcccgaaaaatcaaatttgaggaggaatccagctcaggatattctttgtaaaatcagagaacagaggaggggagtcgtaagagtcagctagggctgccattaccaagtttcacaaatgtggcttaactaagagaaactcatcttcccccagttctggaagctggaagtctgcgatcaaggtgttgattggcagggttggtttcttctgaggtctctctccttggcttgtagatggccaccttctccccatatcctcacacagttttctctctaagtgtgtctgtgtccacatttctttctttcttttttttgagacggagtctgggtctgtcacccggactggagtgcagtggcataatctcggctcacttcaacctcagcctcccaggttcaagtgattctcttgcctcaacctcccaagtagctgggattacaggcgcgcaccaccacgcccatctatttttttttttttttttttttgtattttacgtagagatgggggtttgtcatcttggccaggctggtctcaaactcctgacctcacgtgatcctcttgcctcagcatcccaaagtgctgggattacaggcatgagccactacacctggccccaattttctttcttttaaggacactagtcatgttgggttagaggccacccataggccctcattttaacttaattacctcctccagaccctatctccaaatatggttacattctgaggtgctggaagttgagacttcagcatatgaattttgggatggacacagttcagcccataacgggtgggagaggagagacgggtacccattgtgcccccaaatgcatcacagggtggaaagactggtcctttaaagattctgggggttagcaggtgtcttggattggtgagagtaaataggctagagtgatcacctccaaacccctggccagtcacagagggcaccctcaaccccattatcttctttttttttaagtatagatgggggtcttgctatgttgccaaggctggtgtcaaactcctggcccctcaaatgatcctctggccgccttgacctcccaaagtgctgggattatgttatgtgtattttaaca

SEQ ID NO: 35 - DNA, 8481 bp, Homo sapiens
gacctcagccaaaggaaataacactggtattaattcagatctcttgaaagtgaatgaagattctagtattcatgcagcttgttggaatggtatatcctttcatttaaagtcaaagaaaaaaaaagaaaataatttgcacagagaaagctgctgtgggtgcgttaagctataaaatgtattttttattcatcaagtctcatattcttgccaaatgctcacctcacatacctaggaaacagtggaattaaaaaaaaatttttttttgtttttttccaaaaaagagatggtcttaacaaatgagcttcatcagaagaaaaagttactgatctagtttaaaaaaaaattctaaatgaattacctctgtaaaatctgcccacctcttttatcaaatacacaaatcaaatatcatgggataaaaacaattttccagttgtactggattatcattaaatatttcctaaaacgccttagaattcagtttgttttctttcttatttttactattttatttaccttcatcttaatggtttagaaataaagtcctcatctaaactatggacattaaaactaacttgcaaatattaaacaataaaaatggtttcgtgcagcagtcctcaacctttacatcatgcctcctgttttttttcacgaagacagcaaactcctattggtaatgcttcctgttagaagcaggtattcttcaagggagaatagtaagtaggactcactcccacctgcacccaatgctgagtgtattctagttgtaccagctaatttttaacattctgtaaaatatttggctgaagtctgaattctgtgaatggccaaattgctactctagtgtggaggcaaagggtaaaaagaaaaaaaaaaattacatcaccagaaaaggagcccattactgctcttatcctgatatcttaatcttattttgccactttcgaaccaaaaagagctctaaaaaacttttgttgttattgtttttcaagccatactcagattgttttaggtgaatgaaggaaacgcactgagaagataaagcaaacaagggaaagtaaaaaatatagtatttatagtatttcagtgaagtagtggcagtaaactggagtccttttacagagacttgacagaattagaaattctgagccatttctggcccatcaactaaattattacagactaggtatggccatcttttaccaagagaaaaaaaaatgtttaagtaaattcaataagccctgctttctattatcagagtgaaagagctaagattccttaatgtgggcagggtggtggtaaggtaggaaatcctttattaatttagtgggaaatacctactggtattcagaactgctctgagattccttcctcccttaactcaatagtgctaaggattttaagaaaatactctgtgaaaagtaacacagcccactaagtattaataatttcaaaacccaggtgttgcagtataatgaattaatcactctttaatttattattttttttttatttttgagacagagtcttgctctgtcacccagattggaatgtggtggcatgatctcagctcactgcagccttgacctcttaggctcaatcaaacctcccaccccagccttcaaagtagttgggaccgagagcacacgcaaacacaccggactaatttttgtactttttgtagagacaagattttgccatgttgcccaggttggtcttgaactcctgggctcaagcgatccacctgtctcaacctcgcaaagtgctgggaatacaggctgtcagacacaccacacccagcttttaattttttagaaacacatttctaaagatttttgtaaagtagttaacgtcaacaacttacgcagctttagtaagcaatctgtaagtcaacagagagaatgtgcgtgtgtttctgtgtgtgtacatatacagagacacacatatgtgcatatatatggtagataatgacccatgaaatccaacatcttaggaatgaactgaaaatgctgttaacaaggataatttattcaagaaaggaggtcaacaaatttctaaaaatctgttttagagagaatacatgattttggcatttggttattttttagcagcagatattaaaaatttttttattgacataatgacaggtagaatgcattcagtgctaccatgaaaccattctgggcaatgtatcttggtagttttgttgctgttccatgcatttcagaggaaaattacacactagaaaacccaagtcacttcctcattgccccacacccaggacactgcacagtataaggcagccggaaagaatgctgtgtttcacctctgagcagaagtcattggagacacgatttcagggtttctgtgcagagagagggaatgaagcaattagttgtaatgctaggggcaaaaagagtgggtgctgtcatcccactgccaactccaaggctagaggccaacccctcactgctgtatttggcctcatgaatggggagagtgtgggattcacatgcttgggtgtatgcattttgagctgtatacagatatctccctgttgtgggaaaaaagaggtcaaggtgataattgtaaaggaaagaattagaatacattttgctaaggtctgagaaacaccaaaattaatatcctagaaacatagaatttttaatggtacagtagaaaaagcacagtctggtgtaacaaaaacatcttattcaagttgggtgaaaaatgacattcttcagaaagtcctcgaaacaatcactggccaggaataatttatgttgttcaagaaggaaaaaacattgctttttcctttacattactaatgtaatatgcacatggacattaaatagataaaacaaactggtgacacagttaacttttatactccaaggctaccatagtagatagataatgataatacaagatggctttggcaaaaatgagagcgaataaatgaaacgcctttgttcaacgactggcctcccctttagtgctcatctactgtccattttacttttaatatgtattagttagaaaggcttcatatattttctctttaattttcataataagactgtaaagtaggaactattaatcctattttacaggcaagaaaactgaagtccagcaatattaacatgtcatgaggtgacagagccaggatttgacctcagaacagtctacaaccaaactgcctccaatattcatatggttctgatgagtttaggatataagctctgtacctattacccagcaaaaccaatacttcttcagagaaaaaaaggatatttgggaactgttatgggcttgtgttctcccaaaattactatgttgaagtcataacccctactacctcagaatgtgactatatttgaatatagggtatttaaagaggtgattaagttaaaatgaggcccttagggtgggccctaatccaatctgactggtgtccttattagaggaaatctggatgcacaagaagacaccagtgctgggcacagtggctcacacctataatcccagcactctgggaggccgaggctggcagatcatgaggtcgggagttcgagaccagcctggccaacctggtgaaaacccgtctctactaaaaatacaaaaattagctgggtgtggtggcgcatgcctgtaatcccagctactcagaaggctgaggaaggagaaccgcttgaacccgggagttggaggttgcagacaccagggcatgctcccacagaggagagaccatgtaaaggtgaccatctacaaatgaggaggagaagcctcagaatgaaaccaaccctgccaacactttgatcttggaattctagcctccagagctttgaggatataaatttctgctctctaagccacccagcctgtggcattttgttatggcagccctagcaaactaatatatgaagagagacgaaatcattgaatgtagtaacataaagagactgcagaagtaaatgcagctcatctgttgttcaagactggactgagacctgttgctgatttgggccttgttaataaagcaggaaagcgctctatccctgtgggcatgaaggactgcaggattgtggctgcatggtggaaacataccccttcccgggtattcctctcagagtactctctctcacagaaacatggctgaaatgtccccgcaactccatcacacacgccctcacaagcaaggtacatgataaattaaaagcatttcgaggcatggcccagtgttgttacctcagatgttgctagaataacatgacatttataaaaatacaacccactggatgtttggcactgcttgggaatgaagaatatgtccacttaagaggcaatacccggggctgtcaaaaaatctcaagccaggatttctttttataaacattacctatctttttaaattctacagtctgggaggtggaaaaaaaaacgtctgcttatttccaagtctccttttacttaaacagaataaacataaaccatacacaggaatatgctgaacgctcggtcagggcacactgacagaacggctctgtgcacctggcaaaaaccctcaacactcatatccttcgcgtggggtctccccaccccagcacacacctacacagagctcacactctacctacgtcgaccacctccaatccccatgcacactgaaagggagtatttacaggttatattttcagataccagccaaataatgttcccgttcactctctcgtccacctgagaccatacaacatttaacatctagaaggataagctcagccccgagcacatacgacaagggtgagcagtcatcgaggagttctcaagcaaggaggatttgccagcttccctctgaggtccaggccctgaaaggccaactgtggtatgtttgagtttccatcaggcctggtgcttgctggctgcgcccatgctcagtaagaacttcacagcccaactgtcctataaacatcttggccttctgctgagagctgctcgcctagctccttggagctgagaatatgctgttttagagccgcaggctgaatcttaactaacacttggagcacagctgacctctctcttctccaggccagtgactcctctaaacagacacacacacacacacacacacacacacacacacacacacacgaacatgaacataataagaacgggaagaaaagcccagattttcctcaccatgtgccacccagccatgtttacactgatcacaagtcctcaggttaatcttccctggctgaaaacattcacatgtgcagtttaccagtgtgcaacggatggcctgaaaaataaaggaggaaaaaaaggtcagcatctgttcaaagatactatactcttttcaccatttcaataaatattgcccacttctatttttaaagattttatgatggtaggggcctggagagttttaaaaataaatttagatatcaccaaaatctcttattaaaaaaggtaaagaaaacaaaagctcattcactaatacaatgttttaggtcattcacagtaacctttaaattacaaacttagaataaaaataaaggattacatattcgataagataccggatttacgacatcacaaatccaaaaaagaaaaaagtatattgctgctaatatatatttccacttaaatttctctacttgtcaataaagcaaaaaatacactgtaacaaaataatattcaagtgaaatgtttgtgaaagtaaaatatggcacacaaatattattattagaatattacttttcttctgctgaatttcaattaaatgttgtgctaaactctcaaatatattttaaagacactcctgtgctcaataagacctaacatatttctattattatttaatcacatcccaattccttgaatattttttattctattttcgttcctgttttgaaaaataaaaaacaatcctcctcttatttcaacagtgacataagaaagaaaataagtttaaattttggtttcagatcagacatggaacagaaaaaatcatttatgtgaatattttatatctggaacagtacacctgtattgcagaaaactgaaaaacacacttaaaaatctttcatttccttataaccactttaaaaaaccatctcaccagttaatattataaaatgaatccatagaaaattagcataaatggagtgtaactttttatgaataaaaacctatgtttaagaatagtgctaaagctgacctaagctcccggactacagttaataaatttatctcatacagttaattctaatttgcatagaaattctgaagacagaagggatttagtctgatcattcgcagattaacaatctactgtaactacttgaactgccaggaaaagatctctctgcagatttagatgcaatcaatgattactgattctggggtggaggggtgggcatggggatacctgaaactgcagctctgtgcctgaaagccatgctcactcacacagctccagatgctcatatttctggaaccattaggatttttatagaaactgtctcatttgtaacaggcagtattttggatattgttaacatgactgggacaaattccattcacagagaataagactgagcaggcttttaccattccctatgctttagatcaggcaagtgtaaaatatttctcttccattaattaatattaaatctatggatccctattggtttcagatgttggagtcctcactgtagactccattcatacttcacccccatctttaatttgtgcttcaatttagcactagggaaatatttaattgtataatctccctgatatttcaggatctctcttccaaacatggtccaattgtagctaggttgtaaactttgttgtatatagaagtgattaatttgtagactataaggagaaacgtttcttccagaagttcttaaatttcaataatttgttaactgagaaatatatcagaacatcccaagtcagaaatagtttatttaaataacatgttcattagttaatgaactcaaaacttgattgtactgtgaccaaaataaaaagagcttagaggacagcatttccactaaaaacaagaactttacaaattatctaattataaattcagatacgggaactatgttgacattaaaacattcatataatttgaagtgcaataataaaagctttcataaatgctttaaaaaaaatagctctgctttaccgaaatcaagggagggccaataaaatgagatggtatttcaaggacagttaatataaactccagcacaaaagacacaaatatttaaatcattaatttgataatatttaattattttataaaaatatcctaattttgtattgtctttaaagcacactttcatcaactttaattacagccatatttaagacgagaacaaattaacagactgtggatttgatttatttttatgtgtatttattttttttactggttgaatcattcattcacttactctgaacaagtttatgattcaaatattttgtcttcctaaataactttacacatttggtacattcgggaattcaactttttagatcattattcctttttatgaattctattctttttgtacctaaacatgcaaacactggaacacctcaactccttttgtatataaacacttaagcactagaatatccattttgtatatctatgaattccagaaggtctatttgttttaaattcagatttatatagactacaattttcccttaagagaattatatatatttaaacaatatggtctaaataaatattttgagtaagagactattgccgcttcaaaggaagttttattctaaataacatttttgaaacagcataaaactttgacatactatttattcacaacaaaatagaaccaacgtgatcactggccaactcacccacacgcaaataacataagttatcataaaactatcaaaaccagttaagcctcaaaaatgtacatgcattacaaggagacagttgggaagagtcgaaatgaatatgctttcattcttgtgagcatgttcacagctgcctccattcagctcatgtctgagtgcctccaaccctcttctgggcactcgggacaagaccaagctgttatattctctgaactacacactttgaaaatgcaggtatgcagaaaggagcagagagttcagtcagagtgttcccacctatctatgcagagattagtattcaggtctgggtaaagcaggcctccaggacccagcctaacaagggtgccagggtgccttgtaattctttcctcaatttccattattggaaactgtctgctcttttctttatacctgcattttcaaagtttgtcgttcacagaatgtaccacatacagcttggtcttgttccgagtgcccagaagagggttggaggctctcagacatgagctgaatggaggcagcagtgaagatgatcagcatatcccaactccccaagaacaaccataacaa

SEQ ID NO: 36 - DNA, 435519 bp, Homo sapiens
  misc_feature (285173)..(335172): n is a, c, g, or t
acatgttacttcctattcccataaaccctccactgtaggattaacacctaagacaccaaccaagacacaaaccaatacaaaaaaagatatgacccttggcgtacagtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgaaacgttgtgcctctgccccgacacagcctcatacgcctcactctttacacacacggtcacttgccccgcgcactcccgagccctttccagccctgacacacagctgggattctcacttccgatcagcggtcctgaacccgctcccagggcacgggaactcccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagtcgccaagaggaagtgacgtctgcctctccctttttccctcccgcccctgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcactatctgctgactcatctttgactttgttctcgcgatggtgtcaagagcctggacaccacggctggggtcgagatcccaccagtgtccagggacctcccccagcccaccagtatcagattctattccattgctcaaatcacaaaacatcgagtggagagttctctttggagaccgtaaagtaaagattctgtggcatggtggccagttaggccactggaagcatggcaaaatattgaaaatgagggattgggtgacagtgtagtaactgctgaatactaaatacttgatccaggccccattccctggagattgacagggagacacattgtccaggtagtagtggagaaatgctttctgggtatctgaccagcctttgtggaaagaactggcaccatcctgcagatgtaaccacctgatgggttcttcctgaccaatgtacacaaaaattcaattcatggagaccatggcactgcaggaaagagtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggtgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatggtttccagatgaaactgttccacctcaggtcatcaggcatcagttacagtctcataaggagtgcgcaatctggatcactcacatgagcagttcccaatagggtccgagctctgacgagcagctaatgctcatgctgatctgacaagaggcagagctcaggtggtaatgctcgaaagcctgcagctcacctcctgctgttcagctgggttcctaacaggccatggaccagtacctgtcttatggccctggggattggggagtcctgatttaaactataaactctatttttcccaaagatagcttgggagaaattgcacaggaatgagcaaagacagcaagcctgtgaggctagaaccaagatggagtcagccatgtcagctttctcttgttgtcataattttgcaaaggtagtttctgaggggctgcactggacacttcttaaaaacatgagacagatgttattgtatttactacagtaggcaagagagaccagcagagaactgggctcaacctcgaatacagcaggaggagttgaagattatagccaattggcaagataagaaagtcagtggatggaaaattactaagaggaacttgattagctatcaaaggtggttgcgaggactcttgctaaactagactcaacagtattctttcctaaaactggacttggcaggcaaagaaataacagagaaaagggctcagaggaaactactaaggtttggtcaaagactagagtccttgtcaactctacattgaagcttctgcaaataaacaaagaccaaccaaatgaaaaaaagcaaaagctatttattctgagcttgctatagcagggagtcagtcactgttatttgtgttttggcagagacttgaaggcagtcataaaggtgggaaagctttttaaaaagaaaggcttcaggggccgggcacggtggctcacacacataatctcagcacttcgggaggcccaggtgggtggtcacgaggtcaggagatcaaaccatcctgactaacatggtgaaaccccatctctactaaaaaatttacaaacaattagccaggtgtggtggcaggcaccagtagtcccagctactctggaggctgaggcaggagaatggcatgaacctgggaggcgaatcttgcagtgagccaagattacaccactgcactctagcctgggtgacagagcgagactgtgtctcaaacaaacacacaaacaaacaaacaaacaaaaaaacaaagaaaagcttcaggtatgcttggattggaggctgtcagcatggtgaagctgttgatagatgaagaaaatcaaagtattttaccccagaatatatttctttggcatattttaagatggctgtcagagagccagcaaacagaaggaactctgcaaaactgtcttttgtaggggaaatttacacctgcagagaatctgcattaatccagctttatcttgtcaggtttgagaaataaaaataagccctaggccctacaaccaactgaatggactccctcttggctgacaggaccacagagaaacttcgaaagcagtttctggatgtggcaggctaggaggttggacatgccacctcaaaaccctcccctcactaactgccattatgatgcaggagaacagcagagggaattggaagttggataaaaggcagagtgagtgaaagcagagaaagaagcaaggtgatggggtgggagagcaagaagcaagatataaggcagaagttgagcagccaaaacaaaaagtaagatttaaaaaagcaagcaaggctgggcacggtggctcatgcctgtaatcccagcactttgggaggccaaggcaggcagatcacctgaggtcaggagtttgagaccagcctggccaacatggcgaaaccccatctctactaaaaatacaaaaaattagctgggcgtggtggtgcactcctgtactcccagctacttgggaggctgagacaggagcatcgcttgaacccgggaggcagaggttgcagtgagccgagattgcaccactacactccagactgtgcaacagagcgagactctgtctcaaaaaaaaaaaaaaaaaagaaaagcaagccaggaccccatggccggtgagatccaaaccagtaaaggggcagctcctcagagataggcatgtgcattagagaaaaaaagtatccttaacatgactccatatgataatcagctcattaaaactcatgcatatggactgcacatcatgcatgtacttaaaattatgggatggaggcaatgtgcaagcacacaagggccaaagtaactaagcaacccacctatcaatcaaaaggcaaacactggctaacgattaggcatccttgggaagagaagagaaagaaacacacataaaaagacccaacgtacaccaaactaatactgatctcacatcccagagatcagcccactctccccactctgagactgttactgtgcttaataaattttgctttgctttgctgctttgtgtgtgtcatgtacagttctttgtttgggacaccaagagcctggaaatgcacggcaccatctggcaagaattaggattttttttcctaagggttaacaatccaagcctttggagagacttgcttcactgctgttatcaaccaacagcctgatgctttccctcccttttgtggttttgacaaaacaagcaagcagcattccctcctgataagagaccaccgacctaggaatcattctggccagactacagaggatgtacagtgagggttttcatgtccattgcctcagattttgacgtcagagggccacaaactccactctcagatgattgctaacgccaccattttatgaacatgagccccatggagaggcacgcagctcaactgcacatctgcacatttttcctcttataaacattcatattggaatattatttggtactgctcccgtgaaagatacatttgcagaatggactcagattagaagcattatacaagcactataatgtagcaatggcacatccagctctctacactatagaaatgtctgcagggtaaacatttccacaatgaccaaagatatctgtacaggactggtgactgcagcattctttgtaatcctaaaactatgaaactaaagtcatctcaaaaacattttgtttttttgagatggagtctcgctctgatacccaggcagtgcagcggtgtgatctcagctcactgcagcctccacctcccaagttcaaacgattttcctgcctcagcctcccgagtagctgggattacaggtgcatgccaccatacctggctaacaaaaacattttgaaaagggttaaataaatcatgcataaactgaggaaaaatactattttcaaaaatgatggagagaatcactttcatgatgaatgattccactggtcacattattgatagagcaatcaggaaacccaggcacatcctggaggtaatactggactcctattactaaaatatgaaaaaatggagacacgtaaatactcgtttaagcgtataacggactgaattagaattttatcacatcagaagtgggttcctaggtctctgtttcaggattccttagtgacacaggtgtaaacccggcatttcaggagatagccggctaagaatctggtcggggaggtgggcggcccttgacatggatctgtcataaattagtggcttgagactttgggaagataaaatcttccccatttatctagtgattgacattgcgtgaatgcttcaaaagttccaataagcgtccctgggtgggctcgaaccaccaacctttcagttaacagccgaacgcgctaaccgattgcgccacagagacaagcgcttccaactctactgggcatctaggaagggcgcactcactgaacttcctccgttccgtctattctcagggcccaccgggcaggaccactgagcaaggccttggaaaaccagagagattagagcggtgagtcgcgccggtcacgttggacgcctgcgtgttaggagattctggagccagaagaacagcagaattgccttcgcccgccctgcccctcgcctgctgcagaagcttccagaaactccctggtgggcgacccagcccgagctgcctggggccccaagggaagctgaacgccctgtgggctcctgggatggttcttcccgttctttgcgccgccttcacccattgaaggagcctgtgcccaccctgcccagtcgctttccgggccgctgaggagcttccgctgccatcttcggatcctgtgttccgcacgggggctccaccagggcagggatggtggtgagggtcgctcgtgggtcccctcgcggggagcagggtctggtactcaccagggcgcacgactaggacttgtggaatgaattcatcgtcgcctttagcttttagtcctttgaagagccctgagagtggaaatcaagagattttttccacggggaagttctttttacaaagcgttgatttctcggcacccggcagggagggcaactggcagggtctctggcgcaccttctgcgcggtggagccacgggggctcagctgggcggtggtgcggccgtggggtggtaggtcaagagctgggaaaggaaaaagcaaaagctgggaaagaagccggggagcggtggaccagacatccagacctcctgaaaggctcatgaaggggcacaggcaggatcttctggaagtgagaattgttttgtttgtttgtttgtttattgtagtagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttcaattgtctgtccgttaaataaataaaacccttttcctatatctttaaaattacgttggttttatcattttatgattacaagtaatgctgcagtcatcattcttgtacactctcattggccactggtgtatttctatagggtggaggcctggagagtagttgttccagcatagtgtttacatagcttttatttcattccgttttctttcctttgttgctttattagctataaccgttttcttatttcagaggctgctttagggtttccggaatacatctttaatttatcatagtctgctttctagtgtcattatgcctccctttctggcctttatcctagtgttatgtatctttactttatgcactataacctttgtgattcattattattacttttatttgttacgtcaaatattttttgaaagatttaaattataagaaaacgtgtagtacatgctttctaaatgccatttccaatattcgtttctttgtgtaggaccacatttttatctggtatccttttgcttctgcctggaggacgcaagatttcttgtagcgtgggttggtgaattcttttagcttccgtatgtttttcaatgttcttatttcactcacagttttgaaattttatttttgcatagaattctaggttaactttttttctctaggtactttaaaaatgttgccatttatgaagcattgtcatttaaaatatcatctttctttcctatgtttgtaaatatggcgtaaagccggtttcttgtgctggttatacaattttcagaatgtgtatttaaatttaaaatattaaattgtactaaaaaactaaaaatattaatcatgaatgtcctagattcatcttaagttccaacagtgcacttaaaatgtgcccaacctgagggtcaaacctacctgctgatgtggaatttgtgtttgtgagacattctcaacagcatttgctttccccagcctagtgattttcctcacatctgaatgtcttcattgcaaaaggaaacgtttttctttgcaaaaatactttaaaatattcttacttcaagtaggtgtactaaaaacaaatttctcagttgcatccctgaaatccatcgaaagcccgggagagacaatcaagtgcttcaggaccaagagtgaaacaggagaggacaaagcagggcttcttcactaggagtcaagccaaagtcaactgatttggtctccaatggagaacggaactcggttcaccagcaacgtgaggacgtggcccagaggagacggagtttcccttcatggtgccttcagataggaaatctaggattttctttctttccctttgatctacttccaactctccctttctgtttcttcaagatctttttcggatccctgggtgcgaaggacataaggggccagtggccttccctactggtccctccttgactgggtgtctttggagcccaagctcacccggaacattactgcccgctgcagacagtgagaggacaaaggagggcggtgggtgcagtgggaaccacagagtcaccgtgcacctgcgcccgtgggctcctagcaaattgaataaatgccccctgaagcttctctgcaggtcagagggaaggggagggtggctgccgacctggcgggagaagcttcaagaaacatcgggaggacttggccctgcccctgggccttgaagacaggcctggccaggctgattttgatgggtaggcccaaagaaaaggttcgagggcagcccaaaccccgaccctgagattaaggctcttaagtgtctgacagttttgagaatcgtcagtagaatcgatcctgcctgtatcaggagacttctttgccaaaattcagagaccaagaaagagaaagattgggcagatcaaaatctgtcattaaccaaacaggaaacataagttttctgacaaattgaatgtgtgctgtgagaaaaagactagcctcaaggagaacctggttttttggcttgagtgtagggaagaatggagttgccaccaacaatggtgcgttgaaacggcaggtgcatcaggctgtagatgtgaaggaattaaaaatattttaccccaaactacatttctttgacatattttgagatgtctgttcagaaagccagctgcagaagtagccctgcaaagttgtcttttgttggggagatttgcatctgtagggaatctgcattgatacagccaagtctttccttgtccagatctaggaaagatgaactgagagtctgacacctgtaaaggtctgaaagaaacttttagggtttattctctctgagagctgctacctgtaaggtttcatttacatattaagaccacctttgctagccgagcctcattttctctccctgccatcacttatcttgtccacaataaatggatatacctctgactctgattgcacctggttttggccatgctttgagccctcattcattctgttatctcgagatggtatataagcttctgcatcccattgtgggtaggggagggtaatcactctgtgactctccccatgcacatgttagtacattttatgccttttctccaattaatctgccttttgtgacttgatttttgagtgaaacttcagagagttaagagggagggtttccattggcccctacagttttggagctgtaaacaggataggaaagctctgctcttctggaagctgcagtgaagaacccaggatatgatcagctatcataagggtaagaatttttttaccagccaggctcctggcctccttctctgtgtggaatctcatcaagtggatggtaaaaatcactgtttctttcttttccctctccaaaatcttgattaattggagaaaaggatttgtgtgactagtcttgggtgtagtgactctggtgtgctttttggtactttgtggtaccaattcctattgtttaatccctttcttcccagaaattgtctgttcctttgtctttgtctctatgtgttattctgtcataaaagggggtactggttgaggttccttctcatcttattttatgtccttgagagcttgacttgtgaccaagtggaagcgctttctcttggtttccactatctggaaagaggcggtaactttcaggtcatactaggtggcctgtctgaaaatggctgggaaccccagcacactttttgttctgaccatgacaagctcttggggtttgtcttaagaagtcccatccctttgaggcttttgtcatctcaattcttgttgcctggttagttctaggaaagctcaatcccaagatggcctacctggtatcatggattcacaggtctgtgactggaagtccccataaatttgtgggttgctggaggcaaacatcatccttacccatctgtggtctactctactaaaaatacaaaaattagccaggtgtgatggcatgcgcctataggcccagctactcgggaggctgaggcaggagagtcatttgaacccaggaggcggaggttgcagtgagccaagattgtgccactgcacactagcctgggtgacagagcaagactctatctcaaaaaaaaaaaaaaaagaaagaaagaaaagatttaagagaacaattattttaattgaatacattttgtcaagattaactcaactttcccctagagtagtgaaagaataagcaatcgtaatttagattctaagttactggtctttgagaaagtgtgaaaaccaaaaaggtgccataagtcaaaaagagcaaaagtcctaattttcaaactgatgaaaataaagtactaaaaaattgaaatcatcatagttcatcttggtccttggcaaaatacaaatgtattgattcaaattataatatcttagctaccctattgtgcgtagctcttaccactgaggagaaaaaccaaacccaaacaaaagtgtgttcaagttggcaacaatgtttacaaacctgcaaaatctcttcagcctatcccttaaactccagacttggtatttactaagctctgtggtgtacaatacccaccttaatatccattcttgcacaagttctgttaggtataagccaagatgacatgagatttttttttttttttttttttttttaccctctcatgcctatgtttgcttttgcttccacagacccttctgagtaaggactatcctcagactactggaggcacttagtcacaagcttgcctgaggctcagagctggcaatacctgggagtttatgtcaatcccacagcacccagcaaccctgcctgcaaaatatttacccatgattgacaggtgcaggtgtatgaaagcccagctccttgacttgaggggcacctttgtggtgaattaggtttggcaaaagggaatccagaggccaactttgtaaaaatgcagatagataaatagaaagaaatctttgccttggaagtccagttgagaaagagagtgatttacttgagactctgaaaacagagactaaaatctgtactttttcatgggaaagaagcctatggtgaaagagaaacaaagagaaaggtaggaaatagggtgggtctactccgtagctttaaaccactctgtcatattataaagcccggtgaggttttaactaacacaagtgtctggactctacacatagagattctgatttaaacgcttccaggtgggtggaagccactagtagtcttaaaacactcccaagtaattttaccatgtggctagagatgaaaaggacaatctatctactagaatctcaagtaaccattattgaagtgccccaaatgtgcagctacctcatagaaaaggcttaacaccaccctttgatggaatttcccttcctctctccatggtcttgtctgcatagcatggaaaatagagaagagataaagaggtagatggagaggttgaacctgtaatttgcctatgtagagcagtttctcaaacttttctgaccacaagatgcagtgagaaatatacaattctttgtgatcagttttttttttttttttttttttttttgagatggagtcttgctccgttgcccaggctggagtgcattggaatgatctcggctcactacaagccccaccctcctgggttcacaccattctcctgccttagcgtcctgagtaggtgggactacaggcacccaccaccatgcccagctaatttttttttttttttgtatttttattagagacggggtttcaccgtgttagccaggatggtctcaatctcctgacctcgtgatccacccgcctcggcctcccaaagtgctgggattacaggcgtgagccactgcgcctggcctgtgatcagtttttaaaaaatcttttactatgtgtaatccaccctacctagaatttaaataaagcctgcagtagtaagcagtcgactatattgatttcacaacccctaagtggttcagaattgcaattagaaaatttttccttttggccaggtgtggtggctggagcctgtaatcccagcactttgggaggatcacttgaggtcgggagtttgagaccagcctgaccaagatggaggaaccccgtctctactaaaaaaaaaaaaaaaaaaaaattagctgggcgtggtggtgcatgcctgtaatcacacctacttgggaggctgaggcaggagaattgcttgaaccccaggggctggaggttgtggtgagctgagattgcaccattgcactccagcctgggaaacaagagtgaaactgtctaaaaaaaaaaaagaaaataaataaatttttacttttgctctgcctttttatcaagcaaaatcccaaaagaacatttactataaacatctttctgtgaatccttatttctgtcccagccaccatgacccaataatctctagagcctgttagtgttctccagattgaagccttccctctaactgctcctaaactctgtgatgtagtggaaaagttttgaggcctcgattctcatcccaggtttttcacctacagatcatacggccttagcctcttgacaccattgtctccttatggccaaagatggaactgtacttgggtggtatctgagcaccctgttggctttgacattctagggctcttcccttggcaccactctcttatttaaaaggaacaggatgtggacttaggagggttatttctctgcaaactatcctctctttcttatgacaagctatttctgaatgtgcacatttgaggctaagcaaattccttcctgggaggttgaaagacccttatttctctccagaggagtattatggagagtcaattgatgctgaggaggtggtagagacctagtgaactcatctgcagtggctttgagcaaggcttttagaatcataaggtgggtggggtcctgtgtcctacaccacaggccagctagttcatttcaggagacttttttttcaatctattattactatcttcttctagactgtagttcactactggagattatccacttagttacactcagtttgcacctggcctgtatcaccagtcagctctcactccagcctcaggtatcagcaagacctcaccaaagattattgtttaattttgtgtgtgtgtgtttttgtttgtttcgggtaacaactaatgttggaactatgaaaagctcttctctacttttaacaaagcttagtcacaaacagttccccagttgatgagaaaaactaaaacaacagaacaattgaaagtccaaatctgcaagctcatctctgagaaccgaattctacagccactccagatttgtactccaaatggatagtttgattgtagaaatcacatcccttcagtctgccaatgtgataagggcccaagagacagtgatgcctagattcatagataatcccctttcccccatcctatatataactggagtcaacagcagctggaggaaaatggcaagaacttggaatcaagattaggttagaataacactgctgtagacagtttatcagctcttcagcatacgtccgttttccttgaaggatgagcctgtagaaacctctgacaataaagtttattttacacccattcccttgcctatgattttttcatacaaatcacaattataaaactttcttgctccagctaaaagcaggaaactcaatcatgaatgtgttcactaaatatataccacagaatgataacaaccagtctgattgcatcacttgattccaaaattaaatgttagccctcaggggtgcaactacatgtatctccaactctggaagccacaggcaacatattcctgtttccttgcagggaaacagatctataagcagggcggcagtctgacacatgtacattcctgggaaacccaaggaaacaatgatagtgacgcagggcaggcaagcccccaaactgaaagagttttgctaatgtcgcgattggctttctatgttatttgaagactgagatctccatgaggagtgaagataggtaatgcctaaggctgaggcatgacctcactgggtcaccttagctgtaaagtgaggtcagttgtcaccttgcaaaccttttggtaatccaaatcttggaatgatttctttaagaatttagacacttccaatacttttcctgtccttgtggggaaagcttctatccacctggtgaaagtgtctataaatactagcaaatcttgtagtcccctgtaaggtggcatctggtttaagtctgtctgccagtcttcaccatggtatgttccttggtgttgtacaggtttaagcagggatcggggtatggggtggcttcctgagtggtaaccctttttatagtttggaacagtcccttccgcaagaatatttaggaaactaatttaaatggaaaatcctgtcccaaatgtgaggaatcatgaaaatgtttaattatttcccatctgtcagcctcaggaatagagtttgttcttttctagcaaccatccagatgggtctccctggaagccttttactcagtccctttaatttccttaggggtatattatggtgtcactgacacggatggagtacctggtagtagcgcagcagcctgaaataccagggtttccttagctgtggccttagctgctctttccaccagggaatttcctctaataataaaagtgtctcccttctggtgtcccctgcggtgagtaattgttatttctttgggagttggacagcatctaaaagttccaagatctgagtaaagttgtgtgggggatcccttggctcttgatagtcccctttccttccctatggctgcatgagcatggagcaccaggaacccatatttagagtcagtcaacacattgactcttgaggttttgttctttttttttctttttttgaaacggagtcttgctgtgtcgcccaggctggagtgcagtggcatgatctcagctcactgcaatctcagctcactgcaaactcagggattctcatgccccagcctcccaagtagctgggattacaggcgacccccaccacacccagctaatttttgtatttttagtagagacggggtttcgccatgttggctaggccggtatagaactcccaacctcaggtgatccacccaccttggcctcccaaagtgctgggattacaggcgtgagccaccgtgtccagcttaagtcttttcatggttggaaggccctaattagagcagctaattctgctttttgaacagaagtctgagaaggtaaacccttggcctcaaaaacttcttgttggctaagcttcctttcttactccctcatgaatatagctatttccatctctaaaccactcaacatttgggttagacaagagcttgtcttcaaggttgggccttctagagtagagctcttccgtggtttccacacaggagtcaatgagtttgggatctgtttcttgagacgtgaggtgcagcaacagagtagcagggtttaaaaatcaggacactttcagggtaacatctggggtgtcaagcagaagggtctgatatttaagtaactggccccctgttagccattggtgtacttttgcctctaggaccctctgtactgtacttcatggggtggcagggggtgggggtgggggtggggtggtatggcatgtaattgttgtcccaaggtaaacttactggtttcgtctaacgatagagtgatggtagtcacagatctcaagcttcttggtcacctagctgccacctggtctagctgtttagagaaataagccactggtccaaagcaattcctcagcctttgagttagaacattcgaagctgtcccttgttattcatccacatagagggtgaaaggtttttctaagttcgagagtcctgaggcaagggatgtccctggcttttcttttaaggctaagaatgccttttgacaggttccaagctccgcctcctgggttcacaccattcttccgcctcagcctcctgagtagctgggactacaggcgcccgccaccacagccagctaatttttttgtatttttagtagagacggggtttcaccgtgttagccaggatggtctctatctcctgacctcctgatctacccacctcggcctcccaaagtgctgggattacaggcgtgagccaccgcacccggccaacaagtttttttttttaaatgaacagagcatcagtgaatgatagtgcaagtttaagacacctaatagacaagttaaaggagtcctccaggcagaaggaaactgacaccagatgaaaatgtggatgaaaaaaaaaaagacactagaaatgacatctacataggcaaatatataattttaacatctgactgtttagctgggcacgatggctcacgcctggaatcccggcactttgggaggccaaggaaggcggatcacttgaggtcaggagttcgagaccagcctggccaatatggtgaaccttcctctctacgaaaaattcaaaaattagtcatatatggtggcgcaagcctgtaatctctgctactcaggagtctgagtcaggagaatcgctcgaacccggaaagcagaggttgcagtgagccaagactgtgccactgcactccagcctgtccgatagagtaagactcgtcttaaaaacaccaccaccagcaacaaaaaagcaaaaacaaacaaacaaacaaacaaacaaacaaacaaaaacacatctgactcttgaaacaaaagtaatagagatggattgtaaggtttataacaggtgtaaagtaaaatgcatgacaatagcataaaggcagggggaggagtcatgtgaagaggtatgatgccacttgaaggcagactgtgatgggttaatttttgtggaaagcaaggcagaatttttgaagtttgtttcttcaaatactttctgtttcccgtacatacaagctagtttgttctgcagagatctcattttctaggaggctcggagggggaccttctgctgtctgtcctcatgggatgcacaagacacaagggaacagtctttcacttttaaatacattgatgggtctgaggagatagatacaactgcattttttttttaaatgaggtgggattctcattggtcttgaacttctgagctcagtggaggcttcccctacttcagcctttcaaagcgttgggattaataggcatgaggcactgcgcctggtcacaaccaacgtttaaaatcacgtccctgggtggtctgtaaccaccaaccttatggttaacagccgaacgcgctaaccgattgcaccacagagacaacctcaatcgcttgctttcatctctatatagattaagcaatcactaaaccctaggagttgccatttgctttctgcgggacaactgtgcagactacaaagcttcagaaaaccggagaggctgagtcgactaatcgtgttgttgcacgttagaaacgcgtgcattgcgtgactctgaagccagaagggcggccgaatggccttcaccctgcgttcaccctcgcctgcttcagaagccagtgcctctggaaatgcctggatctgcgaccccagcctgagccaagtagggcccaagggaagctgaactccccgacgtctctcatggtagctctttctgttcttttgcgccgccttcaggcaatcatctgttccgcttgctctcccttcactcaactcggcttcagtagatggggtcggtggggcgggagcgggaaagaggcaggggagtcaaaagggaaaacgtgaaaaggaggagggagaagcaggggagaccaggactagacaatgggacagcccaggatgcccgtgcagagggcaccggctggatgcagagaagatgggacatgtatcagatcggagaggaggaaatggggagaagatgtgagagaaaatcacaagaacctgtagctgcccaagaataaagaagtaaaaatcgcataatgtttttacattaataaaaaaaatcgggggaccaggggcggtggctcacgcctgtaatcccagcactttgggaggccgaggtgggtggatcactcacttgaagtcaggagttcgagaccagccgggccaacatggtgtaagctcgtctctaccacaaatacaaaaattagctgggcgtggtggtgcacgtttgtagtctcagctacttaggaggctgaggcaggagaatcgcttgaacctaagaggcggaggtagcagtgagccgagatcgtgccgctgccctccagcctgggcgacaaagcgaaattctgtctctcaaaaaaatatataaataaataatagaggggtggggaagcaaaacgacgggcagtaggtgtggggcgccttgggattctctagtggttagtagtctgcgttgtgcctgcagcaacctctgttctaatccgaatcctggtacagtcagactctatcttggacccactggggcgaacccacgtgtcttttggtttgcttttgattcctgcaccagctgaggcctttatctgcagccagaaagccggaaagcagggtttacccctggccccacagcgccatactgtctggggaaaagaaggaaacccaagagtacacaaacagtggcccaaagagaaaccttccaagtgctctatgcctcaccgtttagcagaaaatatcaagcaactctcaatctagctggtctgtaccttccacgaatgaaataatgtatttattgcagtctttctggttgagatatttcaaatatttggtggagcttttaatgagagagacactctcgagtgtggaagaaaaaaaagaggggatgtgaagataaggcgactttaggacagaaaaaaaaaaagagacaaggaagccatgtaaacgtttttggatgggcgtgaggcgttgtcagtcttgaaccccgttatgtcaggtaaagagcgcagcctcttctaccacaaacaccatttcccacatggaggaaatcacagggatcagcaactctagagtgagatgaagaagcttcactctgggagaacccccttcgtgaccacggtctctcccctgccaggtaaagtggaaatgagcacatggcttgcagggacagcacagcctcctcgccctggccggtcgctcagggtcaccaccctccccactgccgcccctcgccattcttccaaaccactctccaccaaagattccaccgacagtcaccccacaagacaacccaggccgcctctcagcagcggctcccgccccgcagccaccgcgccctctcacccccgcgcggttctgcccgccgcctctgccgagtctgcgcacttcacctccctggctcccgctctcccctgagcttacagtggactcggggttcttccgaacccctcttgggagtactgaatggaaaagggggagcgtgcgcaagtgcttggtagagtgtagacgtcgtgggatttgactgtggtacaatcgcttcgacgtcctagtgctgatttttccacctgccttctgcttagggcaccggcagcagttttccgtctgtgcctactccacctgctgtccttgttgggtcagcgaacatcgcctccctctaccgctcaatcagcaaacgggaccgccctcgaggacctcacccgccgcttacccccctaacaaattcgcgggcatcgcctccggtcgcctcttcccaaggcctaacgagcgccttcgctggcaacggaggtgaggaggctccgctgactggctggtgcccgtgtccggggctgccacaaacgccacgacttggcttggcctctctcttagttattcgcagctcagcccgatgggcgtctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaagattcctgcgggagggcggccagtgtaaaacaattccctgaccgggaatcgaacccgggccgcggcggtgaaagcgccgaatcctagccactagaccaccagggacacacaggagggagctttctctcccttcttctgtcagaagcgacagcttccctgagctctgggaggacttgggccttgtgagggtcgctctttgctcctggagtctctcacaaggccattccctccctgctttcttcaaaaaaagagcctgcaagcgacacaccgagggctccgcgagggacaccgaggccacgagtccgaaggcctggagcgagttgcagcgacccggccgcagctcaccactggactagagatgcgcctttgcgaggtggcagcaagtgaccagtcggtcgtgcgtcgccaggtccggagccgcgcaccaggttgccaggaggaggcgggagcgcggaggcgcccggggtgagacgggggcaccctctgcatcataaaggacccagacgccagcaccctcaacgtcataaggaatcagacggatgcggaaaccgagacgggctggatgggaaactctttccaggaaggctccggggccctcagctggtctccgaccttcccctgcaacctgtgacacctgccattttcccatcttaggcgatggcaacgccacccttccgtttgctccgggcaaaacttcgagagttccctctgactctggagttttttcctcagatccaagagccaactggtcatcaattcgtaatttcccatcggctaagtgcgtgggcattgagctacacgcgagtctctccacctctgcggaatggctacttcggggtaggggaggggccctcccgtggattgtaaggtgtttagcagcagccgtcgcctccgctgactagatacatgccagggggttagcattctccctccccgcttcccccattcgtgacctagtgtcccagcgtggaggtgagaggcgtgtaagggcaaagttgccccctcttgagaaccactgatgcgcgttgtcctgctgtctgagcttgtgcagaggactctccagatgaaggctcaggggtcgatccagcttgagaccccctcgctcccccgcacagtcagaccttaggattggaggcttttaacatctctacatcatgagattcgaaacctttaggtcttttcttccgttctgtcctccaaatcggcctcttccgagcctgttgaccagggccagccaggcagacggctgggttcgctcaacgaggctcctctcggccctcctggagcttcaggcctctttcggttgcagagaaactttatgggccacttccttcggcatccccgggggcaggtgcgcggtgcccggggaagaagagggtttgactgcggttctcgacccccggcgaccaacctccaccccggtgggcgcgcttttccaggctcctgctggtcccactggccgggagttaggtctcgggtcagcctgagctccagagatgcccaggcccggaaggacacttaggggaaaccagctgctcactttggtcttgtccgcaacggacctcttgctgccaggaaagaaaggcgtcgagtcctgtcctgttgggtaggcggaagagagatcaaagggaagacaagaaaaatcctgggaggtttcaggatctaaagttaccatgaagtcgacctaacctcctctggaggtcctcccagtcctcccgtggctggcgatggtgaatcgagtttccgtctccagtttgccaaggcggacaaagccgacacaatgggcctgtccactatcttctttcatatacacaaaatgtcagcttttcctgtttctaactggcaacatcccgcctgatgaccagcttagcaaattagagactctccatgggattccatctgtgtcttagttcgggcttctctaacaccgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaatcttccgtcacaagtcagcaaccagcatatgtgagtgacagcatgtgttccactcagaaatgagagtgtattagtccgttttcacgccgctgacaaatacataacatagtccaggacgaaaaagaggtttaattggacttacatttccatatgactggggaggcctcagaatcatggcgggaggcaaaaggcacttcttacaaggcagcagcaagagaaaatgaggaagaagccaaagcagaaacccctgataaacccagcagatagtgagacttattcactgtcaggagaatagcacaggaaagacccacccccatgattcaattacctcctcctaggtccctcccacaacacatgggaattctgggagatacaattcaagttgagatttgggtgagggcacggccaaaccatgtcagaaagggatgaagtgacagcatatcctgatgtgtgtgatggttttatgagttattacctatttcaaaaattattgcaatgtgtaaaaaagaacaaggacttgtactatctgactttaaggcttactataagctattacagacaaggcatcaggagtgacaaatagataaacagactgagttaagagacttgaaactgatccacagctatacggtcaataaatgggttttcaataaaagcagttcaataaaagaaaataaatcatttcaattaatggacttttatatggatgtggggagaccaacaatgttattctccctcacactacacacaaaagtaatttcagccgcattacacaccaaaacttaaaagttaaagatataaagcatttcaaggatagtttgtgacttgttggtaggcaaagatcaccctaccaacaagcaggacacaaaaaatacatatataagaaagacatgataaatgagacttcatcaacattagccacaccttctcatcaaaagataccactaagaaagtgaaaaggcaagcaagtcacagacagagagaaaatagccacaaaacgtgtctgacctccacaccctgcagttataattatagtggtctggtacactgcgcccagtttctgctggatggagtattttctgggtgtctctaatgagtaagagagggccccatgggatattccttcagttcccaggtgaacagtgggaaagactccacattgaccaacctcgggggcctaaaaatccaggtcctataggagggtagagtatacctggaccctgacccagacccctggatgggttgtgccaagagacccagcaagggaaaggatttcctcctgcctcaggttctctgtccttctgtggttagacgacctgaacccaactccctccccaagcactggagatggggcttttccaagggctggggatcttgctgtcctgagaacagctgagcaagggggtcgaggaggagcttgggtggtggaggagaggaaaccgggtaagatgcatgaagccgttggctataccaggcacagagaggacccactgggacccaatggcctgcatgtgaagccaggccttgggccacctcgttcctcaaaggggtgctgacttccatggggtgttcaaagggactgtggaaagagaggccttcagcccacacctctgaatgcttttcgaccacagcatgccctgtggcctttatcctgctggtgtggaacagtcagagccctgcagggctgcagagcttctgtactgggcggcatcccagcctgagtgtcagagctcagagagcaggcaccggagcaagtagagaggagggcaccttttggacagaatgtgtgggacaagagcgacggctcatccattcaggttcctcagaaaatgagagtcaggaagatgagggcgcagacctgattccctacacagggctgaaagcagacaaccggaggaagagcagcacctgggccaacgaggtagaagacagaagaccacagtctactcctgccctcaatctcaccccttcccacccacatcctccacgccccctgatcaccttcctcagaagtgtaataggaatccagattccccctggcctggttgctgcgggaggcacagtggcctgatggagcctgaggcaggtgtgggaagatgtggattgtctaactggaggttgggagttcagggtgaggaaggagaagcttggagtgcaggatttggtggtatgtatgtggctgtaggcaaaagaaagagacaactaagccacttgaaataccatgagaattcaaatttagaaaattcccagggaagtatgcatgcaggcactcatgagatccaaaaaacagctgctgcttaactgcgtgttgcaagcaagccctaaattgctgattttgaaacagcctgatgggttcacaaagacaatttctgaatagtcttaagagcagaggtgcactaaagccactgtgccccgcagctcaggatcccagaaagttctttaaggagtaagtcttacttccatttatggaagatttttggagttgtccttagtcacccccaaaaatgttttggttaggagtagaattttagatgtcatcaatttaaaaattaaaactgaaacgctggaactcatagagagataaaattaagagaatccattcacatcctgagtagaaagatttttatagaacatgacgggctttaaaaataaagaaaaaatatggcaaaatttcatcaaattaaatgctttcagaactaagattaaaatctgaagccacccaactagctggacagatggcttctttgccaaggagaccccagagaagtcttaaatactgagttcctggccagtacttggaagctcagacacctctccttatactctctccctttgtggtttagacacaactgaccagcattattgttaaaatagagatcctaagactgacagaacagagtccttacagtagtaagataccatattataaacaagacctaaggccatgccaggcaaggttaagtcatgcacccctcaacttaaagaataaactatgttctaattgccacaggtttttttcttcttcctttttttcctctagctaaacaagcactggccttgagataagcaatgctgaagcacttgcagctcacccattagcataaactgactgagccctccctacacaagccataactacagctttgattggacaagagactgatttcagtaacttccccttgataagagagcactggctgtggacgggttctggacggtttacagaggctgtgcacttgactgcctttgtgtccctacttccccttttgaagcatagggcctaattataatgtatttaaatgtcatctccaccccaaagtgaacatgggttgcatgtaacaggcttgtttactcagcatgcatgcagcaggatcccttcatgaatattcagagctcctcctattccctgttgaatatgcatatgtggcccaccacatcaacataaatccctgttcccccctcccctccctggaaacctacttttcggtttcagcaggagggtatgcctcccagtctgtgggaatggccaccttgcaggctgtaaccatttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaagatcacaagcattcttatacaccaataacagacaaacagagagccaaatcatgagggaactcccattcacaattgcttcaaagagaataaaatacctaggaatccaacttacaagggatgtgaaggacctcttcaaggagaactacaaaacactgctcaacaaaataaaagaggatacaaacaaatggaagaacattccatgctcatgggtaggaagaatcaatatcgtgaaaatggtcatactgcccaaggtaatttgtagattccatgccatccccatcaagctaccaatgactttcttcacagaattggaaaaaactactttaaagttcatatggaaccaaaagagagcccgcatcaccaagtcaatcctaagccaaaagaacaaagctggaggcatcacgctacctgacttcaaatgatactacaagtctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccctatttaataaatggtgctgggaaaactagctagccatatgttgaaagctgaaactggatcccttcattacaccttatacaaaaattaattcaagatggattaaagacttaaatgtcagacctaaaaccataaaaagcctagaagaaaacctaggcaataccattcaggacataggcatgggcaaggacttcatgtctaaaacagcaaaagcaatggcaacaaaagccaaaattgacaaatgggatctaattaaacttaagagcttctgtgcagcaaaagaaactatcatcacagtgaacaggcaacctacagaatgggagaaaatttttgcaatctactcatctgtagattcatcagaatctacaaagaacacaaacaaatttgcaagaaaacaacaaagaaccccatcaacaagtgggcgaaggatatgaacagacacttctcagaagacatttatgcagccaaaagacacatgaaaaaatcctcatcatcagcggccatcagggaaatgcaaatcaaaaccacaatgagataccatctcacaccagttagaatggcgatcatcaaaaagtcaggaagcaacaggtgctggagaggatgtggagaaataggaacacttttacactgttggtgggactgtaaactagttcaaccgttgtggaagtcagtatggtgattcctcagggatctagaactagaaataccatttgacgcagccatcccattactgggtatataaatcatgctgctaaaagccaaatgattataaataaattatatatttatttgatttatatgattataaataaatgattattataaatgattataaatgccaaaggattataaatcatgctgctataaagacacatgcacacgtatgtttattgcggcactattcacaatagcatagacttggaaccaacccaaatgtccaacaatgatagactagatgaagaaaatgtggcacatatacaccatggaatactatgcagccataaaaattgatgagttcatgtcctttgtagggacacggatgaagctggaaaccatcgttctcagcaaactatcgcaaggacgaaaaaccaagaactgcatgttctcactcataggtgggaattgaacaatgagaacacttggacacaggaaggggaacatcacacaccagggcctgttgtggggtggggggagggggagggatagcattaggagatatacctaatgtaaatgacgagttaatgggtgcagcacaccaacatggcacatgtatacatatgtaacaaacctgcatgttgtgcacatgtaccctaaaacttaaagtataataaaaaaagtcaaaaaaaagactcaattcttgaatatacaagagaacttttgtaaatcagtaatatagagctaagccaaataaaatagggcaaaatatttgaatagtcctttgcaaaggagagtttcttatatgctggaagccacaagaaagtatgcttcataggattgctcattaggcaaatacaaattaattccacactgagatagcactaactactcaccagtgtatggctacttttttttttttttttctgagacagggtctcattctgtcacccaagctggagtgcaatggtgcgatcttgactcaccgcaacatccccctctggagtagctgggactacaggtgcatgccaccatgcccggctaatttttgtattttgagtagagacagggtttcgccatgttggccagattggtctgagagcatagctacatttaacaaagttagtacaccaaatgctgacaagaatttggtgccacttcaactgtcatcgctggtgaaaaacattctagaagactggcaatttatactgatgttaaacttatactcaggtcatgacccagcaattgaaggacttccatgaatctcaagtgcacacaaagactgttataagaatattcagcacaagaattcaataaccccaaaattgagaagtgatctatgaaactacatggatatatctcatgagtataatgaatgtaactgcagaaaaaaggccagacacaaaacatatgtacattcattcatgtgaactttaagaacaggcaattgtaacctgtgggaatagacatcagaatagtgataactaagaggacacagggtgggaatcacctggacaggggctctaacaggcctttctcagatgatggcaattttctataacttgagctgggtggtgataacattgatcaaaactaaacaaattgcactaaagatttgtgcactttatgtgaactgtagcttctttactgttctcattgcttgaacctgggagacacaggttgcagtgagccgagattgagccacggcactccagcctgggtgacagaacaagactacgtctcaaaaacaataataatagtaataatttactgttctcataaaaattagcagatggggaatggaggcaagcctgtgcagaccatgacaactagtttagattttattgtcagctcattaaaaactcgtcctcgttttgtgtttttaaaaaattccactgatacagccgttttctctaccagaaaagactataaccgcattatttcatcagtggaagctacagacaaagggcccttgagaggcggcatcttcacctacgggaatttttcctgctcaattgtgagacaaagagcatgtccaagttttcctatcggccaggccgccccctagtttctgcgctgtgggctaaactccagaagctggcgcccttcagggccagaggtttactctgctctctggaggctgctaggattaaaggcaaagcaaacgacaggtctattagccacagttgcaggttagaaaacactactgtgactcagattagaacccaggttgtggcaaccacaactacaagtattaactactacacgaccacaaagcctgctgacaagcattgcacttctatgttttgaatgtaaaaacactcacactattttatctgctttattgttggacgtccgcagattttcgtgcttttctgtctttcgtgcgcttctccctttctctccccattctgctacataattaaaaaaaaaatctcatctctcaggatccgaccactgcctctacaacaagcctcctgggaggtctctttgtcccattgacatctctgccttctttcgctgctttttttttttctttcttttttgacggagtctcgctctgtcgcccaggctggactgcagtagcgcgatcttggctcactgcaacctccgcctcctgagttcaagcgattctcctgcctcagcctcccaagtagccggaatagcaggtgcatgccaccacatttggctaatttttgtatttttagtagagacgggattttcccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatctctcggggaacaccgatgggcccacaaaacacgcggaggccgcggtcgctgacgatgtgagcaaattcggttcacggtgtctggggtacagccctgagggtctactggccgcctctgcgcaaggaccagtctccgccgctcccctcatctccacgcagattcttgcccacacaccacccctttctttgggccgctgacgcctcttggacctctgaggtgactgtcctgcccgcagcttctctccttccaagagcgtcatttcttgatcctctccatagtggctcaacggtaagcccaaggtccagcacgcgaatcaggaacctgatggttcttcgggtttgcagggatccttccagtgaatagatgaaagtcacaggtaccagtatgaaaactgcagtgactcaccggaaacacttcatgcttgtcagcttgctaagctgtttgagtccaacaactgcatggggtcctgagttagtctcctgaatgtctcctgccgctactttcgtgagtgttgtcgtcactttaccttgtggtggccaagcccctaaatgcactattaggttatgcagtatgattttcagcgtaaaagacagataaagagcaacagcggggtgaaaaagaccctcttgcattggccgggaattgaacccgggtctcccgcgtgggaggcgagaattctaccactgaaccaccaatgcctctgcgtaacaaccgcctgcaggataacagaaaacagtatccacaaagacttagaaaccgttccaagcggttttttcaagtgtcgactaaaagctaacaaagacatccaaaccaaatgtgtttttacaggaaacttttactagacaacgttataaatatcaaaatagctcatttgtcggatcaaactcttaactctgaaaaaggtctttctttctacctgcattacaaacccctataataaaacatcagaaattcattcacgtttcttttttctaatcctaaatcttccatcgtcaacctcaaactgctgccttagaggttctaagaaggtaacctaactggtagtttaggtaagtaaagttcaaatccagggaggaaatcagtagcagaagcagaattagaagaaagaggaaataaaaggacagaaccaaggtagagataatgaagaaacaaaggttggtccactaagttagtcttttgtcgctggtttttttggcaaaagagtaatgatcagtctcgtaatcattataatactattatttgtctgcttgaagatgtataaagcatttgaaggaaatgtgatatgaaaagatgaagaacgctcgctgtcaatgtttccttgtttgggagaatcccatttcctaagttaatatgctttgatgtattagctatgtaagcagtagactagtttaaggaaatattgacggtcaaatattagcatattagtcttttgatgaagttcaaatagtagagagatttctttcctcaattttctctggaaacattcaactgaagagacaaatccagagttttctccatatgttgggtctgggagtcattatgactttttcaaagacaggagctgtgacatggaatcatgcttcttctctagctgagaagccaagctaggtccaggctgcgtcataaacttgagcccaccaaggaaatcacccttcacattgacctcgcagagttttggctgttctctgttctttgcccaacacccaagacacacaccagctctggccaacaaaccttaacatatgatctatatccaccagagctatatttattcccaaatctccttctaaaatacaaacctgtactttctactctcaacttctaaatttacaaaggcctcatatgcatctcagagtcacagatgctaaaacttaaccggttttctgaggattatttggggaaggggtatgcatgcaaatgtatatacataattcatgtgatttaggaatattgactctatgacttccagatgcagatttagaacctttttaaaaaatattttgtttttgttgtcttgcaaatcagccagatctgcaacttaccagagtaaagcgaagccaagcgggacccttaggaaatgcactaagatgtcatccactttcagtgtcagcctgtgaaaatacaggcgatagaagagaatgaagagaacctgaaggaatttctggaaccaaagctaatattaagcaggcctcttgctggcagaccagtggaaactgtagcctggtcaacgatctctctagattgaggaggtctaaagtgtagccacaggttcaactacttttctgtttgtttcccaacctcgattaaactcactaaatttagggacaaaaaaacaaaacaaaacaaaacacgatgttcccacgcagtctcgaaccagagacctttcatatgtgaagcgaacataataaccactacaccacagaaactgcatatgcaccaaaaaaggcaaaatatcatcatgaaaatcttaggtcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcgtccgagccctgggcgccccgtgcctctcaggagtgtggacgccgcccttccagggatgcggaccccgcctcggggccttttccccggcgccggccgtcggggctcttggctcttctcgtcctcccaggaaccgtaggactctccttgccctccctcccgtaggccgaggggcgcgagctgcgcctgtttcctcacggaccctttggcctcagcgcctcgacgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacctactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacgtaagccataggaggtatttaagagtaaattctaccctgataaagtattgcactgaaaaatttagtatgggccgagcatggtgactcacgcctgtaatcccagcactttgggaggctgaggcaggcagatcacaaggtcaggagtttgagaccagcctggccaatatggtgaaacccctcctctactaaaaacacacaaaaaaactagctgggcatggtggcacatgcctgtaatcccagctacttgggaggctgaggcaggagaattgcttgaacctgggagggagaggttgcagtgagccgagatggcaccactgcactccagcctgggtgacagagtgagactctgtatcaaaacaaaacaaaacaaaaaatttaccatgccactgttcttcaactgttctatatatgttaattatatgtccctagataaatcgtaaggtctgtgagaatgaagatagttctgcgtttcacatcccttacagcaccagcatcacagagattcacagcagatactcaatgaataattagactcatctcatcctaagtctagataggacctttcatgtcttctgttttaaccaccacctgatgtctgaatttcttctgtgttgtgatactgtggctgactgtattttgcaatcatggccatcacataaactctcatgccatcaactgatgagacccaaaacaagagaccctaagtgagagccacccagctgagcccagtcaaaccacagaaccgtgaagcataataaagtactgtttgaagtcactaagttttagagtggttcttacttagcagtagataaccaggacacataccaagatgaatgtctgtgttttcaacacaaagtgtcaataacactgataactatggcaaatagcattgagagcttaatgtatgctgggcaccattctaagcacttgtactaattttttttttttttttttttgagacagagtcttgctctgtcacccaggctggggtgcagtggtaccatctcggctcactgcatcctccacttcccaggttcaagcgattctcctgcctcagcctcctgagtagctgggattacaggggtgcaccaccatgcccacctaatttttatatttttagtagagacagggtttcaccatgttgggtagcctggtcttgaactcctgacctcaggtgttctgcccacctcagcctcccaaagtgttgggattacaggcatgagccaccacacctggccagcacttgtattaattcatgtaaacctaatatccaccctttgagatgggttctgttatcatcctcacttaataggtaatgacaaaggctcagaaaggttaagaaggttgcatgggtagtaagcatcagagctaggcagtctgattccagtattaccactatactatactatactatactatactatactatactatactatactataccataccatatgtactattactttactgatatatccctaagaggaaatccctgagatctggtatctcccagatactgggacatcatcctatgccctcctgcttgcctacctgtcttttccacagacctatatctaccatttaaatcagtgtccttgtgaatacccagacatgttgtttcttccaactgcctgagctaccctacaccaagcacaaacttacacattttcaatccagaaagtgcccagacagtgccatccttacccaggccacgaggctgatctcagctcctcagccagcttcccttctagtcaattttttgggagctgggcctccagctgggatactctctggatgagactcttcaggtcctttttggcctgaagtcctggagagtagaaagccccagtgccatcagacagccacacctcatcctcatcagtgacactatgaggtgaagacccctccagggtgtcaagagctctcagcttccagggtctttccagactagatgaataatcacttgtaactgagagggactggacccggctcttgaagttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttacaactgtgtgaaaaataggcaaaggaaaataagactttgaataaatatatcagcatgttaacatcagtgtattggggcagtggtagtcagaatgagaactaatccacagcattttacccgatgccagacactgttctaaagcattttataagaatttactcatttaattgacattagtacctgatggggtaggtagttcctttattactattttaacatttgaagaaactgaggcataggaaagtttacaaattgggatttgaagcaacaagtctggccccaggatcttttctcttaactgccacactacacttcctcaagaatgagagagactgtgtttttcttctcttctcgttttgaatgtggtgggtggccctatagttgtagtccttttataatgcaaaccaaaattatttttaacttatggtttgcatgtttccaaaacctcatgtggtctctaagtaggccttagtatttctataataatcagttggatagaacttcatatgattattattattattagcagtatgccacaaactcattgtagaaattcaaacttatactcagcctcattttgggtaagagttctcctattaacctcctgtcctcctcttccccactacttgtcaggtgtggaattggccaacagcacccaaatgtgacagctgactccagggagggaaggtgagccccacaccctgtgctcttaccgggactggtggattcctcctgttcagcctcattcttgctttgaccacaagtctcatagcccaggtcctggaggtccacctggacctgcttgctgtcctgcttcagcaagggttcacctgcgtgggaagagacagcaggtgttacagaatgtctgaatttcccacatatgccctgagcctcaatggcacataccctaaccttgtggggcagggagggcagatccacagtgcaagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccactgaagctggcaagtgctttatcagcaggggttcaataaatgttgaatgtaaaacatggctgattactttttattttcaatccaacaaatctccatttctggtgagaaaatcttgccaaaaccaaccaagcaaatgcataaaagtatatcaaaaagaaaatgaaagcttccctgcctcccaatcccacttgcttggtttcagctattatttattacatggaggaagggggctaggcacccaggaagtcccaagtcctgttctgacaatcatctggcctccctgggcaaagggaaaagagggaaggcaaaaagaatataacattactgtttgcagaaatttccccttggtacaggaaactctggtaaactgagagagtatgttttccatgagggaggcctcaagggctcttctctggccctaagcccaaactggattttgcctcattttctaagatgcaaaggaaatggtaaaagttgatcaaaggagagggcagagaaagaaagaggacgactcctccatctcaggtccaccttcctcggtgttgcttgagggatcagaggaaatgcatgaacagaggtgcgtgggaactacggctgctctgtgaactcagtgccctccagttacgagctattgtgaggttccatgatgtaatggcgagcgctttggactctgagtacggtgatcagcgttcaagtctcagtgggacctttctgtataatgccaatgatattcctattgctccctaagcggaatgggggaaattgccccagtcatggtcacccaccgtccaggccactggctgtgtgcaattggagtcctagacccagcgacccagcaagacccctcccctctcagggtgaccctgggcctccaggtgacaggtctcctccactgaaaaggctgcgtcccctcaatcctagaccctgagttttcttttatacatgtcattgggccattgccctgtgtctctttggaagaaatgacctatatgaaaaactttacttccgggattccctaattccttcatcccttaggacggcgcagtttttcagctcctggtcttggctccagttctaatgcacacgtttcattttattgtcatgggatcccctccaacaggctaccactggattcctgtccttggggtctctgtggatggcaaccagatgctgctcttgtcccagatcctgacacctctctccagggaattgcctcccttagcctcctaaatcagccaatatttagatttgggcctgggatcgcagcaactgtggagaacagaggttcccgatccctggccagcctcccgcagtgaaggggagaggagcacagcagctgggaggggcaagtctggggccctgggcaacccccttcttcctgcccagactctgctccaaggagcagttgccttaggaccagatcagatggaaactcttttgttctcttctcatcagcagaaaaatttaggcaagagctctggaggacgttcctagctcctaaaaatggtgtggccaaatctctccagttttggaaatgcccaaggttaccaagtattttgagggctcactttggagcctctgaaaaggaggggtgagggcccatggaaggtacctgagggatgcaggggagagaggggaaagagcagacaggagggaggagagaaggaaggaaggggagaaagggcgtgtgagggccaggagccaggattcaccctgacagttcagtgactgctcccttccaacaagcttcccactgtggcaccttctagcaggtggtttccatctcttattgatgtcctaagaccttggctctatggaacggttctgttctatttgtctggcatgagtcctggcaaagtttctttttcaccatttgggggatgagatgggggtatataggtttgcaagtgactaggagctaagtcaggaacttgtggagccactcagagtcaactgtcaagtagcctccttctcccattcccctgcaggacgattgcctgcaagacagggcctggagaaggccagggcacccaaggccacagaaatgcccagggatgagtcccggctggagatgccttggctgaactcactgtgtacttccagggtgcacagggcaggtactctgggggtctggccgggagactgagcaaggggaccagggaggttatgcagaagacttctgcacagcaaggcagacattcttcttggagcccccaacccaaatcaggtcttccacctcctcttcctaaagaccctttactgcagtcattcttttactagaactgcaagtttatagaacatagatttcagtgtgctcatctggccaaccatcttcagtggccaatgcccaaggtaacctccctccctaccaagacctgaactcagagccttacctaaggagaagatgtcctgttctttctttcccaccagaactgccctggcccagaccccatttctgtctggtgaccaggacagtcccctcaccagtctcccaggttggggagggcagattctcctcagctccctgcccctgagagaccccaacagccttgcgtggctccagcccacagagggctatccatggcccatatctctcaaaactctcccctcccactctgaatccaccctctactgcatgctcccctcacagaacagacatgggtttttttttgtgtcctcgttttgcctacccataccccagattgacttttctgtctcagaactacctgtccctctttggacagtgtcttcttggtactacacatgaagatgtcctgctctcccctgctcaaggagagagtgcctgacctgagctgggcccatcagatccagtacttacccggaataggaaaaagatggagagggtgaccaaagattacaaaaatctctgaagcttatccacttgagagagagtccctgaagatactggcctttcatttcctgctatgtatatccagtgtgactgaactctgaataacatatacaagttataataatgtagtagttggccctcaaactaggacacaaacatgttagagggtaaggtagtgagaggcatgtttgggggtggtggtgatgagcaagtatgtgaaggagagatagtgcctacgcttgaaaatcaaaaaggaataatatctatttagacataaggagataaataactaaatacttgcttctatgtgatgaaactctgggagtacacaaggggactgctgttttactaaacaaattttccagtctatataactttgataaggtatccaaataaaaaaattcctttcccatatatgtatgtgtatatatatgtatttgtatacacatatatgtttgcatttttgtattttgaatataaatttttatagagtcctgtgaacccctcttttcaattaggatttgagtttgatgtcatgcatgcaatgtgatcccactgtgtgactacagaaatgttggcaaaagtaagttcagaggaaatggtaggcaagtacttcccagttttggccagaagatggagaaaaaaagaattctcataaaatattaaaagtatgacttgttacagcttcttttcatagtaatttggatagaaattagcaaaatcagaaatgtataaatactttggtctgacaattccatctccaggtatctacggagaaatagacaagtgatgcacgacagatacatgtgtcagtctggtctctgcagttgtatttgtaataatacacattggaacaatgtcatggccatcggttagagaatgtttgaagaatgacccattcatatcaggaaggacgtttcaaagatcaaagcctgatggaaatgctggaggccgtgacgctgataggagctcatgcgtgttgaccaattgctacgtgacaggcattggctccacgcttttcctgcactgctcgtttaaacattggacaaattaagtgttctgatttagcccattagacagatagaaatggaagcacagaaaattaatgggtttatctttaaacgcgagcagattaggtttttcacccagggcctgtggcttcaccataggtgtgattcaggttctgttgttctccactttaggaattcccagtattccaaatatgagaagctgagaaaacaaacaaactcaaaactctaaaaaccgggataagtaagggtagatgtttgctgggtgtggattaataatgaactttttttgcctcaagcaacaaagaggcaccttggaaaatagacaagagacaagaagaggagaagcttgaagatatatttggtccaaggaagagactcttcagagggaagatcacatcagctagaaacattaatgcgactggatgggctcaaaccaccgacttttcagtcaacttccgacagcactaacctagtgttccagagaccctgcttgttaaacagtgaaagctgttgctcaattgtgtcatccataattgtcaaatattgtcatttagtagcacaaggaagtattctctgttgccaagctagagtacccataactcttctgttttgttgaacattcttccccaccacaaaccctctttagaagactggtggctcctaaaacattgaggccaacagacctgtccttgtgcatgtttgggcattgatccagggccaaatcagtgggagactcctccacgcacatgccaggtccccaggtgacaactgcagtctctggatctgaggtcatccactttcccattcctagctcacctcacccatcatgaagcctggttagtattgccagagacccgagtgggcaggtgcccgcactaaagacagaacctgctgtgtgcccactttgctgatccctccatctttctagacaaggctttgtgagccaaggactttgggtttgctcacaaggcagcccctcacctagtaggcattagttcattatgtatagtatacgtatatgtgtatgtatatgtatatgtatatgtatatgtatatgtatatgtatatgtgtatgtgtatgtgtatgtgtatgtgtatgtgtatgtgtatgtatgtgtatgtgtatgtgtatatgtatatgtatatgtagtcctcaggttgtattccttaaatatatataatatatgtaattccttaaatatataattttaatacaaaatttttaaaagattcctttcataaacatttacaataacaccaagaaatataaactacatagcaaagatgtgaaagccagccaggcgcagcttcaaatcctagcgcttaggaaggccgtggcaggagggtcgcttgagctcagaagcttgaaactagcttaggcaacatagtgagacctcatctctactgaaaatcagaaaaattatccggctgtggtggtgtgagcctgtagtcccaggtactcagtggatgaggccctaggatgtcatcggcctgagaattccatgctgcagtgagctgtgtgatcttgccactgtactccagcctgagtgaaagagtgagatcgtgtctagaaacaaaagaagaaaaaaaaaaaggtgtgaaagcctatatattgaagattaccatgtattactgagagcagttaaagacctttggaatagagaacgttccttcttgcatttcaagattgcttttgttttggggggacacttgctgttttttaggaacatgaagttcttctcaggcattcctgtaaaaaaagccactttttgataggattgtattgagtctgtggattgctttgagttgtatttttatcttaaccatgttacaacttccaacccatggacacaagatgtctttccattgatttaggtcttccttagtctcctcgagcaatgttctgtagttgtctgtgtacaagtactgcaccttcttgaacaaatttattcccaggcatattatccttacaggtgctattataaatgaaatcattgtgtcagtttacttctcagatagctcattgccatcacaatggattgtttgctgaaagtttgctgaattcacttattaactctgatagtgtgtgtgtgtgtgtgtgtgtgtgtgtgtgtgtgtctggtgtctgtgtgcatgtatgtgtgtttgcctttgtatgtattgtttgggattttctatgcataggatcacaccatctgcaaattgagatcattttgttttctgttcaaaaatattttttctcatgtttatttttgaaagataatttggccaggtgtagacttgtaggtgacagtttttctttttttaagtactttattgcaaacttcttgtttgtaaaatttcctatgagaaatcttatgccatccttatatttagtgctctgtatgtaacatgttcttttcccttttattacttttaggatttcctttttatcactggttttgatggatttgattaaggtgttccttggtgaagttttctgcatgtttcttgttcttgggataatcatatttctgtaatatttgaagtttatgatttctatggagcttctaaatctttcatccagtatgttttaaatatctttttctctcttctccactacctgcccttcagggattccatttagccctatactggggggtttaaagttttgatgctgatggtctttatatgttttcaagtcatttgttaatgtgtgtttcatttatgttagtttcaacttctattccttctagtttaataatcttctcttctgcaatatttaatccagtgccttcttccatttcacactgtaaatcatagtttttatctacagaatttgatatttaaaaaatcttcaacctctccatttaattaaaatacaattatactaattgcggtaacgtccttttcttctatttccaacgtgtgtgtcaatttcaaccagattattagattcttcagtatgtgtcatgttttcctgcttctttgactgcttgatattcttttatttttatttatttgtttttggggggatggagtttcactctcgttgcccagtctggagtgcaattgtgtgatctcagctcactgcaacctctgcctcccaggtactcaagcgattctcctgtctccgcctcccaagtagctcagattacaggcatgcaccatcatgcccagctaaactttttgtgtttagtagagacagggcttcaccatgctagtcaggctggtcgtgaactcctgacctcaggtgatccacccggctgcttgatattctaagatttgatgctggagctttggtgtcaatgctcaaaagtgcccaaagacaccactcaacctcagtgtctatgcacacccaagcttttgcaacaggagaggtagagacagcagagatgaatgtgctacaacatgctggtagaaggtaccccaattgtgcttggggcttcctatgcctcatagaataatgtgccttccttaatttttcccataagaaccaccctacttcatgccctgtctctctgtccaaacaccaggacagccctcagaccagtctcaaccacccaatggattgacaaaggtccaaatatgattcagtggagaaggcattctcttgtcaacaaattgtgtagaaacaactggacatgcatatccccaaaggaaaaagattcacctgaacctcaatactgactcaaaaactaactcaaaatggattatgcaactaaatataaactataaaagtagaaaaagtatagcaggaaatataagacaaaatcttcacgacgcagttaggcaaagtgttctttgttatcaagaaacacaaaccattaaagaaaacattgataaattcaactttataaaaagtaaaagtttttgctcaacacgagacagtattaagagaacaaatataagctgcagattgggagaaaaacaggggaaatgacaaatgtgacaaaggacaagtgtgatagttacttgcacgtgtcactgtgactgagcaccagggtgccgggacattcggccaaatgtgattctggttgtgttccagagagtgtttcacatatgattaacatcgggatgggcagactaagtgaagcagattgccccccttaacgggggtgggactcatgcaatcaatcaaaggtcaggagagaattaagaggcctaatgggaaacaaatgctttcctgggtatccagctttccttccatcttgggaatttcagcctccataatctcagaaacaaattcacatatgtatacacacacatatacatttcataggtatgtggctaagattgtatttttaaaagttcagccatgagatgattggtgaagccagccaatgaataagggtgtgttctattatatgactcagtcttcttttgtacacgattgaagttctgcatttgaagtaggaggacaggagagagcaagtccacctaggatgataacagctgaatttctcaacagacacttcaaagccctaggcgttaacttagagagtcaaaaatcccacccataaccctgcccctaaacgccagggctagggaacactgtggccctcaggtgattttgtttcacttggtctgggagccacacaagggcagagggagcaggaaacactaagcaaatcgaggccaggacagcagggagggcctgttcatgacagaacacaggtaaaactatcctcagaaagagcatgtggagaaacacagatcatgcctgagacctggtggattagagcactggctactggggaattgaaaggaaggggcttcaccatgcagaggaccagaggtgccagtcttggaaacgcagaattgctgggagatggggaggcatggacaaaggaagcatcctctggagactcatggtgaagagaacaaatgaagtaactggcagaaattataggtcctggtagaacaaaatagaatcccacaatgagaacatacagcatgtatgtcccgcaaggaagacaatagctcctaaaaatgcaagaaaaatcattttgggcaaacaccttatatccagtaatgcgatccatgtatcaagaccacgaggaagattattaaacatgctaaactcagcgagacctgattccctcatgaggactctgttaaggatgagtaccactcagcaagtgatgactgtgacattcacttttgaacagctcatgagcattaatatatttaattgtggatctaaaccaaaaaccaaggtgtgggcaagatgacaaccacagaatgtcactggcatatgtttaggttcaaataccattatgagaagtggcaggtaaaggaggtaggaaaaagaaaacacatcatgtaactgactgtcatatggaaatatttgacgttgaaagtcataatttaaaatgtataaaccaaatattagaagtgtgtctagttcaaaggggggaaaactatgaaacatttttaatcaatatcaaacatgagctacacaacccttcctaaatgccagaggcacacacagacacacacacacacactctcacaaagaatataaatatctagaaccaagaaatggagtaaatgcattctgctacatatggtaaacatagcctacaaggtggaagagattagaaaataaacagggaaatggaaatgtttttattaattcacatcagtacccaccaaaaccaatcagcataacaaaagattataacactgaatgtaaaaaacaatccaacagtccagagtgataggcaaaagcttttaattgtatagattaaaataactttggacaaaaattaaaactcaggcagagaatgttttttttttcaacaacacacactagcaaaaacaaaggcacagtaaacattgaggcagaaagtttccagcgtagagatatgaatataataatagacacaggcagggatgattaataaatgataaaatgtttacaggatgatcattggaatacaggacatttctaattttgaaaaccaccctcccaaatacttcattataagtaaggtgtctctaaaagggacagatctcctagacccctccttaaccaagtaaccagtcctgatatcatgataatgctgatggacaaactagaccttctctgcccgcagatgggctaaggttggaaactcacagcattgtctctgcagtgttcccggcaaaacgtttaggctgaatttaatcatgaagacattttcagacaacttcagaatgtagatcattgagccagagagctgacctgtcctctataaacaagtccatgtcaccaccatcaatgacaacaacaaaaagatgaggaaatatttggggttcaaaataactaaagaaatgcagctatattatctttttactttttttgaacccaaaatatctcttctcctttttgttgtgtgatttgtggtgatatggactatgtgaaggagacaggtcagttgtcctgctcagtgttctacattctgcagttgtctggtaattacctcctatgaaactcaggctaagcgttttctgcaagaacatggcgttgttcatattctgcaccggcagagtcctgggtgacatgctgtctcctgccagcggctcctgactcctgttctctacaggatggaatcgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttaaagatggatcagctaaaacaattcaacactgaagatacaaagaatgaggttaggttcattgaaaccagggtaacacctttggatgagctaaacacaaagatgacactgaccttgagcaggtatagaagctcagagacatgactgcaaaatgaaatccctgaggaactttgtagctacccagagataagtggttcaaattaaaatgtctgactgatcactcccggcatgtgctgcacagttatgtgaacgtgtcacacctaacttgggtccattgtcttcagactgagcacagggtgccactggcatggtctgagaataggaatagagccatgcccactgacccatcctatgtctgggcttccaaatggaactatagtttcattcaaatcttcacgtgcctataggtcctgcctgcaggaatgacatctctcggcttagtaagggctgcttactgtgggaatatgactcccatctggaagaccaggtggagacttgttcccatcaaagtaagaaacctattgtccacgtcaagggcgaagctgatgtgctgttcctcaaatgagtaaaacacacttctgtagtgctggaatgagtcaggtagttcaaagtacattgacggagtcgaataacatctatccagtgagtcctgcaagacttcaggctcttccacttccatcagcatgccgctgagcctggaaaagcagacaaaactaaagaagcagccagggaaaatcagacaccacagagccccactagatttcagaagtaacgtaaggaagtggtaagaaaagaaaaggatagatccattagatccattaatgaggtaaaaaaaaaaaattattgcctttatgttgggatagaaaagggccaggtagaaaacaatgaaagagaaagacagagagacagagacagagacagagacagagagaaagtgagctagtgaattggccaggtgacatactggtaagggagtaaaaggacactctgagttagtgccctcatgacacacagcacactgcgatcatgaaaagagtgagctcaatagttttccataaaatatgctcaaaattcgatgcagtggccatgagagtacagcttttgaagtatggtcatcctatggtacgttagtaaatgataaggggaggaagaaatggaaacctaaacatctactgcaatgaaaaccaacagcaatgacagtaggagtaattcagccttcgttgaaaacatgaaatcaaacacactctggtttccctcaatctgttgcctccaggtgttaacacagaattaagcatccacaattgctgaaagttacctggggcatggtgggttttgatcttcttccccttcttttcttccccttctccttcttttcttcgttgatcttcttccccttcttttcttccccttccccttcttttcaatttctgcaataaattcagacatggacagacacattaagctgattcccctacacacataacaatccactgtctaaccctcacacagggacctcaggctcctcagcataagaataggagactgtgagagatatatttcaggaggcctgaaggctggtcatgatagaaattcctcggtttttctcccagaaactgtgggtaaaatgtccctattctagtagatcgttatcccaatatcatttgtcccgagtttgtgcaaacagttatgccatatttttccaatcaatttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagagtagaatcagagtgccacaggcatggcctgagactaggaagagagccatgctcactgacccatcccatgtctgggcttccagttagaactagagtttcattcaacctacatgtgcctataggtcctcactgcagcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggcaggcaggagtcaggctgttcaagacaactggaaggagttgaataacatctatccagtgagtcctgcaagacttcaggctctactgcctccagcagctccctgctgagcctggaaaagtaggaaaaagtaaagaataagccagggggaatcagaaaccacacagccccagctacatttcatggctaacataaggaactgtttaaacagaaaaaggacagatccattaatgaggtaatgaattattgcctttatgttgggatagaccagggccaggtagaaaagaatgaaagagaaagacagggagagggagagggagagagagacagaggagaaagtgagctcagcgaattggccgggtgacacactgacgaaggggtcaaaggacactctgagttagtgccctcgggacacacagagaacagtgatcatgaaaagagtgggctcaataattttccataaacttgcttaagattccatgcagttgccatacagcctttgaggtatggtcaacctacagtaagttagtaaatgataaggggaggaagaaatggaaacctaaacatctactgcaaggaaaaccaacagcaatgtcagtaggagtaattcaaccttcgttgaaaacatgaaattgaacatactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacgcagggacttcaggctcctcagcatgagaataggacactgtgagagatcttcttcaggaggcctgaaggctgatcatgatagagattcctgggtttttgtcccagaaactgtgggtaaaattccctattctggtagatcgttatcccaagatcatttgtcccaagtttgtgcaaatggttatgccatatttttccaatcgatttaaagcaaatgcccccaaatggttgctgggagaaaaactgcaatattcagccctgtctcatcaaatactcagattcttcatggtagcgaggattttagatgctgaaattagagtgaaggatgaaatctacaagatctacaaaattgagacaaaatcagagttgtgtgaatttgtcacatctgcccagatccaacatcttgagagtgggattagggtgccacaggcatggcctgagactaggaagagagccctgctcactgacccatcccttgcctgggcttccaagtggaactagagtttcattcaacctacatgtgcctataggtcctccctgtggcaatgacatctctcagctcagtaagggccatttgcagtaggaatatgaccctaaccagaagactcagtggatccttatcaccttcatagaaaggtactcaccatccatgtcaagagcccagccaacacgctgttgctccaatatgtaaaaggcacttctgtagggctggcatgagtcagtcagttcaagataacctgaaggagttgaataacatctatccagtgagtcctgcaagacttcaggccctttctcatccagcagctccctgctgagcctggaacagtgggaaaaagtaaagaataagccagggggaatcagaaaccacacagccccagctagatttcatggctaacataaggaagagtttgaaaagaaaaaggacagatccattaatgaggtaacaaattattgcctttatattgggatagactagggccaggtagaaaaggatgaaagagaaagacacacacacacacacacacacacacacacacacacacacacacacagagtgagctcagtgaattggccaggtgacacactgatgagggagtcaacggtcattctctatttgtgctctcaggacacacagtgaacagtgatcatgaaaagcatggcctcaataattttgcataaaatgtgctcaagtttccctgcagccaccatgagaatacagcttttgaggtatggtcaaccttcactaggttagtaaatgataagggtaggaagaaatggaaacctaaacatttactctaatgagaaccaaaaagcaatgtagtaggcataatttagacttgtctgacaagacaaaatcattattttcagcatgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacaggtacatcagtctggtcagtgtgagaacaggagactttgagagaaatattccagcaggcctgaggtcaagtcttgagaaaactggcttgggttctttcatgagccttgggcaaaattaccctgttttggaatgttatcttccctatgtgctctgtcctaggtttgtgtacacaaatgagcaactttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgacggacagatgagctaaagcaagcgaacttagaagacacagaaaatgggaataaattcagtgaaacctgggccacatctttcactgagaggtagacaagggtgacacttgccttgggcaggtaaagaaccacacagacatgctttgggaacaaaactcataaggaattttgtagctggcaagagacatttaattcagatgagctgatctgacagacaactcctggtcatgtgctgcatagtttggtgtgagcttgccacacctgccttgagttcaatgtcgtgacagtcagtccaggttggcacgggcatggcctgagactaggaagagagcaaagctcactcacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcaccgcctatgtcaacagccatgcagacttgctgttcctctaatgagtgaaatgtgccgctgtaagacttgtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactagccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacacagtgcagacacagatcttgtgtattaagggccccattttcccaatattttgatataatatatttaccttttcaatttcttttcttgcaaaaatactagccaacatactaccaacagataggaagaaagcatatatacatctctccctggatttaaacacatgggagagaataggcaacaccaagaaatccctgtttgagggtctggagtggacttccagcaaactccaacagacctgaagctgagggacctgattgttagaaggaaaactaacacacagaaaggaatagcatcaacatcaacaaaaaagacatccatcccaaaaccccatctgtaggtcgccatcatcaaagaccaagggtagataaaaccacaaaggtggggagaaaccagagcacaaaagctgaaaattccaaaaacctgacatcccttctcctccaaaggatcacagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggccaaccagaatgaacagtgtagagaagaccttaaatgacctgatggagctgaaaaccatggcacgagaactacgtgatgcatgcacaagcttcagtagtcaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgcactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagtgcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatgtatatatatttttcaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttccccttcctgtgtccatgtgttctcattgttcaattcccacctgtgagtaagaacatgcggtatttcgttttttgtccttgcgatagtttgctgagaatgatggtttccagcttcatccatgcccctacaaaggacatgaactcatcattttttatagctgcatagtattccatgttgtatatgtgccacattttcttaatccagtctatcattgctggatatttggcttggttccaagtctttgctattgtgaatagtgccacaataaacatatgtgtgcatgtgtctttacaacagcatgatttataatcctttgggtatacacccagtaatgggatggctgggtcaaatggtatttctagttctagatccctgaggaattgccacactgtcttccacaatcgttgaactagtttacactcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaaccggtaccagccactgcaaaaacatgccaaactgtaaagaccattgacgctaggaagaaactgcatcaactaacgggcgaaataaccagctaacatcataacgacaggctcaaattcacacataacaatattaaccttaaatgtaaatgggctaaatgccccagttaaaaaacacagaatggcaaattggacaaagagtcaagacccatcagtgtgctgtactcaggaaacccatctcacatgcagagacacacataggctcaaaataaagggatggaggaagatctaccaagcaaatggaaagcaaaaaaatgcaggggttgcaatcctagtctctgataaaacagactttaaaccaacaaagatcaaaagagacaaagaaggccactacataatggtaaagggatcaattcaacaagaagagttaactatcctaaatatatatgcaccctatacgggagcacccagattcataaagcaagtcctgagagacctacaaagagatttagactccacacaatcataatgggagactttaacaccccactgtcaatattagacagatcaatgagacagaagctttacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaaccacaacaaactgtcagaccacagtgcaatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagacacaacataccagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagacacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaccaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtccattttctaagagtgttgctgcaatacggacttatatcaccagataacatggacattaaatgtttagaggcatctatacatgaaacacacatgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgcaactgcactctagcctgggtgacagagcaagactccatcgcaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttccgtcctgatttcagggtgactgtgcagctaagcaagctgacttaaaggagatccggatgaaagctgagagcagtgaagcctggggaacaatatttccaaatacaaaggcaaggctgccagcttcctgaaacaggcatagaaactccatggacattgttcagggacagatgacttaatcacagatgacaagagatactgaatcgaagctaggaggcctgacagatactgcctgtgcacctcctgcactcaggtgactatgagattgtcacacttgcctggggtcgagtaacttgatactggggactggcagacaaaggcatgacattagctgagaaggacaaaaaaactccctgatatctgtttagaaacccatcatagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttcggcatctccctgatgagccaggtgggacagagatgacagaagattaaacacagagggattggaccccagggagtcctagctggttttgacaggcggcattaagagagtggtcccagaaagcaaaatggaggttccctttaagggggaacatgcaatcctgttctctctgcaacagagcatggctgccatgggaaccagagaggaagagagcagctggtgttcattgcagtggacagataggagctgaggaggatgaagactcagctatccctgtatggtgcagacatgacactcggcacacatagagaaacatgacagctgccgcaccctgtgtctaagctgggttatatttcacatactgtggccaagcaaatgcgggtttttggcccatcatagatgccagagagggtgtacctcctagatattcttcatatgttaccatccattacttgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggactttggcagctgtcgcccccatcctgccagatctgattcccaggcacaggcttggtgtcctgtcacagtttgcatttcaaacctaattctttctcttagaagcagacaaacttatcccacagtcctctatgcatcagaagatttcaagcctccaagtggcttctgctgtgttattcagggacattctatccatggggagtgctccagtctgaagcacttcctaccacgaaacgccaccacataaagtgccttctccaacatcacacggcgaggggcttcatctcattttggaaagcagttttaagtgttcccacatttgaatgcttcagacccttgcaagagacaatttgccatggagagagagaaactcaggaaagacaagtcattcagtcactgacagttactaagaacattgccgaaaagacaccctgggaaccttcattcttagtccagagctcttttcactctaacaagcctgctcctatcgcagcctccttcctgtcctttaaaactagatagatgctgcctcttactccaaagacaaccttccatcaagggaggagggacaattgcaatactgtgacctccaaccccatgggtttcccaactccgttcttacccaggaagtcctggtcatgtcatggccacataagcttagtggcaaaaaacaccattgatacaactgtcattgtgaaagtatggaggtctggagtctctcataagcctggggttttgggtcatcagggcctatggccaccttacctgggctgagcttttggacaaggtgctgtgccagtctacacccctcagccagctgttcttggaggtcctgcccctgggacttgtctggctcatccggagtgaggagggcctggagatgctgattcaatgagcaggaggcatctctcccttcccgtaacttctcccttaactgggtcagctctcgttcctgagagtgaaccaggactttatattgcctaaggtgagacggtagagaaaatttaagagtggaaagggttgagtgatccgctcaaatattgcaacagagatttctgagacaatgtcctcaaggagacctccaagcagaaggtcagcacatgttggaaggaatgtctgtggctaagagaaagaatagaaaatggtttacaggtttcctctgtatcagagagggctcctgcaagatcctcgatgatgttccattcatctttcccttctgtaaacaaaagtaggtgtcttcctaattccatttcaaaaagacatcctttcagtccctcactctggccatggacatttccatgtgaaaatacacatagtgcatcttgcggccactagatacaaagccatgtacagaaatgaggccaggtgcagatggggcgaattgaaaagatgaaagaagaaaagaatgacagggtcgagaaggcaacattgattgagtgaaagaatgagaagacgcagtcagtcagaaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccataaatttttattatccttcttctctgcttgataaatacttgtgtgttgcgagcctgccatggcaattcctgcccttcccctggcccagcttagttcttaagtctccccactgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgaggtctttgcactcttcattttctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagagaacctcaatggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgatggtttcccttttactgggaatttcaaggacaagtatgcaaaagattttaaaaatctttgatttttaaatcatatcttcagttatgattttaagaatcatatctgaagcataaagtgtgacacataacaccataaggccatgaaggaaatatgcccaaatgttaataaagtttgtgttaatttagaaacagcagaatgaagaactaatagatagtgtttactgtgtgctaataaatgttctaggagattgacaagaaatagctcatgtaattcactgcagcaatttacagaggtaggtattattgtagtaccctctgaacaggtgaggaaacagggacagaaaagacaagcaacttggatggagcccaggagacaggcccacggtctctgctctgtacactgcactgctatctccacacattctcgggtgcgatctttcttcctctttaggaacaagactctgtgccccaggaagcaggacttcactctcaccaagctacattctgcttcttattcttatttttatttatcattattagtattatttttttaacagtcttgccctgtcgcccaggctggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgtttcccaggctggtctcaaactcctgacctcgtgctctacccgcctcagcctcccaaagggctgggattacaggagtgagccaccatgcacagcccctactccctgctcttgatgctgtcacttatagatagcacaggttctattaggagcagactcctcttgaagcccctcagagcaggtactggctactatcaccaagtttccctcagagtcactagaacagagctttgcatattgggcctcaacagaaacttgaactgaataaaagttcactagtctcagacatttagaacaacagactagatgttatttgtctgcaggatcttacatggtacagagaggattcttgaaaacatgattgagcctcttggagaaaacaggtcattctgtgcctgtgtcagaaatcaataaatggcagtttaactctagtcccacccccacctgattgcaaacatggaaagttgctaaatattttgggacctctgtcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagcggcagccttgtctacttatttgaagatgatgtttccctggtttcactcttgtcatctccagtcttgatctcctttaagtcaacttatcttagctatgcagtcaccttgaaaccaggacataaacacttctacacttttcttgcttataagtttctataaagcaaggcttggccctgagatttttaccccatgagtggccaatgtttctgtgtagcacaaaaggtttcattttgcctttttaatttttttcttttttggttttttgttttttgtttgagacggagtctcactctgtcacgcaggctgcagtgcagaggcacaatctcagctcactgccacctctgcctcccgggttcaagcgattctcatccctcagcctgccaaacatctgggattacaagcgccaagtaacatgccagctaatttttgtatttttagtagagatggggtttcgccatcttggacaggctggtttcgaactcctgacctcaggtgttccgcccaccttggcctcccaaagtgctgggattaagatgtgagccagcacccccggtcagagacttttttttttttttttgagatggagtctcgctctgtctcccaggctggagtgcagtggcacaatctaggctcactgcaaactccggttcctgggttcatgccattctcctgccacagcctcccgagtagctgggactacaggtgcccaacaccgtgcccagctaattttttttttttgtatttttagtaacgacggggtttcaccgtgttagccaggatggtctcgatctcctgacctcgtgatccacccgccccagcctccgaaagttctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaacaatatgtgcgtatacagcctgtcctcagaattgatcttccatagcctagacagaggtatgagacacaaggaaaatagaggctacctgggagaatgtttacagcatcctgacattcatcatgagaggattctctgtctacaaccagagctgagttgactttgtcttcctcaaaggtgatgttgatgttcttgtgaggctggttggagtcacaagggccgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccacaccctgtgtctaagctgggttgaatttcacatactgtggccaagcgaatgcgggcttttggcccatcatagatgccagagagggtgtgcctcctagacattttcatatgttaccacccattacttgctcctgagtattcagtgttacctgggggcagatgattccagtactttctcagcctcctcaacttgaacatcttcatcctcatcttcgtcattttctgtaaatacaaaatgttcgttcagatatttcccacttcccattctccaagcacagtcagcccaatgtgcacagagacatgaacatctatgtgtggttcagcattgtactgaaaactgtcatgttttatctttcacaaaatgccctggcatggtttcctggtccatcgggcaatgcatttctgatctggagggccaccatcaagatgtggccaaatattgaaaagaccttttgcttcccatatcactggaggcttgtgcagcctctctctggactttggcagctgtctcccccatcctgccacagatctgattcccaggaacaggtttggtgtcctgtcacagttcgcatttcaaacctcattctttctcttaggagaggacaaacttgtcccacagtcctctatgtgtcatgagactgcacaggccctccatgtggcttctgctgtgttattcagggacattctatccatggggagtgctccagtctgaagcacttcctaccaccaaatgcccccacatcaagtgccttctccaacaccaaacggagaggggctgcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgccaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtgtagcagaaaataaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaataatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcaacttgcagccactagatacaaagccatgtacagaaatgaggccaggtgcagatggggcgaattgaaaagacgaaagaagaaaagaatgacagggtcaagaaggcaacattgattgagtgaaagaatgagaagacgcagtcagtcagaaggtggttctcactaagggtaagtggggtggtgatggcacaccattttgagtatactgagtgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccccacctgcccccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagggaacctcaagggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggtcatgaaggaaatatgcccaaatgctaataaagtttgtgttaatttagaaacagcagaatgaagaactaatagatagtgtttactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccacggtctctgctctgtacactgcactgctacctccacacattctcaggtgcgatctttcttcctctttaggaacaagactctgtgccccaggaagcaggacttcactctcaccaagctacactctgcttcttattcttatttttatttatcattattattattattattattattattatttttaccagtcttgccctgtcacccagagtggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgttgcccaggctggtctcaaactcctgaccttgtgatctgcccgcctcagcctcccaaagggctgggattacaggagtgagccaccatgcacagcccctactccctgctcttgatgctgtcacttatagatagcacaggttctattaggagcagactcctcttgaagcccctcagagcgggtactggctactatcaccaagtttccctcagagtcactagaacagagctgtgcctgttgggcctcaacagaaacttgaactgaataaaagttcactagtctcagacatttagaacaacagactagatgttatttgtctgcaggatcttacatggtacagagaggattcttggaaacatgattgagcctcttggagaaaacaggtcattctgtgcctgtgtcagaaatcaataaatggcagtttaactctagtcccacccccacctgattgcaaacatggaaagttgctaaatactttggtacctctctcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagtggcagccttgtctacttatttgaaaatgttgtttccctggtttcactcttgtcatctccagtcttgatctcctttaagtcaacttgtcttagctatgcagtcaccttgaaaccaggacataaacacttctacacttttcttgcttataagtttctataaagcaaggctgggccctgagatttttaccccatgagtggccaatgtttctgtgtagcacaaaagattgcattttcctttttcgatatttttctcttttggttttttgttttttgtttgagacggagtctcactctgtcacgcaggctgcagtgcagtggcgcaatctcagctcactgccacctctgcctcccgggttcaagtgattctcatccctcagcctgccaaacatctgggattacaagcgccaagtaacatgccagctaatttttgcatttttagtagagattgggtttcgccatcttggacaggctggtttcgaactcctgacctcaggtgttccgcccaccttggcctcccaaagtgctgggattaagatgtgagccagcacccccggtcagagactttttttttttttttttttgagatggagtctcgctctgtctcccaggctggagtgcagtggcacaatctaggctcactgcaagctccggttcctgggttcatgccattctcctgccacagcctcccgagtagctgggactacaggcgcccaacaccgtgcccagctaattttttttttttgtatttttagtaacgacggggtttcaccgtgttagccaggatggtctcgatctcctgacctcgtgatccacccgccccggcctcccaaagtgctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaagaataacaatatgtgtatatacagcctgtcctcagaattgatcttccatagcctagacagaggtatgagacacaaggaaaatagaggctacctgggagaatgtttacagcatcctgacattcatcatgagaggattctctgtctacaaccagagttgagttgactttgtcttcctcaaaggtgatgttgatgttcttgtgaggctggttggagtcacaagggctgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagcgaatgcgggcttttggcccatcatagatgccagagagggtgtgcctcctacacattttcatatgttaccacccattacttgctcccgagtattcagtgttacctgggggcagatgattccagtactttctcagcctcctcaacttgaacatcttcatcctcatcttcgtcattttctgtaaatacaaaatgttcgttcagatatttcccacttcacattctgcaagcacagtcagcccaatgtgcacagagacatgaacatctatgtatggttcagcactgtactgaaaactgtcatattttatctttcacaaaatgccctggcatggtttcctggtccatcgggcaatgcatttctgatctggagggccaccatcaagatgtggtcaaatattgaaaagaccttttgcttcccatatcactggaggcttgtgcagcctctctctggactttggcagctgtcgcccccatcctgccacatatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccacggggagtgctccagtctgaagcacttcctaccaccaaatgcccctacaccaagtgccttctccaacaccaaacggagaggggcttcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgtcaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtatagcagaaaaaaaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaagaatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaattgaaaagacgaaagaagaaaagaatgacagggtcgagaaggcaacattgattgagtgaaagaatgagaagacgcagtcagtcagaaggtgattctcactaagggtaagtggggtggcgatggcacaccattttgagtatactgaatgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccctgcctgcccccatggggtcccctcacctgagctcctcagcttgcttgagctgctctgcaagcttctcctccttgaactgtcgctcattcctcagcataaattttatgaggtctttacactcttcatactctgagaaaagacagacacgcctgcctcagtggaaggctggacatgctgctgtggtcactgcctacagggcagaagccaggtccatcccaaggacaaaactgtcccccgtaccaggctctaggcagggatttccacatctttactcttcagtctcctgactttctggcatcttatcctccaaaatttaaagacgaagaaagagaaattcaaggcacatcaaggaagttgacaagatgattcaaccacaacgaagtggagtcagaactcacagcccctgaggtctgactctgaatgcggggccactttcccaagacttgcagcctctcctctgaaacactgcactggggcatgaagtagtgatttcttgtacagttgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggccatgaaggaaatatgcccaaatattttattagtatgacaggcagcatcaagatttagattagttgtgttaatttagaaacagcataagattagtttgtgttaatttagaaacatcagaatgaagaactaatagatagtgtttacactgtgccaattaatgttcaaggagattgacaggaaatacctcatgtaattcattgcagcaatttacagaggtaggtattattgtagtaccctctgaacagatgaggaaactgagggacagacaagacaagcaacttggatggagcccaggagacaggctgagggtccctgctttgcacactgcactgctgcttccacacattctcgggtgtgatctttcttcctctttaggaacaagagcctgtgcaccaggaagcaggacttcactctcaccaaggtactctctgctttttatttttatttttgttttatttatctttttgtttgtttgttttttgatgagtcttgccctgtcacccatgctggagtgcaatagtgcaatcttggctcactgcaacatctgcctgctgggttcaaaggattcttctgcctcagcctcccgattagtggtgattacagttgcccgccacgacgcccatctactttttgtatttttagtggagatggggtttctccatgttgcccaggctagtctcaaactcctcacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacagagccttgcctgttgggcctcaacagaaacttgaactgaataaaagttcactagtctcagacatttagaacaacagactagatgttatttgtctgcaggatcttatatggtacagagaggattcttgaaaacatgattgagcctcttggagaaaacaggtcgttctgtgtctgtgttagaaatcaataactgtgagtttaactctagtcccacccccacctgattgcaaacatggaaagttgctaaatactttggtacctctgtcttccaactttaacaaaatgttaaaatacccatttctgttttcctagaagtacaggaaggatgaaattatttttgatggagagagcatttagtgtctcagagagaagacaggacatcattcatcactttcatgatggtgagcctatagatcttactgtatttcttctgtcggttggccaggaagccggccagttgagttacaaaacatttctctttgaggtttctgaactgctgtttgttctctgccagctgggggcgcaatttctcgttgatttctaaaatgttcgtctctgccttctcgctggaccaagggccagctgataccaccatgctgacgtttgtggcagaagaggtggagccagggactggggagaagaaacccaaacatatgatgggttaaaaactggtgaaatcaaataggtttaatcaggactgagggatgtcagtaactgaaattcttaacttactgttgtgaaaaatgtgatcactccccacagcactttaggatccttcaccacaaaaacaaggttcgaggtgcctgaactcagagctgaaagcactgccagtagctcagactctgataagagtgaggtagactgtggccagcgtgccaggtaaccgtctgcagttgcaataacagaattagaaggtgggggtgtcatggaatcttaggagccctgcattccaattgcccaggctttcctgaaacacaggcaccctagtctcacctgagggtcaccaccaatggggatcattccttcagcattcactctcagtattcgtgtacccttgtgatgatgccacagacccgtgtctttcccaatacatctaagcatattcctcactgtttatctcttgtctgtacaacatcatcaaggcagaaacagtttcccaacaggttgtattttcttaatggtagtcatgaagtcaccccacctgctctcagttaaaacagagcttaaggcctttccacaggtgtaagatatcaaacttttagcctgccctgatttcctctgggtcttctgcagttttgtctgtatccactagaaagtgaatgaataattcatttgtaaaaaatgttgtctttcctgtctcagtattcttcttgctgtttcccattgttatgttgatttcttttttctcactggggcaccatctttgcttttcattacactctagaccagtttgacatccctatgtccagagctcttcctctatgtgggttgatttggtttttgatgtcactgagcgctacattttatacttgtcacttatggatgtcattctagtgtcacaagagctcttttcaaggtatcaagtgatcaaaatcatttatatagagatctcctgaaaacatgtgtgaccatctatcttgggaagtttcataaacctgatgctattttgttgtttccattttgttttcccatatactgaaaagaacagggccatgagcggttcttatgcaatatggtttgatatatattttgttgagatgacctaacaccattgattttgggttgcattccactaacagaacatggcaagatcaaggttatggtcacggttggttggtgatcctcagtgttgcagtagaaggtgagtttgagatgagaggaatgagtaggaaagagtgatcccctgaaccacctcctcgctttctcagctttcaccccacctaggttttgtgagcctggaacttgggagactgttctgtagcccaggtctcctaagattggctgctggacttgcctgagttgagggtgcggtgggttgaccctgggctgcccagcattcatgtggtagtgaaggaaggaggactggatcaatcccatttcaaagcatgtctctctgcactccacactgtcctccaatgacactgtaaggaaaccgctttaagacgtatcaacggctttaagtaaatgtattttctggcatctgggagacctgacattctgtgtcataatgaaaatctgtcatgtttctttattttaaaaatgataaaactgcaggttcacagagttacatggcttacttgaggtcacacggggatgagttttcagcactgccaataaaagcaatcacatgaattattcagtaattattcataggatccatataattcagtaaatattcacataattatttactagttgttcattgaccaattcgtacaaggcattttgctcaaaactgtgtttatatttggacattgtatcttcatcataatcctgtggtaatgctgttatccgtaagtaacaggtaagaaacctgaagaggagggatagcaaatcatgtatttggacatatttcctttttttttttttggtttttgtgatgctggaagaatgaccagaatgagtcataggaagagtatacattcctgtagtattttccaggacagaggtgtgacctcctagagtactgggaccaaaattcccaagtgtctgcaaccttgctttaacagtatgggagatcacctctatcacctggaattcccctggaactctggaatatacaagagaagtatgagacttgggtcttcccttggctgtgtttaattcactcttctatggaataccaatgattctcactaagactggccttttcataagcacaatgtgcattttatggagaagattttacactttgctctatttagaaagaataaatatgagcagtggtttaggttttatgccctggacttaatatgtttctgattcctgttttgagattaaattctcatgtaaatagaaaaatacttattatttctcataaggccaagtttgttattagtttgagtttttgaagatgaagcacaaacttttgattttatctttgtctgtctctgtcagcgccactcgttgtctctcagtatgacctggacttgcccctgcacttacccttgtcctgctgaaccatctccatgcactgtccaattccatcagtgattcgggctccttccaaggctccctgaaaagggcacagagatcaggacattaggcacattccggacacaaaggcaacccatactgtagagtgggcagctgtgtttccacttccctaatattccagtgatgtcctcaaactgaaaggaacactttccctttttaggggtctgttcttcatgtctcagtgcctctgatctagtcaacacaactgtcctgaatgtgaaagaacttgctaaatttctagtttcttgttaggtggctaaaatagatttataagacttccttacttacccatgactgctgaagtttgaattcttagcagtacgattcgttttcttgtaaggtgagcagcttaggaaagattggccatcttcctgtgcaaaaagaggcaaacttaatttctactcaaagcatgcttgaatttggaatcagggcttccactcttccgaagttggagtgtcactgcgacaggcatgtgtcccgaagggctcgtgtctctgctatactcaaagtttaaatggagcccagcaagccagatgtcctttacttctaggttccctcaacagtttctcctccgctttagagaccgcattgaaaatattcttgttctgctgttgtgttttggctttggaatgatgtgatgcagctcaatgggtcccacccccaacttgatcaaagtaagaaacagctgggaaagtcagtgcaaatacaagttcattgtcctccttgcagggattctgattcagagggctcaggtggggcctggaatgtttgttaacatgactcagatgtgcagtcaatttggggactcactgacagcattgaccttacagtttatgggatgattctttctgtttggtgatgaagaaactgaggcacacagagtctgtaacttgcccaagttccccttgttgtaagtcctggagccagatctcaggtggaccagtgcttctctcccctatacctcatttctgagaaaaggaaatcttctgcaatttgacttctttcatctaacacatttcctcacaacatgcagccagcatcatattttggccacttactattaaagtgagatgcttttttttttttttttttgagacagggtcttattctgtcacccagggtggagtgcactggtgattatagatcacggcaatcttgaacttctgggctcaagcgatcctcctgcctcagctttccaagtagttggaactataggcacacatcaccatttctggctaattttatatttttcatagagacaaggtcttgctatgttgctcaggctggttttgaacttctggcctcaagcgatcctcccacctaggcctccaaaagtgctgggattacagaagttagccactgaacctggccctgaaatgcttttatttctttcttttttttaatgaaaatactggacatggagatgtggaaagacaccttgctttattacttttgttgttattattatttctacagtagaatttatacatcacaaaattcaccatttttaagcatacatttcagtgtcttttaccatattccaaaactttcgcaaccatcgccactacctaattccagaatattttcataatgccaaaaagcatgcctgtacctatgggcagacactctccaattccccccttcttgcgctctctgacaaccactaatctaccttctctatatattgatgtacttgttctgggcacttcctctatatggaataacaaagtgtggtattttctatctgcttcttagaatattgttctcaagtttcatcctttctagcctgcgtcagtacttcaactttttatggccagataatattccactatatggttataccacattttgtttattcatcaactcatggtggtttaagatgtttccactttttaactattaggaataatgctgctgtgaacagctttgtacaggtttttgagtgaacatctgtttttcattttcttggttataaacctaggagtgcaattgctgcatcatatgtcactttatgtttcactttttgaggaactcacacactgtttactaacttcagtagctatatcattttagattcccaatagtaatatatgagaattccatattctccatcacttttgaaacatgtgttgtctttatttttttcttaagtcatactgctgggtgtgaagtggtatctcattttggtttaaatttacattttcctaatgacgaaaaacattgaacatctttgcatgtgcttcttggccatttgtgtgtttcctttagagaaacctctactcacagctttttttccccattgttaaatgtggttgtcgtttattgctcagttatatgaattccttatacactctaggtactagacctgtgtcaaacatacaatttggaaatagttctcccattatgtggattatcttttcacttccttgacagtgtcctttgaagcatacaagttttttattttaatgaagtccatttatctatttttcggttgtttgtgcctacttaaaaaatgtctaatccaaaatcacaaagatttgtacctaggtttccttcaagacatcgtcttttgaatgagaactttcctgggttttagaggagggtggacattgtttattgatgcctcctgtccattaccgatgtttctcttgattgttattcatatgctcaccacccctccatggagcatccatggcctgtgacagagctctggggactgatatccttccactgactttggcgctggtgagagccctggtcatgtgattcagcttggccttaacccgacccagttgcacatattcctcaggccctttagagttgaagtcgagacctctctgagaacgcttgccagcccatgctcttctaaggctggagcaaacttcctccatctattccagacagaggggactgcaggggttggactcactcaagatatctctggtgttagaaagaagacctgtttcaggctttggggaagattgttcaatatgaactaggtcctctctaattatttttaccgtatgtgtgacttctttctagaaacaagggaagaatatttatgttagaacattttgtctattctttgtcaattgttgtttatctacaattttaacatggataaaggagagttcagtgtcaatatattcttaacaactaattacggctcatgtccaccgccatgcgatcatatttaaatctgtcaactatcctgttacttaggtattatcctgttcctgatgagaaaacaaactcagaaagattgcaaaatttccctaggtcacaaaactagtgaggagaggagtaagaattagatatccgttccttttggccttcaaagctaaccttgtaccattagatcaaactgatttacatacttttgctggaattagtctcagacttgtggttctcacttgattttcccaaggaaacagtgtgccactttaatatcatttcaaactttgaaatttaaaactctttttattatacttttttgtctttgttctattccgttgcttttggtttcttctcaacggatccctcttatttatatgctaaatatttgttacctattttctgtcaattttcacctttttgagtgtttgttatctgtctgttgtatgctaacagtttttcactgaggtaaaatttgcgtagagtatactgcaaaaaaacctaaaggcacagcttaataaattttaatataattataattgtaaagtaacacccagttaaagacagagaacattttcccccatgccacaaagttctgatgtggtccttgccagtcaatactcatcccccaaatgaagaatatattctgaatgttgtcactgccttagcccctttgtgttgctggaaaggaataccagaggctgggtaagttatcaagacaagaggtgccttttgctcatagttctgcaggctgtacaagaagcatggcccccgcatctgctcctaatgagggcctgaggctgcttccacttgcagcagaaggtgaaaaggaaccagggtgtgcagagatcatatggcgagagaggaagcaaaagagagcaaggaaaggtgagaggcactttttaataaccagctcctacaggaactaagagagtgagaattcactcactaccttctcccagggtggggattcatctattcatgagggatccactcccatgacccaaacacctcccatttacccccacctccaacactggggaccacatttgaacatgtgatttggaggggaccaatatttaaacttagcagccaccatagattcattttgcttgatcatgtgcttcataaaaatggaatcattttggctgggcctggtggctcatgcctgtaatcccaagactttgcaaggctgaggcgggcagatcacctgaggtcaggcgttcaagaccagcctggccaacatggtaaaaccctgcctctactgaaaatacaaaaaattagccaggcatggtggccggtgcctgtaatcccaggcaccagatatgtactggtatctcatatgtacaggacatgtactggtatctcattgttgtattgattgatgttcctgatggctaaactgtagagcatcttttcctatgctaattgaccattcatgtatcttcttttcttaagtacctattcaagtcttttgagaaattgtttcattgtgctgtttatcttattaaacttatatatatatacatacatatatatacaaatacactctaaaaaacccctttgttggaaataaatatatctcctatattgtggtttcttttaatgttctcttaatgttccctgtttggagataacgatagataatcttcaaaaaggtgaatatacacacccacacccacccacacacatacacacacacacacacacacacacacacacacacgtgagccaccggatccagcctgttgaatttatttctaagcacaacatgtatttagatgttacttgaaatgaaattgtatttttatttcattttccaaatgctcattgctaatacacagaaatacaaaagactacttctattgagcttatattctgcaacattaccaaactcactaattacttttggcagatttttatagatttctaggattattaacatacacagtcattatctgtgaataaagacagcttcaattctttcttttcaatcttttcaatacttttatttttcttactttattgcattgatttagatctctagtataatgctgaattgaaagaataacaacagatattctacttttttctctgatttaatagaaaagcattcaatcctatgccatttaatataatgttacctctgagtttttttcaaatctacccttaatagggttgaaagtgttgccttctcttcttatcatgctgagagttttctggggtttgtttttataaatcatgaaaaaagttttcaattgtgccaaatgcttttactgtgtatgacaaggtaatcatatggtttttctcttttgccctgataatacataacattacattttcttaaatataaaaaagatttcttgaatcaagctaggacagtttttttaattataaacttttaacaaatatattgaaatataacttacatgcaattgagatgcatgaaagtgtataatcattaaagtgtataattttaagagtttgagcacactatacacgagtcaaagagaaaggacagaaaatactaacgatggctcagcacatgtggtctatcttgctgaatgctctatgtgagtttgagaagagttatttgttagctgttcttagatgtattttgcttaaatatcgacctggctaacatgtgtcattgattgtgtgaattaattttgttctagtgggcagtaaaattactgtctgatcactttggacttatgtggactggttcatgttttattacaacggattcatggaaagcccacagcatttcccaagaccctctaatttggcaggactcaatcaccaatccacccctttgtgaatttgtcagggtttgcttttaggctttagcaggttggtctacaataggccttattgaaaagtgtgacacttattcctaaagcacatccattctagtgtctcagttggatacctgggtgctaatgaggtgtgcatgagttcttcccaccatggatggcagaaactccatcatacattccccaaccctcctccacctcaagtacctctggtccaaactcaatttcatagcagccacccctctgttaaatctgttagtcttttccttgtgcaggtagagtccactccttgataagtatgcacatggaaccccacatagactttgagagctgcacctttgatcagctgtctcctcactggtgccctgccctgcagattgcagttgcttcagccgtcttgaactctgatctctgccttctcagctcagtgagctgccctgccctgagtggactctagctcactatgcagctgctgagaaattctccccaaacaactaggaaatcatggggcttcccccttaagttttctcttggactgcctgttgtacactgctgaaaacaattttacgtttgtttatggaggcagggttagtctgatatgatttattctaacagacagaagcagaaatctgttatactcttttaattactgtgtctttataatattatggtagacagaatcctaagatgacccccagtgatctttgctcttatataatcacttcctcctgagtgtagacaaagctactgaggagatgtcactcctgtgattgtgttacaatttatggcaaaaacaagttaacagatgtaatcgagatcccaaatcggtccaatttaagatagacagattatctgatgagcttgacctagtgaacgtgagttccttggagggactgaggacttcctggagagatgtgaagtgcaggagggtttccatgcagggcgatcctcctctgctggctggaggaagcatgcagtgggaacatgggaggcctctaggagcagcgagaggcccctggctgacagccagcaagaaaacagagatctcagtcctacagtcacaaggaactgaactcagctgacaacctgaggaaacttgagaggaagttcttccccagaacctccagaaagaaacccagcctaatttcagcctgtgaggccctgagaagaagacccagagaatccaggcctgaacttctgatctgtggacactgcaagaaaataaatcattcttattttacgccgctaatgcttgcagtaatttagtatgcagcaatagaaaattaatacaaataaaatggagaaggctttggagtggggacaagaaggaaacggtgggagagggatgcctgtatgctgatatggttgatgcctgtatggttgaattgggtctaccgttcctcatctaattagctatggtctattaaggtgcatagctacacacaaatattggtactacgttcaattcagaggaataagatattgcattcttgacagtagacaagaacaccctgaatttggggtcactgtatcataagtcatgttatcaggtccctctaggaaggcttagaggaagatttccaggatacacttgtgacaacattgaaggcttcttttttccccaaagggacccgatctcccctcagtcgagaagctccaagtctctgaactggatgccaggttataaattccccctatactgactccatcaggcttctgtcctcagaactagagtttatcagtaaaagatagactcatgggagtctaggcatttattctcttattttatataaatcagttaatgtgcaggaacaaaacagactttgaagaaagacactcacagttgccacaggaaaacaccttcaacatcctcatgagtcatcatgggtgttctgttgggaggacttgataggaggctttcctcctcacgggctagtgcagatccaggggaaatgtcatcaagtcctccattcggagggtagcagctgaggctgctgattcgttaggcctcctgcagctggagatgcaagtagtgcattttcatggccaccgcagggccctcagtttagcattcttcagagccagcatccaacaagccacagaagctctgagtatttccctttcttcagtcacccacataaatggcttcagggccttctggggaaggcctgaaggaagatttacagcatacacttgtggcagcattgaaggcttcactcttcctcaagggatccaatctcccctcagtcaagaagctccaggtatctgaactggatgccaggtcataaattcccactatggtgactccatcaggtctctgtcctcagaactagagcttttctaagtgtaacgtaagttgatttcttagtagatgtcccatccattacattcccagacacctcacaatgattcgaatgattagtaaccaccacatatccctgcctctcagggaaatccctcccgccttgtctctagatggccaagtcccacggcctgtcctctactcttccagaaccctgttgttctcactgacagcagggagggcaaatccatgcagcagctcccgccatgacctccagcctgcagaggatgggcgccacaggacttttaaacgcatgccgctgttcccctcacctgtgcatttcttaacgccttggtgaggagaatgtctctggatcttccttgatgggagctaaaggaacaaaggtaaataatgctatgggacccactgagaactggggctgtggaagagtggccactgaagtaatagacagatgcagctattgccagatactcagtgccagagcagggagggacagggaagaaatacggacctcaccttcctctcacttccaggatccatcgggggccctccattgctaaacctaactagaagtgtgcacgcacgggagccagggatgcattctaggagggacgagccccgagtggcatgagacaggatggaaatgagtggacagtggatctgtgggaagaaggaggggatgttatgggaaaacaaaaggagaatactagctaagaacgctaggtgacattaatattccgaagtctgtgctcatattcagcaaagaaagttcagcataaagcactaaataaggagtcaagatattgtacttccaactgttgttccaacagctgtattatgaagggccactttatttcatgcctttctaatttgacctaaagtgccaggtggcactggggctggcacagccttgctcaattatgtgttgcagagtacacagagactgccaggctgagggaagatgcaagagaatagaagagatgctctcagggaacaagagaccacatggccccagagtcaggggcagcatcagccactgtcagctgctcattttcccagacagagcccacaagcctcagccatgctttgcttctgcaagacgcttcttcaccttttcaataaacctgcctgaatttaagctgacagggtttatttctccttcatcataaatgaaattcttcaccacaacaatctccaatgaattttgggcacagcaggcaggcccatttctgcttctgttccactatctctcctgtaggttgaaaaggaggaggtactgaattacctccaaatgttcctctggctctgatattctgttattctggttcctttttggctactttgtttttggtagcgtgtatcctaaggcgtccagttgaacaacttttgtctactgtgtccaggcattcctggtggtatttcagataagactctcttgggttgctgaactcacaaccactgaaccaattctatgaccatctgtttcatggccacatgtttgctcattttatatgtacataaagggaggggacagacagcaaacttgcgtgttacaaattgtatcatcttaaaaaggaaacaaggcaacactttgcaataaaaccttaagatgcatgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaactagtaaatcttaccaagatctgactttctgcagatataatattattttgtttgaccatccttatcttcaagggctaccaagaaggaaccaagaatttatttacctccccaagggaaaaggttttaccaatgagaccctttctcaccatgaccccaggaccccatatgccctgttcacttgagtgccctgtgtggcctgatagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaagctttctcaccttcgtacactaatggttggaaggtacaacagcatatgcactttgggaaaaaatatctggcatattcttacagaaacaaacaactacctattctatgactcagtaattcctaagcatttatccaagagaaactaaaacctatgtccagaaaatgacttatacaagaatgttcatagcagttttattcataatacaaaaaactggaaacattcaagtatctgtcaatacaagaatggatcaataaactgtgatacactcattccatggaatggctaaaggaacaaactggtgacacacagaacaacatggatgaatctcaaaaacatttggagtgcgatagaagccatacccaaaaaagtgtgagaaaaaaagataaataataatggttccaagaaatgcacagcagacagcccagaggcaaagacccacaggacggcgggccggtcccaggctgtcgatcctaattaagaaacttctgctggattttgcccagctccatttccaaactattttgggtcagtgacttctttatcccttccatgttgcctcattttgaactagaatcactgtaagtgttattctatgtctgtcacatcattccacagtaggggcagataagctgtttagaatggctaaaattcaaaaaggtgaacacaccaaatgctgtcaaagatgaggagcaaccagaactttccatcgctagtggaaatcaaaagggtacagtcactttggaaaacttaagttcactcaaaatcctgcacagaagtacttacagcaattttattcatcatcgccaaaacttggaagtgcccaagatgtctttcaccaagcgaaagaataaacaaactgttgtagccatacaaggaaatctgattcactgattttaaaaaacaagttatcaagccatgaaaagacatgaaggaacttaaagtacataatgctagaaagaagccagtctggaaacccacatactgtaccactccaactctaggacattcttggaaagtcaaaaagatagaagtagtaaaatggtgagtggttgtcaggggtggaggagaggaggacgcgtgaaatggtgaagcacagggaattttcagcagtgaaactctttcgcatgatgctgtattggggatttaggacattatgtaattgccaaaacccataatctgtgaaactcaaagaatgacctctaatgtaaactatggactttagttgataatgacgtatcaacagtggttcatcaattgtaatgaatggaccacactaatacaacatactagtagggaaaattgtgtgctggaggacaggggagcctaggagaactctctgtattatccactcaagttttctgtaaacctagaactgttctaaaaaataatgtctattaactgtttttttaattaggatgcagcagccccatatcaaggttttggtggcatcctgtaattgtgtggttagtacttggcattgaagtgcaccaacctggagtcagagcagttggagatttcaaggcctgtgccatttacctctaaccctggggtgcccctggaatacagatagcagatcggttaaggagaagcagcctcagcaatctagacagtgcaggtttctggtgaggacaggtaaaaaccatctgggtgggcagaacttggtgaagaccagaaaccactgagactcagcagctgccgcagtggcacccacaaatcaaaggagggggctgggaagagctaagggctactggatgagctctctgcctgcaagacagaagcagatccagagattttggaaaataatgtaggtttcagtacagtgtgatctcttcaaaaaagtagagagaatgaaaaggaaagaaaaagagagagcatgagagagaaagaagaagaaaagaagaaaggaagaaaggaaagaagggagggaaggagggaaggaggaaggaagggagggatggagggcgggtgggaaggagggaaagaataaaaagagagagaaagagagttggagggaagtagggaaggaaggaaggaaggaaggaaatgaacaaatttacatgaagatgagaacagtggggaaacttacaccaccaatattttccattaacaggaacacgctaagtagttattagagaaagacacgctactgtaaaacaatatactgtttccatggggtacaacaaccccttcctcctcctctgaaacacattctatctctggctcactgttgccagagacactgagtcttgtctttggatacgttctggtgcccacaagaatgagatgagacagtggatcccagaacaccaggccacgaacttccctgttgctccttgtccactccagaagctacccagctgcagttggggacctcagcccctgggtctgatgtcatccatttgcctttctcaatggacttctctccttgcactggctcctactcccccaggacctgtgggtgaccacatgagaagaacacaaacaggccatgcccctttctttctccccctctcaatgcctgcagtagtgggttccatggggtagtgacctgagatttactcattgtggggcctctagcccagagcagggcctactacctcacagtcaccccatgaatgctcagtgaaagaagacgtccaccacaaggtcctggggaaccaagaattccactgtggcccataaattctaagtctacaggattctggaatgggagatgggaaaggccttcaaaagtggccacttttaacccattatactggcaactgagccatgtttccccatcctggacacatccagagggcactgcctaaaaccagacacatctccccacccaggacagtgtaggagccttagcctgggggatgcaggtggacagggagggggtgagccaccaaagctgaagagcagaaagcaggtgaaaggggacagcagggtggaaacagagagaaatgggggcagagaatggggggtgagaggggaagagtgaggagagggatgcagatctagctagtaaggaaaagtcctggagagaacactgtcctctcctgaagtaaaatcacttctacctgaccacggcactgcagctcatgggcagcacatgctgtggatatttgttcattcatttaacaaatatttatttaatatctgttgcatgccaagcaaggccctgcaatgtttagggaccttgacatcttcccttcacatctgagtcataatacaaagaggactctctgaccccactgagctggcaatgcctcgggatttttacctgttggatctggcagctcttgatgtcagcccacaccatgtgaggctgctcttggtgcacccaatggggaagtttctacatcagggcctcggagaatccactggaagccctggacagtgggagtcagcggcatccccagtgtggaggccaagagcacacagtgcttaagctccaggcaccctcaggaggacggcaagggacaattggctggtgagagcccgggtcaccgggaaccttcgcctgggtctaaacaggatttgccttcagattgcctgtgagataaaagagagaaatcaaggttaacgttgagatttagggcttcggtaacttgaaggatggagctgccatttacggagactgggaagacccagggaagagcagattgaaaggtggtgggaactagaggtggttgggtttctgtcatatgtaatcaacagtcctgaccagcctgggcaacatagtaagaccccgtctgggaaaagaaaaaaggaaaaataagctgagcatggtggtgcacacttgtagtctcagctacttgggaggctgaggcaggaggattccttgagccttcagttagcggttagtgagctatgatggcaccactgtactccagcctggggggaaaaaaataaagagtcctgactaaatactagagtagccagggaagttttcacaaagtaagtaatatttgaggcagatcttagtgaacaagaattccattatttctgttagggaattaagagagtgtgggtgtcgttagttaatgcttattaaagtagctttggaatctcatctactggtctagctggtctatctgtacacgtatattgtatatgctgtctctctgagctttcgctaggttatgctacggtaacaaaagccccaaaatcttagcagctacacatacgaaggtttatttttcattgacatgtccttttatggcaggttgactgtgactctactctatacaagctactttatttgttagatggtgaaaactgtgatactcggaggttgttgaatatggtattagtatgttcattcattcattcatttaagaaatatttattcaatatctgtttcatgccaggcaaggtcaagtactgagaatacactggtgaatcaaagagacaaaatctctaattgccaggagcttatattgaaaatcagattaaacacatacaaaatcatcataataacaacaatgaatactatattcataaataatagctgtaagagattttagtacatcttttaaattagaaaaatataaaaattattaaaactaaaatggccaggtgtgatggctcatgcctgtgatcccaacactttgggatgccaaggtgggaggatcatttcagcccaggagtttgaaaccagtctgggcactacaggaaaaccctgtctacaaaaaggagaaaattagccgggcacagtggtgcatgcctgtagacccagctactaaggaggctgaggtgggaggagtgcttgagcctgagagatcaaggctgcagagagccatgatcataccactgcactccagcctgggcgacagagcgagacactgtctcaagaaaaaaaaaaaaattatttgatgtagtcctaaaactattatgtagaatactattgtttatatcacagcacgtgagccccttaaatggcttaacacttatttaggtatgatccataaagcttttctggtaattaagtatacttaagaacaattaagtataaaagagttactgccttgacaggaagattgtaaaaattttaaaaagacaaataaataaaagagtaaaaactgtagctctgtgaggctcaaataacatctaattcaagtcacaatgaacatctagcaatcattctgaacaccatataattcacttaatacgttttgcctgaacacccaacacatctgaattaccaacacccatatgtagccaagaaactggcaatcatttataaattatcacctatgactccatctgctctacgcacttattttttaaattttattcatttatttattatttttatttgttgtagagatgggatctcactatgttacccaagttggtccagaaacagaaacagacccacactaatttcataaatcagatgaccatacagtcattcgatttatgaaaaaaagtgccacatggtgcggaaggaaaaggatggtcttttcaataaatggtgctggatcaagcagacacatccatgtagtaaaaagtgaatcatagccaggtggggtggctcacacctgtaattccagcactctgggaggctgaagcgggcagattacttgagcccaggagttcgagaccaacctgggaaacatgttgaatccccatctctacaaaaaatatgaaaattagccaggcatggtggcacatgcctatagtcgcagctactcaggaggctgaggtgggaggatcacttgagccaggagatggaggttgagtgagctgagatcctgccaccacactctagcctgggcaataatagactgaggccctgtctgaaaaaaaaaaaaagcaaaaactaaaataaaatcgttataaggttaacacagaaaaatgtgttcatactcttaggttaggcattgatttcttaaacaggacacaaaaaacagtaaccataaaggaaaagattaataaagtataatttcattaaaatgaagaatctcaggctgggtgcagtggctcatgcctgtaatcccaaccctttgggaggccgaggcaggtgtatcacttgagcctaggaattccagaccagcctatgcaacgtggcaaaacccatctctactaaaaatacagaaaacagctgagtgtggtggtactcccctgtaggtcccagctacttgggggctgaggcagggggatcacctgagccttgtgaggtcaaggttgcagtgagctgtgattgtgccactgcactccagcctgggcgatggagtgagatcctgtctcaaaaagaaaaaaaaaaaaagagaatctcccttcatgaaaaaacaccataaaagagtgaaaacgcaagctacagattgaaaaaagggaaatgcaatacatataaatcctagaaaggaggcatatccagaataaagtattacaaatcaacaggaaaacaagcatatcaatgaaaactggataaaaagatttaacaggcacgtcacaaaagaggacatataaatggcaataaaagatactcaatctcaatgaaaccacactgatatattactgcacccctactagaatggcaaaataatttttaactgacaggtatcagcgaagatgtggggtaaccagcatatccctgctaaatggtacaactactttgggaaaatgttcaacaatatgtaatactaaagttttatcattcatatacctctaaaaccaacaatgccacccctacaaatataccccagactagtaatgttcaatttcttgatctgtggtggttcacttggtaaaaattcattacttttttttttttttttttgagacagggtctcactctgccatccaggtcggagtgcactgccatgatcacggctcactgcaatctcaacctcccgggctctggtgatcctcccaactcagcctaccgggtagctgggactacaggcacacgccaccacacacagctaacttctgtatttttagtagagaaagggttttgccacattgcccaggctggtctggaaatcctgggctcaagtgatctacccaccttggcgtcccaaagtgctgggattacaggtgtgatcactgcgcccgggccacctgcacatgtaaaattgtgaacttctgtatacttcagtaacttttccaagatttctttgacgcaaagttctcagaaatcttaaagctagcatttcagaatagaaaaagtagcttctggttcactagtgaaattttaccaatagaatttaaaaacaaaaagctactaacgcatatcagctcagaacactaccagcagatcttttctttaacttcctgaagcactgggattcattcttttggcaaagaaaggatgaacaacactgtaacccaaagaaaagataccactgccagaaaagacttcttttcgaaagcagctctaagcaaaagataggaggaaaacaaggaagccaggccaaacgtcttggttaactctccgctgaaaggacgccacatgagatgatctaagaagccagccagccagccagacgcagggaaatcacagcaactctttggagtgcaaacagcaaccccacaatccaatctacccgaaatcctgcggttcatttgaggcttgccccgctagtcaggaggtgattcagtgatggctacaaatgctgctcatgtgcatcctggagctggcacacctggcttgcccatcaccagcctggagacaccgccaggagcagaagcccggaggccagtaaagaccccaactttgcaagtcaggggcgcgagcgcgctcgcctctcaggtccgcagagggaacggatttctggcctggagggtggggtgcggggtcagtgtcctctacaggatataggaggacgtgcccccgaagctgctccgtccctccaccccctgggatgccacagaacacccgccagcgagtttcttccccagcgcccacgagagttgggctgcgggcggcagcggcaggcgaagaatccagcgcggggaactcaggccccggcggtgcacgaccccccacagcccccacccgcccccgcgctcgcgcaacaaaacttgccacggccgcgcctcgacccagctgtgcgcccgcgggtcccggattcaccgcccgcccagcctggcgcggcgccctcacctcagaaacgctgggtggacttcgcgtaacttcccattcacagggcagccggcagccgcgccgccgcgcctcggcccagctcctggcgccgcagatcgcccgtcccgcgttcccaaaagcaccgcgctcgctcagaagctcgggcagcctcgcgaccctcacctacgcctcccagtaccgccgctgtctcaaccgccacccagcccctcgcctgcgcctgcgcctgcagcccactggctcctcaggatcccgatgggcgtgtcaggataacccaaggcgcaggcgcggcggggccttaaagggacccggcggcctcttctgcacaacgggttcgagcaggttaggggccgcgcaggcggaggaaaggagtaacccaggggaaggaccgagtgcagcggggacggggaaatccctctctcccctccgcctgtctttcaaagcaccagccctcgaccctccaaatcgctggtttccccggccacttgaacagcccctgccaggttgaagaggcaggagacacaccccctctggggctggagcgaccccgcgcttaggactgcaggcctcgcgctgccgcaccgccccgaatctgacttccaggcacgggcacgcggtgcagtcgggcaggcttcagaagagcccccagctctcccagaggtggccttaggtcactctcaaaaagaataaccaatgtgtcaatggcacttgtagttattttctaatttaaatttattaacagattttgcagatgggcttccactgaaataagcctttgagaaaaagaaaaactttttttttcaacaggattagaataccaagaaataggaagtaaagccatgccgtccacccagctaaaaactttgaaaacttgatattttatctaaggcaaatgtttgcataactttaggtcatgccattatttaaagtcaatttcagttaacaatttcattgcaactgaatctatcttgtataagaaaactaagatacatccctgataatctacctctcccctcctatactccatccgtcagcaaatcctactggtttttaccttccaaattttccttgaatctgtcctcttctatctcctccgtcaccaccctagtctaggctgccttcacctggggagtgagggtcgagggactactgacctagtcttcttgtggtttacccatatcccctttatcgcctctctaatctcaacacaacaggcagagtggcttttccaaaatataatgtgaccgtgtcacttcccagcctaaagcacttaaacaccttcccattctcttagacaaaacctcctaactaaccaagccccgaatggccaggcgccttgcccacttcttcatctcttctcactactcagaccaattctgttctgctctctctgctccagccaaactggcctcttttattccctatttaccagcttcctggcctccacagagcttttgctcatgctttgctctgtgcctggaaagttcttctaacccctattcttctgagaacagctgtagtctccacctctgaaaagcaccttctgacctccctatggtggtcccttactcctatcacattgcatgaaactgtaatcgggtggttattttggtgaattttttactatcggctacgtaagcccagggtttggttttgtttgcttcatgatttgtatttccacatttgttaaatacatatttgttcataaatgagaatgatggatgctagaagttgaagtaaatttggcataaagtcagagaaagagaaaatgtcacaatctgacagttggagtcagaatgtagaaacttcagttatattaaaactgattttatatcgttttaggctgagttgtcttaggatgctttgggtaacctttaaaactgagttctcaaagagccttgtataaacacctgaattaataatgataagccatggggtggcccacataaaactaataacattggttgctttaagagaggaagactgagccaggcacagtggctcatacctgtaatccaagcactttgggaggccaaggcccgcagatcatttgagctcaggagtttgagactaacctgggcaacttggtgagaccctgtctctacataaaatacaagcaaaattagccaggcgtggtggcgggcacctgtactcccagctatttgggaggctgaggtgggaggattgcttgagctcaggaggttgaggctgcagtgagccatgatcatgccactgcattccagcctggatgacagagcaagatcttgtctcaaagagagagagagagagagagagaaatgaagactggtgactggtggctactggtgggaaggagatttttactaaatgcccaaaaggtttaaaattgtaacttttttatttcaaagtctgtgaagataaatgacacaaaagagcacataccttcccatttatttgaaattctagaaaggggaaaattaatctgtggtgaaaaaatcatagcagtggttccctctggcaggggattgactgggaagttacatgagagaaatttctgggtggtaaaaatggtctctgtcttgatagggatatgagttatataagtgtattcatttgtcaaaaaacatacagttaacatttcaatgaatgtaaattttaccttaaaaactatacgaataaatgcaaatttaaaatctgctagctaacacctagttgagtactcagtgtctatgggcattggccgaggctatacatacacgattttctttagtcctcataccgtcctcatggggtaggtattattatcataacccccttgcatatgaagaagccaaaatgcagtaaataccaaataacttgcctcgatttatacccctggaaaatgcgggaagagctttaaacaccatcagtcaaatgccagaagttgttaaacattagactctatagcacttctctgaaattatagtatttttggtatatgtatatatatatatatatatatcatctactagatcaagagcttcacaatgattgaaatcatagtttgtctttttgtttgaggtttatgtttttattttacttcattattttaaagactgagtctcggccgggcacggtggctcatgcctgtaatcccaacactttgggaggccaaggtgggtggatcacttgaggtcaggagttcgagaccagcctggccaacatggtgaaaccccatctctactaaaaatacaaaattagccaggtgtggtggcacgtgcctgtaatcccagttactcaggaggctaaggcaggagaatcgcttgaacctgggaggtggaggttgcagtgagccaaaattgtgccactgcactccagcctggccgacagagtgagactccatctcagagaaaaaaaaaaaaaagactgagtctcactatgctgcccaggctggacttggactccttcattcaagccatcctcctgcctaggcttcacctgggactacaggcccaatatttttgtcttaagtttctaagcagtcccaagactttgcacagtagctgttcaatgtattttgagtgaatgattaaaaacaagcttgatgtcgattttattggtacaatttatatttacatatgtaatatttatatgcttttatatatttatgtgtgcatgtatataattggtactaacttagcactgctgtgcctaagtgcctgagatgcatctcaaatgaataggcctgaggagagaagcttgtgtcattagctctgaccctgcagcactaatcctggtttacccctttctttcagtctccctgagcacaatttatttgctgaaaggccacatctcactatggagtgaggatcaagaagtaaaggtctgaaagagagaagctgcggggctggggagactgttggtcggagaggcgtcgggggcccaaggaaaagggaggattgtggggaggaatcggcgtagagatgagaggagcagcagagacagagtctcacgcagaggtgtgcccagacaccctgaaccaagttacttaacctcgtccaccaccgtggcacccgtggggtccgtgggcccgtcggtcttccaggagggattctgtgtccctgttattgtgtgtcaacatgtgttagcctgatatttatatttttaatgagagaaaacgaactctggaatttgcgaactgttttttcgttttgctttatacctcttggacactccttccgaaggattgggtctcaagggcagtggggtgtgactacggtagacagggctgattaattttcatccaaaactctttggcggattcccctgctctccgcttctccggtctaacagtagtttaaaatagaagatcagcaacatttggagagtttttttctttgcattttaatgataaacttgatttattccattccaaaagttttcttattctgaggttgtctttctatattttgagtataaaacaatggccatactatgttggaaccaccaaggttcttctcttcacttgttcatttgtaatgtctctttataatctgagaatttcctgagcaaactgggaactgttatacataattccttgtttttcaacattctttgtaaacaggaatcaggattggggatggggagggagggaggagtaggagtcctgatttgtggaacagaaaatcatggattacttatgtgatggagcaaagggtttaaaaactcttagcatccccagatttccccttttactgtttgctgaagaaaattctgtctttgactcccttccttaccctctccgggcctgtgagaagcttcctccctatccagtttatttcctcctctgctccccgacccaccccccacagccccctcctctttttcagtgaagccgctggaggaaagtcgggtttgggagaagacccacacaggcaaggacagcaggagaacactgacatagttacactcttgtcaccagcacttttattaagacgtgaaaagacaaagacaacagaggagagcagagaataatatctctgtttcagctattccaggatgttatgccaattatccagagtccttgatctgatgtagtaaagagctagggacattttccctgaaggctttgattgctggcaaaatctcattaaacgtgtatacattcataggttggccataggatggataaaagaagagcctctggcctacatctgccacgatacatgtgcaaaaatgctctctgcagcattatttttcattgtaaaatagcagaacaaatttattattcaataattataaaatggtcaaatgtatgtgactatatttggacaatgaaaaatgcagctgttaaaagcagacaatactgatgattcagatgatgttactgatgaaaataataacagatgacaattattgagcatttatggcattcttacaggcattaccttatttaaagttcagaactaccaaggaaaagagtaacttgtggcaggcgtgagaggttccgaggcacaaaaggaagataggcattcaaggaacaccaggatagaagacccagagtaggagaagagagaggaagaggagtccgccagatgggatgctggaaaccgcgggatagctcggtggagagagggcgctcctgctccgcaagcctccctacgacggcaggcctacccggtcctgctcctgccggctctgggcatctggtttctgccgctccatctccagggagatggtggccaggctgtgccgtgtacccatcaacttctctgacagcgccatcttctcagactccttcagagacaaggcctgggcagaggcaggggacaaagggcttgggggatgggctggtcctgggggcatgctcaggcttcttgctgcctaggaaatgtgcccactgggggcttagaggcctgagtgtgccactgcaggtggacccagggcagacatgcagccctggaaaagggcacaacggcagtcacaagaatcccggacgtggataccactcatagagctcactaacccgccacagcaccctgactgcagagtctttctttctacccatcttacagatgaggaaactgaggctcaaggaggtaaagtgactcgcccaggtacacagctggtgaggagaggagatgggcacagtctgccctgtctccgttacattataggaaagttagggatttgttatttggggggacacgtcagctgatgcctgtgggcatcgtggggactgctcagaaggcagccatgaggatccatgcccagcgtggggtgggacgaggcatgggagaatatggaacagctttcctggtgtcacgactgtcactgtcactcagtaagtgctcactgtgtgccaggcatggagcacagcaaagcctcacgaacccccttctaatcctcccctcctgcaggtaaggaaactgaggcccccaagagggcagtggcctgccccagggctcctagctgccaagtggcagagcagggcccggccccagaactggagcagctcagagagcagcagaggccacgccagggctcacgaacctgctgcttctcgctctcggccaggaggaggccctcgtcatgctcctgctgcagggcagcaatctcctcactcagctgttccttctcagccttccgccgggccagcagctcctcctgctcacgctgcagctgactctgcagctgggcccgctcggcctccagctcccgccatgctgcctcctagggggccaggactggacgcgtgtgacacaccaggaggggcccaggcagaccccccaaaacatcagggcagcaagagccatctggcccccataccctcagagatggagggtgaccaggtaaatacaagggactgataagggctatgacggggacacgccagggccgtgaaagtgccaaggagcagcagtgggctggcctgggggtccgaacatgatcccctgcggagagacaagtaactgtcagccaggtaaggagagaaaagaccaccccaggccaagagcacagcccctggaaaggactacaggatgcagggtgcagagggaaacagggcacggtgagtcacagggccagagccccaggcagtggctgggccaggacaggccgtgtgggccatggggattctaaggacagtgaggggagtgggagagaggactcgagccaaggtgacaaggagcaatctgatttttagcttaggggatgttccgacagctgtggaagagggattggggttgggatggaggagagttaggactggctgtgaggaatgaagggggtcaggggttgccagaggagctggagagaagaacacagatttggggacattaatgaggccaagccaggcaatgcaaagggcaagaagagcaagggggaggtcacagttcagatccctggggactggacaggcgggcaggcagagcccacaggcaaatagcagcccacccggggagcccgagggcaggtgcctgcctcagcagttgtccctagcaactctgtgagaagcagacagagctgccacttcttttttttttttttttttagacagagtctcgctctgtcacccaggctggagtgcagtggcgtgattttggctcactgcaacctctgcctcccaggttgaagcgattcttctgccttaccctcccaagtatctgggactacaggcgcgtgccaccatgcccagctaattttttgtgattttaggagagatagggtttcactgtgttagctaggatggtctcgatctcctgacctcgtgatccgcccacctcagcctcccaaagtgctgggattacaggcatgagtcagcacgcccggccaagccaccccttctttaagagcttcaccatagctcatgcctggaatcccagcactttcggaaagagctttaccgccccctgatggagaagcgtgataaccaccacccaaggccatggggactgcagggtgagtggcatgccctggagccatgtagtcatagcctgcacctctgtcagaggaagccctgtctaggatttggtggctgagggcccctgttctgagggccactctggagagcatgccagtgccagcaatcataactcatggagcatttgctaagtaccagtcactatgttaagccctctatgcagatggtctcagctcatcctcaataccttccactatcctatccctatttctacaggtggggaaatgaaggcacagacaccttgggtagcatcaccagtaagcgaccaagattagattcaaacccaggcaatataaccccagagtcagtgttctagtaacttccctggccccttgcctttctacatgctcaggtctgcgtggcccttcatatggaaacttcttagcaaatgaaagtgctttcctgctgtgcattaggtcaacatttcccaaatgtggttgtggaccctctgcatcaggattaccagggctggaccagatttgggacctgggtatctgaatgtctaataaggaccacaacctccccaccacccctccagtcctcccagctgtccccagggcctccacaacagagagggagtcccatttcacagatgtacagaccgaggcagagcaagaacgatgatgaaacactggctcagacttctgcccacccctccccagctgcctgaaccttttcacgctggagtcactgtaagtcctcctcctgggctgcccactgctcccgcagagaggcctgggcctcccgctcagcctgcaccagcttctgggccatcagctccttgtctagactggctttctcctgcgtagctattatttgctgccgcaggcccgccaactcccctgcacgagaggaatgggggaaagggcagggttgggttgaaatttttccttgggccagcagacttaggccagttgagccatatgggcaaaatcccagaggcagagggcctgcctggcatccagtttgggtcctcttgaagaagtggcttgtcctctctgggcctcagtttccctatctgctacatgggcccactggccctgacccctttcctgcctacctagaatggcattaaaggcataaaatgactgatgagaaggcctcccaaatgggacggatgtcaaacatataacaaccctaggccaggtgccatggctcactcctgtaatcccagcactttgggaagctggggcaggtggatcaccttaggtaaggagttcaagaccagcctggccaacacggtgaaaccctgtctctactaaaaatacaacaattagctgggcatggtggcggacgtatgtagtcctagctacttgggaggctgaggcaggagaatcgcttgaacccaagaggcagaagttgcagtgagctcagatcgcaccactgcactccaacctgggcgacaagagtgagactctgtctcaaaaaatcaaacaggctgggcgcggtggctcatgcctgtaatcccagcactttgggaggccgaagtgggcagatcacctgaggtcgagagttcgagaccagcttgaccaacatggtgaaaccccgtctctactaaaaatacaaaattagccaggcatggtggcgcgtgcctgtaatcccagctacttggaaggctgaggcaggagaatcgcttgaacctgggaggcggaggttgaggtgagccaaaatcgcgccattgcactccagcctgggcaacaagagtgaaactccatctcaaaacaaacaaacaaaaacaaacaaacaaacaaaaaccctattactgactcagcacttactatgcgtcaagcacccagctaagtattttagacataacctcattttgtcttcataacatgcctatgtagtttatcctcatccccgtttaacagatgatgaaatggaggatcagaggagatcagcagcaacttcccacagctgcacagctacacataaagcatctcctttaatgactgacatgaacatacctgtcaagcattaactatcagcattaatggaaacgactacagggaatggaaatggtatagccatcatctaaaaaccatctcccgggttggaaacccaccagcatttcccttcctggttctgtctggctcaggtgtacatggacaggaaaattaatttccatgacccaagtaggtgcttagttaatgttagatgagcagaaagaagccctgagttcagagattcgatggggaacggtgcagggaagtggggctcggattctggggccaagagagtcatctgaaaaccacagagaactcagactaacaggcctgatgaccgatgaacagcagttactgttgactcagccaggcaccgtgccacggccttacacgcttttcccatgtcatcctggcaacaggcttagaaggtgggcattgccacctccaatcatcagctgaggaatctgcagcccagagaggaaaggggcttgctcaagggaaggtgagatctaagtggtggcacaggactggaacccaggccagccagactcctactccagtgctcccaacttctgtgagactacagacattgggaggttgcagtctgggctggaacctggtgttccccccaagtccccagccactcgtaccagtcagggtctccttggccagcagcagggcctgcccctcggcttccagctgctcccggcgggcctcaagctgggccagctgccattgcacctcaaacaggctgccctccagggcttccttctccaagctgcagcacatacagtgcgtgaggccctgggactcagcctccctggccccaggaaactgtggatctcagggagtggccaggcatgggccaagtgccaatctacctgcctggccaggcccacactccctggggaagcctgagcccacagctaggacgagttggcaagccagactccttagtaactgcccctgggggcccgtgcctgggtgaggctgttcatggcgtggccccaggaggaccgcccagggcgggttgggcagagcccaaggccttactgcaggtgtgtggcctcctctgacacggtcctgccttcacgctccgcaggccgccagctgcacagccaggccagcgtgctccttggctagcgcctccttctcccgggccacttgccccagcgtctccacctgtcactgggcctcccaccgggcctgctccagctcctgctcccgcctgctcagctgccaggagagctggctcccacccagagactgagtagcactcccagcatcccccagcttgttcatcgtgcagtaccccaactctgggcctaacccagtcctggcagaaggcctgggttcgagcccagggtctgccctgatgtgctatatgtacttgggcaagtcatgaccttctctagatctgcaatgcacgtgtgtacaaaaaccagggcccggccggacacggtggctcacgcctataatcccagcactttggcaggtggatcacttgaggtcaagagttcaagaccagcctggccaacgtggtgaaaccctgtctctactaaaaatacaaaaattagccgggcatggtggtgcacgcctgtagtccctgctacttgggacgctgaggcaggcgaacagcttaaaccccggaggcagaggttgcagtgagcccagatcgtgccactgcactccagcctgggcaacagagcaagactgtcaaaaaaaaaaaaaaaaaaaaaaaaaaagaaaagaaaaatgagggtcctcactcagctttggaagtaacagaacccttgtattactctaagcagagaagctgaatatataaaccagacccaaatgcagctgctcagcaggcctcaaggtggagacttgcaccctgcttcctgcactccctaccccatcctctagaggcacctcccagaaacccaggccctccaggatggaccttgcatgaaggtccctggatccctgaaacattaaggtctcttcgagatgtgaagttcccaaaagtctaagattccaattctaaaaagtctccacctattattaatctgtatcattattattattattattgagacggagtcttgctctgttgcccaggctgcagtgcagtggcacgatcttggctcactgcaacctctgcctcctgggttcaagcgattctcctgcctcagcctcctgagtagctgggactacaggcgcgtgccaccacacccagctaattttttgtagagatagggtttcaccgtgttagccaggatggtcttgatctccggacctcaggtgatccacccgcctcggcttccccaactgctgggattataggcgtgagccactgcacccggctagccccatgttataaatggggcaactgaggtatgggaggttgggcagcttgtccaaggtccccagctaggagaagtgggactggatttaacccagaagcaggctccagtgcctgtgacttaacccaggactggatgcaggaggctgcgagcctggcctgccccacatgctctccagaccaccccacacacagtttggcctacctgtgctagctgctcctgcagccaactgagctcatggtgcagtgtggggagctgttgctccagcgcctcctgggcctgctccgccactcatagggagccctccaggccctgccgtgccacctcctgctccaaccacagctcctccagccactcctgctctgccggcgccactgtggcctcctgctccgcctgccgctgccggccctgcagcatggccttttcttcctccagctgtgggccggaaaggagtggggcctcatgagcagggcgtccctcccaggaccaggacgcctcctccacccacccaccagccacgatagcccaggggaggctcccagggaatgagggacagtgcccttgggtgtgtgggacactggggagggggagatgaggagggcccatggagcgtcggtgctttgactcctagagaggacagacagacagacggagatagacagagaaccagagacagaaagggaggcaggggccaagacaggtgcagggccgggcccagggtgcctcactgagtggggaggacgggtgggcaaggtaggtgggcccgcaggtgcacagtgtacctgggtgacaaggcagttcagatccaacttgtcctgagcaaggctctcgttgagggcgctcagcttggacagggagtcctgcagggaggcctcctctgccctcagcttggtcacggagagctcgagctccatgcggccagcctcaccctgcagggtcaggccccaagagatgaggaagggcagaaaggtcgggaggaggtgaggagagacaagaagagacccagagagatggaccctcggagacaggggaggggagacaaggaggggatacggcgtgagatggaaaaaaaaatcaccgcagaaagcctgctgcttatggagccatttaaaagccatgcaccgcaaagctgtgcaaaaatagctcaagctgcagggcagggccagagttcagaggatcccctgagtaaggtctagggatagcactgctcagagcccaggctgcagcggacagcgcaggcccccccgccaaggaccctctgcgctgtggccacaactctcagactccaggagctgaatctcaggatgaccctgagctataggcactgcccccaggagcatccagaacagcagggatacggccataaagagaggtcagtccacttatggctgggaccagaggtccagaggtctgtggcctgtgacaaagatcagcctgtatccagaaggaaggggtcagtctgtgaccaggctcagaggtctgcctgacactgggaccagtctgtgccagagtgacaaggcttggggctgggggtcagaggtaggtttgtggttgtgcagcagacagggacccaccttggtcagcgcctcggccacctcggtcttctcggcctgcagcatgtcccgttgcagcgtggcgcggctcagcgcctccctcacctccaccagctccttggccaggactgagcgcttcccttccagctgctctagttgtctatggctgtgggacaaagggtgggtgggtggcccatgtcactttcctgcccgaacctcctgtagccagcaagatgctgggccggggaccaggcctgaggcacgagtttggagagaaacagcctgagccacagggcaaccaagcccactaccgcttagctccatgaccctgggcctccgttttcacatctgcaaaatgaggtaacacttgcctcgtgacattgtttgtttttttgagacagagtcttgctctgtcgcccagtctggagtacagtggtgcgatcctggctgactgcaacctctgcctcccaggttcaagcaattctcctgcctcagcctccctagtagctgggattacaggtgctcaccaccacacctgactaatttttgtagttttagtagagacggggtttccccatgttggtcaggctggtcttgaactcctgacctcaggcgattcgcctgcctcggcctcccaaagtgctgggattacaggcgtgagccaccgtgcccagcctgttttaaggatacaaacttcacatgtgcttaaaatagtgcctgacacatctccccaaggaccttcagaaacaagaataacatgctccaccacagtctactaaacatcatcagcgatcacgtccctgagaggtaagcagcgcagtggtgaagaggttaactctgaaggcagaatgtctgggttcaaatcctggctcttctgctaactgtgtgacctggggcaagtgacatggcttctctgtgcctcagtttaccatccacaaaatggagataacagcttctatgtcacagagttatcatggagttaaatgagagaactgaattgcttaaaatggtatctggcacttagtgaaattagtaaggatattattattcttctaactaaatttttaaaatactactactaatattactagtgttattttaattattcttgttattatcatccaagttctaccttttaactagttctctgactccaggtaagtgactatacctccctgagccccagtttcctgaaatgggtctggttagaaaacccgacatcagaggggtccagacggtaggaggcccaggacccagtgggtgtcacctaaccccatgggggcactgtcaggggacccgaggcacatttgaagggtcctggcagggaggtgagatgctgctaacctgcgctcaagctcccggcgaacccgtgcgccattctgcaccgcctcttcctgctcttcctccagccggtcccgctggcgctgcagctcctcctgggcaacctgcagcttctcccgctcctgcggcagctcctcggcctgctgctgggccacctgcaggctgtggaccaggttgctcttctcccttcaggacaaggggagcgggagcagaggggatgctggggctgctctctccagggaaggtggctggctgctcctctagccatgagctacatcctcccgtcttccaaggcacctgcctccaggaagccttccctgaccctgcccatagcagactcatttcactcacacactccagcagaagaacctggctttccttctccccagcccgcccacttagagtggatggaggtgctggcgtgatctctaagcactctaccacgtagaagaggccaggctaggctcctgggacacacaggcaattgtgccaccagttctgctaggccatgtgaccaggaaatgtcccctagaacaccccatgcccctcaattctgggaagcctgatagagctgagtctgcagatcccacagcttcctgctacacaggcacatggtggccacggcaggggagggaggagaagggaacaactaggaccccaaagacttgctgtgagctgccactttccccactggtggtaggtgcaaaaaacttcaagacgtgatttttttttttttttttttttgagatggagtctcgctctgttgcccaggctggagtgcagtggcacgatctctcctcactgcaagctccgccttctgggttcacgccattctcttgcctcagcctcccgagtatctgggaatacaggcgcccgccaccacgcctggctaatttttttttttttttttgagacggagtctcgctttgtcacgcaggctggagtgcagtggtgccatctcggctcactgcaacctctgcctcccgagttcatgccattctcctgcctcagcctcccgagtagccggaactacaggcactcgccacgatgcccggctaattttttatatttttagtacagatggggtttcaccgtgttagccaggttggtctcaatctcctgacctcgtgatccacccgcctcggcctcccaaagtgttgggattacaggcgtgggccaccgcgtccagcaatttttttgtttttacacacagtctcactcttgcctaggctggagtgcagtgacacaatctcactgcactccacacagcttgctgcaatctccacctccagagttcaagcgattctcctgcctcagcctcccgagtagctgggattacaagcgcctatcaccacgcccagctaatttttgcatttttatttagaagtggggtttcaccatgttggccaggctggtctcaaattcctgacctcaagtgatctgcacgcctcggcctcccaaagtgctgggattacaggcgttagccactgtgcctgggcaattttttaaatttttagtagagatggggtttcgccatgttggccagtgcctgcgggacaagaccgacggcgccacgcaggtgttcctctagggcccgccgctcactctcgctgtcgctaagctgcttccgcagggtgcccagcaggtcctggcttgcctcatagcgcccacgcatgttctggggcgtggggatcacagagtctagcgggggtcctttgaggcctccagagcccacctactctcttctggttccagggatacacactagcctacgctaggcggggtccagggcctggacctgccctggggcaggataggggcctaggcctgagagccaggcttccactcccctcctatgtgccctcaccaccctctgaaccctcatctccctggggtcccggacaactcctatcaaagcccccgggatgccagacaaactcccaggcacactcgtctcctgggttctgatcccacccccagggctcccaggctcctcccccttgcatcctggttccactctcacactcctccctaccctggctctgcccctagttcccaagctctcatcctaggctgtgatttcccttgctagaccttttcccagggtcctggctctgtatgaccagggacctgtctccctctctaccaggaccctaacactgtcgcagcctcctccctccaccggctgcccaagcacccacccccagctgcccaagcacccccacttctgggctggcttcagcgcagagccctcgaccacctccttgggggtcctgacaccctcagacactatttctcagggctctggctgcaccccagggcgctcagactcctcccccagacacgcccccacccccacctggagggcgcgagcccctccccctgggcctctggctgcgcccagaaaactcaagccccttcctacctggaccttcagctggcaaaagtgcagggcggagagaatcagggcaagcgagcgtggagtcttctgagcaggccggggaggggcctctgcggggcgaacggcctcggcccggcgaggagcgccgcggtggagacggggtccgctggcccgagagcccccgcaggctgcggtcggacgctgttggacgcaggctgccgctctcagcgtcagacaggacggcctgagggtaagggagggaagcaggaggccgcagagttaggaacttcggggttagctggcaaaaacgaccaggggaggctgggggccgcctcatcccaaatgctcccgcttacaagaagccttctgatttcacctcctccactagctcagtcctcagctcgccgctgaggcatcccatttattgcgaagacatcatttggcattgctcacaggtgggctccgagagggccgtgcctcccctctgagactgggggctccccagggcagaggccgggtgagctagcaggggtgctgagcagctacagcctgggtcccagggccccacccatctgcagttcaatccgaagccaccgaaaggcgaggcgggggagcccaggaccgcctggcagggccctgtcttcccgcctttctgggctcacacctgtgccaggtcccttaggctccgctgtagcccctctccatcctctgtctccagggccgcctgctcctgtagccgcagggattcctggagtgcggtgagggagacaaagagtggtcggggttctgtcttacctgaaacctcccctttccctccctccctggcccaccactgatcaggtggcctctgaagccatgtccataggccagccacctggtagaccccacagcaggcccgaggccctcaatgaacagaccaggcccagagaagagctgggttctgccccaggtcacacagtcgattgcaggagagctggacctagaacccaggccaggccccacacagaggggtgactaaaccaggctggaccctgggggagtgagtgtcccactggtgggggtggacagttgggattccaaaggcagcatctggacctggagagcgtggatgggagttcaagtcccaactctcctgcttactggctctgagactggacaagcatttcccctcttgggcctcagtttcccatccgtgtcattaggattactctacagggctgctgggagggagaaatgggatggaggaagtgagtgtgcttcccacaaagcctgcacacctgtgtgggctgaacctgagtgtgagtgggatgctgggggtggcccaggcagcccagccctaagcctgtgtccatggatctggccggtaccccatcccaccctgccccatctcaggggcagctgaagctcaccagggcctcaagcttctcggtgaggtccttgtcgacctgatccttctccagattctgcttctgtagacgcttcactgccaggcccagctctgtcactctggagttgggggagcaacagaggtgaatacgggaccaccccagcctctcaaatccactagctctgtgtccaccatgcttctccaaacccgaggcagggaccctaacatccacctccctggctgtgtgaccttaaacaagttgtggctcctctccagacctcacacttctcatctgtgaaatgggaatgaggttcccaccagctttatctcatgggaaagcactggaggacttacccaggtggcaggagtaaggggcacaagttgtttttttgtggttttcttttgagacagagtttcgctgtgtcgtccaggccggaatacagtgatgtgatcttggctcactgcaacctccacatcctgggttcaagcgattctcctgtctcagcctccctcgtagctgggattagaggcacacaccaccacacccgactaagttttgtatttttagtagagacagggtttcgcctattgggcaggctggtcttgagctcctgacctcaggtaatctcccaccttggcctcccaaagtgctgggattacaggtgtgagccacagcacccggccacaagttctgtcataggaggctaagctgtttatgataaacactgggcaactgccttcggaacctcagtggggtgcctgggaaggctggctgagctcacagaggaaggccctgctcctagtgaacagatgctcccttctccccaactctccagttttaccttctgcagtgacgcctgcctcatgcagcacccaccagggaccctcctggcactgaggtcagccttgtccaggtcgctttgcatctgctgctgggacaggtccttctcgtggagcaccttgtcccgcagctgctcctccagctgggcctgcttctccagggctggctcgacccggctctctgccagccgcaggcctgtgctcattcccaggccggcctcctggacagctcccctcccagctgcagcgggtcccttgggaagagaacacaggatggggatgggatggggctcactcccaactacaaattaaaactagtctggggctgggtatggcggcccacacctataatcccagcactttgggaggccgaggcgggcagatcacctgaggtcaggagttcgagaccagcctggccaacatggtgaaaccccatctctaccaaaaatacaaaaaattagccaggtgtggtggtgcactcctgtattcccagctacttgggaggctgaggcaggagaattgcttgaacctaggaggaggaggttgcagtaagctgagatcatgccactgcactccagtctgggcgacacagccagactgcgtctcaaaaaaataaataaataaaaaataaataaaactacactgggctgggtgcggtggcatgcacctgcagtcccagctatgcgggaagctgaggcaggattgcttgagcccaggaatttgaggccagcatgggaaacatagtgagactccatctcaaaaactaaagaggaagaagaaaaaaacaacaaccctacactgggatgccatttgtccactatcagattgggaaaaaaaaaaagggacacataatacacaaagagaggctctggggcaacaggccttcccctacacagctggtgggagggtgagtacaatcacaatggagggcactgagggagatcttcgaaaactatgcaggcataggaccttccccaccggctcctcctctaagaatggatcctacagatataccccagcacagaggagatggcttgtggacaaggaggttcactgcagcattgctcatgtaagatatcctggtgacaacctaaatgtctatcaaaaggggactgctactaagtacatgatggtacatcctttaagtggagaactgtggccaagaaaaaccagtggagaagttcttcctggcctgatccagagccacctcccagttataactagtaggtgaaaaaagcatcttcaagaactgtgaagatgaaattttaccaggcgtatatacaaaaaagtgtgtgtgtgtgtgtgtgtgtgtgtgtgtgtgtgtgcgcgtgtgtgatctcatttgctcatataaaataaccctggaaggtcacttaagaaactgataggccaggcacggtggctcatgcctgtaatcccagcactgtgggagaccgaggcgggagggtcacctgaggtcaggagttcaagaccagcctggccaatatggcgaaatcccgcctctattaaaaatacaaaaattagccaggtgtggtggctcattcctgtaatcccagctacttgggaggcggaggtgggagaatcacttgaacccgggaggcagaggttgcagtgagccaagatcgtgccactgcactccagcctggagactcgcagcacagcgagactccatctcaaaaaaaaaaaaaagaaaaaagaaaaagaaactgacaatgcttcttacggtaacttggtggccaaaaaaaaaaaaaaagaaagaaaataattgtatatataaaaagaaaaagaagctgatgatgctgcttgcctccaaggaaggaatgggaatatctggggtcagaggtgggagggagccattttactgtgtacccttttgaaatgtgaataggtgacttcatcaaaagtaaaatataaaaatttgaaaggctacttacaaaatttttttttctttttgtttctttttcagatggagtctcgctctgttgcccaggctggagtgcactggtttgacctcggctcactgcaacgtccgcctctccggttcaagcgattctcctgcctcagcctcccgagtaactggaattacagatgtacgtcacaacacccagctaatttttgtatttttagaagagacggggattcaccatgctggccaggttggtcttgaactcctgacctcaggtgatccacccgcctcagcctcccaaagtgctgggattacaggcatgagccatgacgcctggccttaaaatacattaaaaattatttgtattttaaaaaattaaaatgtattttaaggccaggcgtggtggcccatttcttgagacatagcaagaccctgtctcaaaaaaaaaaaaaaaaattagctgggtatagtggtgaacacttatagtcccagctatttgggaggctgaggtgggaggatcacttgagcctgggaggtcaagcctaacatgagttgtgattgtgccactgcactccagcctgggcgacagagagagactggctcaaaaaaaaagtattttaagtccataatacaggttaaatcctttcctttcctttcctgaatgacctgtaccactggttatccaatagtaaggagggaaagtgcctcattatagaattctaattaatatacacaggagtgactaaatgagaagctcacagttttgcagcctctaatgagtgggttggatcttgaaaagagagacagctggcatagggacatcctgatggaagaacacattctacttatggagtcttgatcaaacgaaaaagcaagcagaagagcctgaatctgacctagctttacatccaacatccaatttacaggaaatacatgggataaagaaatatgttaattgacaccataaggatgcaaccagcaaaatccagaccatgagaatctccaaggacaactagcccagtttcctgaacaaataagttaaaaaggacttcaaagacaaagcatgggccgggcacggtggctcactcttgtaatcccagcactttgggagaccaaggtaggtggatcacctgaggtcaagaccagcctggccaacatggtgaagctcccatgtctactaaaaatacaaaagttagctgggcgtggtggcgcactcctgtaatcccagctactcaagaggctgaagccatagaattgctgaacccaggaggcagaggttgtagtgagccaagatcctgccactgcactccagcctgggcaacaaagcgagactccatctcaaacaaacaaacaaacaaacaaccaaacaaacaaacaaaacaaagcaaccattcgcactttgtgaatgtctatggatccggattcaaacaaattgtaaagaaaaaactaaagcaagactatctgtgactttttatttatttatttattttgagacagagtttcactctgtcacccaggctggagtgcagtggtgtgatctcgactcactgaaacctccgcctcctgggttcaagcgagtctggtgcctcagcctccccagtagctgggattacaggcatgtgtcaccacacctggataatttttgtatttttagtagagatgggggtttcaccatgttggccaggctggtcccgaactccagacctcagatgatctgcccgccttggcctcccgaagtattgggattataggtgtgagccactgcacctggcctatctgtggcatttatgagacatatggaaaatttagacgctggctatttgatgatattaagaaaagattattaaaccaggtgcagtttctcatgcctgtaatcccagcaccttgggaggccaaggcaggaggatcactggggcacaggaattctagacccgtctgggcaacaaagtgagaactcgactctacgagaaataaaaaaatcagcaagcctggtggcatggacccgtggtcccaactgcacaggacctgaggtaggaggattgcttcagaccaggaggccaaggctgcagtgagccataaagaaaagaaaagattactaactaaaagtaagtccttgatatcagccagatgacactaaatcccatccattcccctgagctcacaggggggctgcctagactccagaaaaaaggctgtgcctagtcctagactctggcatgcaggaggtcagaaggctgaattctccactaaactcaaaagtataaccagtccagactgggtgtggtggcccgtgcctgtaatcccagcactttgggaggccgaggcgggcagatcacctgaggtcaggagttcgggacgagcctggccacatggtgaaaccccatccctactaaaaacacaaaaattagctgggcgtggtggcacattcgtataatccccgctactcgggaggcagaggcaggagaatcgcttgaaccttggtggggcagaggttgtagtaagccgagatcgtgtcattgtacttcagcccgggcaacaagagtaagactctgtctcaaaaaaaaaaaaaaaaaaaaagtatgtggccgggtgcggtggctcacgcctgtaatcccagcactttgggaggctgaggcgggcagatcatgaggtcagtagttcaagaccagcctggccaacatggtgaaattgcgactctactaaaaatacaaaaagtagctgggcgtggtggcatgtgcctgtaataccagctacttgggaggcggaggcaggagaattgcttgaacctgggaggcggaggttgcagtgagccatgatcgcaccactgcactctagtctgggtgacagagcaagactccgtctcaaaaaaaaaaaaaaaaaaaaaaagtagccctctctaagtcttaattccttcatctgtaaaaacagaataatgacttatgttagagatgctgtgaagagcccagggaataacaagtgctgtctgcataccacataacctgtccgctctcaaaggtggctgggctgatgatgtctggaagaagaaggctgggagaaatgctggttcccaaagtggtcagtaccaaggccacctagtccaacccttgcccctaggcctgtggttcctttggggcagattccagtctcgccaccacccagccaggggagtctgtgttgaatgggccatgtcctggaagtatgaaaggctcagccctctgagctgctggatggctctgtcctgtacccgccagtccataaatggtcagcagagcacatggcccacctacccgagccaaaggagttgggaaaaatctgtctgggtggccccctcatcctctcaacacacaggcctagagggaaaagggtactgtctaatgccagtcagtgctgtcctgagctcagctgctaagaatagcagggagtgaggtggtggtaaccagcaggactcaggcagaacagaggcccattacacacctggctgcccacaggctgccaccacctgctcttccacctttcatgccagttcctaccctactcatccacacagacagaaagctctggaaggggacgaaggtggcacaaagcaccctgacaaagtagccactacccaggctcagggatcacatattcccccagtgtaagccactcccagccctgagctgtaggagcagagatgcacaaaggcccctccccactgctgctctgtcccaggccaaggccaggtggtggctatgcagtcggggtgctcagctagtagcatagaaggctaaagccaaccccatctctgaataccccagtggaccaaggataaaggagcctttctcaaaagcagttacaggccaagcatggtggctcacacctgtagtctcagcactttgggaggctgaggtgggagaatcacttgagcccaggggtttgagaccagcctgggtgccacagtaagaccctgcctcttaaaaaaaaaaaaaaatttagctgggtgctgtggcatgtgcttgtggtcccagctatgtgggaggctgaggtgggaggattccttgagcctggaactttgaggttgcagtgagctatgactgggacatagcgagaccctgcctcaaaagaaaacagttcttaacaagcccacacttggagtggctactcttgtacctgacccccaaagtcgtgtgcctgatcctgagagcagactgcacatatctgtgggcagtcggcctgagacagccaccactgagtgcctacagcacggcccatttggccaagaccagcaacttccctgacctttttggatctcctaggtcccagttcagggccctgaatccccacaaccactgactgacggccctaccacctgctgtctctcctggcggccacagcagcagcagcagcagcaggaccatctctggtatcacatgaggtagggatcagatggctctgagaacaggccaggactgagtatggggtgggggtgggcaggaactctctgcaagcaggcactttctgaccaccacaattgcttaaatagaacaggtaatgatgctgccttttggacctgcctaaagagcagaagtcgtaaaagacagaacagctaaggctgataagggggtgagagacagggacaaccgtgcctcactgcagggacggagaacctacttgatcctttgaagaagtaatctggcaacagtcttaaaagtgactgcagttcaaacactctagccacacgactccagccctgggcatcctcacagcattgtttacaaaggcaaaagtccttccaaactagggcacttgtatgggccacagcagaccccctggccctaaagatgctcagtaagatacattgataatgtggaaaaatactcacgggataacatttgataataaaaataggatgcaaacttctggaagtgagggacatgtccattaccttgatggtactgatggtttcacgggttttatctatatgttaacacttatcaaattgtacactttaagtgtgtgtagtttattgtatattaatcatagctcaataaaaatgttttaagaaaagaactgaaggtgacaaatttttttaaagttttctatacagcataatctgaactacatacattataagataaacagacatgaagttaaaaagcttctgcatagcaaagtaaacgatcaacaaagtgaagagacagcccacaaatgggagaaaatatttgtaaactacccatctgacaagggattaataaccagaatatataaagaacgcaaacaactatataggaaaaatactaatagttccatcaaaagatgggcaaaagatacgaacagacatttctcaaaagaagacatacaaatagcaaacaggcatatggaaaggtattcaacgtcactggtcatcagagaaatgcaaatcaaaactacaatgagatatcatctcaccccagttaaaatggcttttatccaaaagacaggcaacaacaaatgctggcgaggttgtggaacccctgtacgctgttagtggaaatgtaaattataatagtgcaatcactatcgagaacagtttggaggttcctgaaaaaactaaaaattgatcaggtgtggtggctcatgcctgtaatctcagcactttgggacgtcgaggtgggaggatgacctgaggctaggagttcgagaccagcctggccaacacagcgaaaccccatctgtactaaaaataccaaaattaactgggcgtggtggtgtgtgcctataatcccagctacacgggaggctgaggcaggagaattgctagaactcgggaggcagaggttgcagtgagccaagatcatgccactgcactccagcctgggcaacaagagcaaaactccttctcaaaaaaaaaaaaaaaaaaaaaaaaaaaaggccaggcacactggctcacgcctgtaatcccagcactttgggaggccgaggcgggtggatcacgagctcaggagatcaagaccatccttgctaacacggtgaaaccccgtctctactaaaaagacaaaaaattagctggacctggtggcgggcgcctgtagtcccagctacttgggaggctgaggcccaagaattgcgtgaacctgggaggcggagcttgcagtgagctgagattgcgcccctgcgctccagcctgtgcaacagagcaagactctgtctcaaaaaaaaaaaaattttttcaaaaagaaaaaactaaactaaaaattgagctaccatatgatccagcaatcccactgctgggtatatacctgaaagaagggaaatcagtatatcgaagagatatatacctcaaagaagggaaatcagtatatcgaagagatatctgcattcccatgtttgttgcagcactgttcacaatagccaagatttggaagcaatctaagtgtccatcaacagatgaataaataaagaaaacacggtacagatacacaacagagtactattcagccataaaaaagaatgagatcctgtaatttgcaacaacatggatggaactggaggtcattatgttaagtgaaatgagccaggcagaaaaagacaaacactgcatgttatcacttatttgtgagagctaaaaattaaaacaattgaactcatagaggcaaagtactggatggttaccacaggcttggaacggtagtgtagggcttgtggggagatggggatggctaatgcgtacaaaaaaatcgaattaataagacctgtctggtagcagaacagagtgactgtagtaaataataattgtacatttaaaaataactaaaagagtataactagattgtttataacacaaaagataaatgcttgaggggatggataccccatttaccatgatgtgattattacgcattgcatgcctgtgtcaaagtatctcatataccctataaatacatatacctgctacatacccacaaaaattaaaaattaaaaatgtaacacaaagaaagaaaacagaaaagaatcgcatttgaatagtcatgttaaaataacaagatagcaggtgcttttccttctttttttagagacagggtcttgctctgtcacccaggctagagtgcagtggcatgcagaggccagctcactgcagcctcaacctcctaggctcaagtgatcctcccacatcagcctccctaacagctgggactacaggtgcacaccaccatgcccaggtaatttctgtattttattgtagagatggggtctggccatgttgctcaggctggtcttgaactcctggactcaagcaatctacccaccttggcctcccaaagtgctgcgattacaggtgtgaaccactgtgcctggccctctaagtttctgctaaaatgtacttgtaacttttacactgactacactcaaaagtattaaacttgtaaagaaaaggccctggaggagtttgttctttacaaggtcagtcagaagctacaaggggccaggctggggccaaggtgagggcaggtacatgcaggggcagatgctgggtgtggagtaggtgccaggtgctagctgggcatgaatgtgcacccgctccctgacctctgctccctgactctcacaaggaactagcactgcctggagacaggaagaagcagcgtacggaaggcagactctctggccagagatctcgcagccaggagcacagtgagaacagagcctaagcctatctgtccagagcccaggctccctttccctacaactgcagcctccttattctgctctggcccagcagagtgaggaggggccgcccacccagccatacctgccggtggctgctgggggtgcatggtcagaagaggaaagatgcggttcaggtagtcattcagcagcttctcctgcacaatgcctgagccacaagtcagaagggagaaaagggccacacgatgagtgcagctcctggcccctgctggccccagagacttctggtcctaggccagccacaggtgcagcaaggcctgaggcctttgtcccttccttctcctcccaacaagaggagcctccttccttctctgccagcccttacctgtgaccctggatttctcagcatctgaggtcagcctacagctcttgcgggagaaagacacgccggcccccttggatgccatccttcgtctctcatgggcagccagtggtcctggaggctgaggcagacacagagcctgtctactcagggccagccaggggcccccacacctgacctcagtcctgccatggcaggaagtcttgggagcaggtgaggccaggggcatgcacactaacacataggacaggggaatgcaggggctcccagcttcctacacaggcagggtagccagggtctaggcccatgtaacagggaccacttcttgttctccagtgtccctgtgcccagcacagggctgggcagagagcaggtaccagatatatttttgccaaaccataacaaaatgtctcagctctgtggaaatcagaccaaaatgtccaaagtgaggtgtcctaggggcagagcccctgtattcatctcggttgtaagccatactgagtccagctcacaaccagaagcgacaatcctacacattcccccaagtgcagaccaccactggtctggtcatctctagccataagtcccacttactccccacaaggctggagcctctttcctcagccctgggttcctcccttcttttatccatggtcctgatagtttcactgttcccactcacacatgtggcctcccacctcatccaagcaccacccttgcccagccctcatggcaaactccattggtcctcctagtgcatctatccctcacatcatgttgctgctgcagctgctccaaaacctgcactgagtccctggtgctggcctcactgatgtgtagctgtgctgtccaacacagcagccgtcatccacgtgaggttacttaaatttaaagttttaaaaattaacaattcgatttctcagttgcctcagccacatttcaagagttcaatgaccacatgtggctaacggttactctattggacagcacaaaggtagaacattcccaccatcatataaagttctattagacagcgcaggtctagagtttcgctctgcagcactgccttagccagcactccctactctgccgttcagtctcttatctcgccccaaacagaccctctactcccgccacaaacccctgtgggtctgcaccacgcctgctcctcgggaaggtgattttcccgacctcgggccctcggtgggcctccatgatcggtgccccttcactaccacagtagttgaagatctgattaaatgcagtcattcatttgatgagcagaccttccagacacccactccgggtgtcagttgctgaggacccaggtgagaggcggaccttgtccccgcccggggactccctgtcacggctatcccgtccaacctcgccggggtatccgggctcagaactgaacctactccgtctgggagcccaaggatggctcccccaagtcgcccccgcctggccccaagctccagaggacctgccagaccagcttccgctcggagtttcgcactcagatcccggcgctgcaggtgccctcgcagtggactaaactggaccgcgaagggaatagccggaacccgccaggctcagagccctgccgcccctcactcaccccgagcctcggccgccgcgacccggttcacaacatccgcccaacctctcggctacggcgtccgttcagggccaaatcacgcgcacgctcgcgcgctgagcctccagccgcgcacgcgcaccggcccgcgcccagcctccgctaggggaccccctccgtggcttcccaccgggttgttccaggcctcagcttcgccgaaaggcctcaccacctccgacctccgcctgccccggggatgctcccagccctgctgcggcagaacgcgacgtgctaaccggaatccctaggccgcctgtctcctacccatacttggaggccccgctcagacggtcctgaaaacgtctgaaaggcggttcctgccagagtccctgctacctgttacctccacccctatttagtcctagtggacagcttcgctcaccttccctgggatgacacttctggcggctgagatgagcgagcctctctgggctctgccgccgggcgtgggctgacctgcctacagctggggcctgataaggcagcagcaaaagggtggaggggaggcagtgttgaagctggggcaagtaattttccccaatttacagggaaaaaccgaaattcagaaaagtttaatgtcagccaggggctggaacccagacctctggcagctgtcactttcacaatgcccttgggctgactaggctgcagaggggtttcaccccaaccccagggcacctcaagtggccccaccaaaccttcctaacacctgaccactaagtagggaggcctctcagggggctagctgtgctaggcccttgcaactgacctgtgggacctgaggcctggcccctcatggctcctgtcaccaggtctcaggtcagggtccagcaggccctgagctgacgtgcggagccagagccacccaatcccgtagggacaggtttcacaacttcccggatggggctgtggtgggtcacagtgcagcctccagccagaaggatggggtggctcccactcctgctgcttctgactcaatgcttaggggtccctggtgagtgcccccaaccttgatccccatctgccttcaggaggggcttggccccattctcctattctgggatgagaaaaaagtcagggagccagaggctcagtgggcatggggcagtgaccttggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgcctttgtgcaggtgagagcccagctttggagtctgaatgcctagccagggcccctggctgggtaatgtgatggctctgagccttagcattctcatttgagagatgagatggggcaagctccatcacccactgctctcacagagcgtgtgtgttagatctgagcccggtgcctgggccactacacagaggcaccggtgataactaccaagtctgggcctgcttcccaggggaaattttttgacaagtatctgtgcaggggggctagactggcccttgaaagtgcatacagggtccatcccagaagccttgtagctttgatcccctgaatgaacaaactgtggacatgccaatacacattactgacatgtatgcccacctgacctgcacccactctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccggtgagtggccactgggcatagataagactgggggcaggggagcctgggccgtggcgttaccttgtgccttcttctctccagggcgttccactacaatgtgagcagccatggttgccaactgctgccatggactcaacactcaccccacacgaggctgcggcattctgggcgctgtgacctcttccaggagaaaggcgagtgggggtggagaggggcagggtgggagacaggggacctcagcccaagttgatcttctgtctcttgctcccagactacatacggacctgcatcatgaacaatggggttgggtaccggggcaccatggccacgaccgtgggtggcctgtcctgccaggcttggagccacaagttcccgaacgatcaccagtgggacaaacaccttccctccgtcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcggcatcaaatcctgccgggtgggtaagcggcgccgggtcaagctgggagagtggagggacaagcccacgcccatccacgaacccactggctctttgtctccagccgcgtgtgtctggtgcaatggcgaggaataccgcggcgcggtagaccgcaccgagtcagggcgcgagtgccagcgctgggatcttcagcacccgcaccagcaccccttcgagccgggcaagtacgcgtaggcggtatcggcgccctgggggccgggctagggaaggtccaggactccaggggcagggctccgtgtagggcaactgggcggggccagataagccagagtcccagggtcttcttcacgccccattaccgcccccaggttcctcgaccaaggtctggacgacaactattgccggaatcctgacggctccgagcggccatggtgctacactacggatccgcagatcgagcgagaattctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgcgggtccgctgagacgccgcacaagccgcagtgaatccctggtgctcccggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagccctcaccaccaaaggctggctcccttaaccgcagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagaggtatgtggacaacctgggagggtgtgaggtggggctgagccttgtggcctcagaccctgagtgcccccattcttgctaaagatctgtgaccctgaaccagcgtgtggccctgatctgcctgccgcctgaatgatatgtggtgcctccagggaccaagtgtgagattgcaggccggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccagggccctcatcagttctcctacctgccagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctagtgcagtttgttttcatggtcttaatttttgctaagactccactgcttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaggagctgtttttctcctttctttcccccggcaatatttactatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaaggggatgcctatcaattaattcatttagagagccatacaccccaagaaataaattatttgtcctctggagcttgtcacagggggatttttaaaaaaacattaaacagaaagacaactgtgcatcttagaaagataaaaggccaattcttcctctccggctgataggttcttaataatagtgatatctactaataagatgttttacatagtgtaaagcatgttcacatacaaattacttagcctctttgagcctcagttttcttatatgtaaagctggattaatagtacattttgtgtttaaaaagatgatgtatatgaagtgtttaccatttttcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggctctcagaaaatattctcagctattctgttagcttgatctcctaccatctgagagtgggcttccttcaaacaaccaaatttccaggtatttctaaactgcccttcccctacaccattctttgattcagtatttcaagacccctaagagaaatggtacatttacgtgtaagcacaggatagtgaagtatttacaacaagtgctttggagccagcaaatatggatcagaatgcagctttcctttcctacatacatgacattgggcagctaatttctaagattttacttctttgtctatgaaagtggagtactagtacttgctttgtgcaactctgatggttgttacatgaggtagcatctagaaacagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacgcaggattttctataaccctctttctgctttgagctcctaaaggtatttcatagaaaaatgaccttatttttaaatagagggggcagttgaaaatcagtgaacggacctaccccctaatgatttttttctcagacataattataataattagcattataaagtgctaattatctttggacacagaggacctgcacaccagagacagaggtccgcattaagtaaagtgaatttcactttcttcagttgtgagatttctcttttttcttctttgtaatgatgcaaagatatatcatccaccaagcctcatttaaaagctttttccagttaaggaaactatctcttggccatccacagccagactccatattgagattatggatattcaaagaaattgtctttcccttgtatattgtcataactttttgtgaaatgttcgttttatagttccaggccagcacctagaaccttgctagaataaaaaactgcagaaatcatgagtttctagtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgtaaaaaaattagacgaggaatggggcattggtgtaagattatacagagtgtaaagttgggctttctcttatcatctgttgtcaacaacaggatgattgttactgttacccactccttaccatcattcacacagagacattggatattgaggagagactttaaaacagaatattagtaatgcagagctataaagagccacgatcatattaatacaatcctccatacacatagtgacctgtctgcagctccagcctagagaaacccagttattcatttgtagtgggcagccccattatcagaaagcgctattcaattggaagtgctcatctgtgttaggtcaaaaacgacttcctctaaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttttggaatgctttagaaatttagcagttatcttttttatgtattttacatttgttacagctttccttggtggacagatatgagttttctacttgaaaataaacacgtttttctttaaaatatcattaaataagagtgtaattagtgatataaagcaagatgactaaaaagaatctctcattattatgtttgcacagcctgtatagaaattatttgaactagaaaggatttgctaagtaaattatttctatttccctcacttaatagtgaatattatggtgattaggggaaaaaataagctttcttttttcttttgagatggagtctcactctgtcacccaggctggagtgcagtggcgcgatgtcggctcactctgtcacccaggctggagtgcagtggcgccatctcggatcactaagccatctcggcctccccagctcaagtgattctactgcctcagactcccaagtagctggaattacaggtgtccgccaccatgcccagctaatttttgtatttttagtagagatcaccatgttggccaggctggtctcgaactcccgacctcaagtgatccgcctgtcttggcctcccaatgtgctgcgattacaggcatgagccaccacgcccagctaaaagaagcttttctgatagtaactttgttttcccattctggagtttatggcagtatgaaaaagactgaatttataagcagaagatctgtttttgaaatccggggacctgtatttcacaatggctttgatgtgttttgattgtgcacctttagacaacttatcagtttcctcatttttatacagcaataaaatagtaacagctacccattaaattctgtacagaagctagggacagacgcaataacacttgcatatctataaaggctttgtaaatgtgggtattatatctaatgtttatgcacatgctgtttgattattttcatttggaattccactccattaaaggaaaagtaacatacgaattcagattcttgtaagtcttcaggcatgaggcctccattgactaagtacattgcctacataatttctcctaacccaaatgaatctccagttaaaccaagctggtggttatgtactgtctccagaggatgccaagcataaagtccttgagtatattcatcttggatcctctgattggacaactgcggtattgagacttcaagttcccccttgaaggccccagacggtacctgtaattttactcaagttttaaatgtatgctctttgttaagaaagagtgacaatgatttgatttattttccgtgactggggttagggatgggggagactctaggaatgtgacttaccagtgaggttctagttttataaatcataggacaagttttgataggcaaatgttggactatagggctgaggttgttttccaccacaacatatagacttctactagcccttgaaggaaaaaacacgagaaaatcagttgggtcagctgagtattcctttacgagtatggaacagacttacataacaattctgcaggtaatggctctggaaaggtcaaccacttagttttggacaactcttttctattctgtataaccactttttcaccaaaatgatactaaataaatatgctataggaagctatattttgacatgactgttttaggcaaagatacactcaccaacttactccacaagagtttctaatcagagaatatcatatggatctatttgaattgctcccatgcttggctgagcccaaaataatttactgtgcatatgtacaccaagtgagaaggttgaggaggtgtcacttgtacatctctttattcttttttttttgtatgtgtgtgttattttcatgtgttttgaaaggctctcttgcttagcttttattttgccattaaagatttttttctgtgctataactgtatttttaagtctggtttgagttcaagaaatccacaaattcacaaaagattaggaataatttgtgaacaaaatgatgcagaaataaaaaatgcattttccaaataactcccttgcagtccttctcgcccaactaccactttctattaagtttcttcttcctactctatgaagtgccatgagctttcaattcattgtattttaagtataagctatacttactaaccttcacgttattctttgctacttaaataagcttgctttcatagttcaattgacgtattgtttaactgatatttttaattggtatattttgatatatattgataattgatagatacataattcatttgagatattttgggtatggagggttggaaggaatcctttcataatttttctacttaaaagaaatcttttttcatttaacagcttttcccatggggatagagttttcatgaataaagcaaagtcattaaatgaggtatatggtacatcttttaagagtcacagaaagaagcaacaacaatttacccaggcagagggtataagtttagaccttggttgcctgatttgtgggacaagttctttaattttttttctttatattttgacttttttttggactctctcctccccttccaggctccaggtcaaatacttgacacctgaatgatgttcaattatttaaaagatggattggccagctcagctcctgtctcagacagactgtctttaaatgtattttcaacatgtcttcagacagttatttttcctctgttcaattttgttcatcttcttacttaaccgttcaagtgctcctatttcctttttaaatgtagtattgagaagtgcaaacattattggaaaagagagtctcactagcataattgtgcattatcttcctcttatatcgccggcctccctgcacccccatgcccacctcctcctcgcgcctccatgccgcctcccactgctccagctccttgcagctgcgagtccagtcactggtcacctttcgtatctcctcactcagagcctggttggccaaacctgcctggtccagctgttctcagagcatggcattcacctgggccaggctggcactcctgaatggggcacaggggatcagtaggcgctcgcccagggggccatgctgccagccctggccctccctgctgctcctcctccagccagatgagggcactctccaggtcttggctgtgctctgcgtcctgggtggcacagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcgtctccagctcaccagattgcagccacagagcctgctccagctgcagggaagggccctgggtgagagtcctgggcctcctgggaaggcaggctcaggcctctgtagggggtggcaggctgggcccagacccacaatgccttgtaggctgatagcctggcgccctggggagcagcacatgtgggcaagcccaggggcagtgcacgtgtgcatggggtgatgcagccatgcacgggcacgcagatggggcatgcatggacacatgcaggtgagcccacaaacccaaaccatgcaggcaaagctcaaaggtgcacctggggtctacgtcaggggcctcagtacaccatgcgcctctcctccagaacacttagccctgtcgtggtttctgtttattacattgatgcctgtgtcttcccaccatgcccccaccccagtgtgagctcagaaagcctggattttttgttcctcattgtatcttagtgctataatggtgtctgtggaatggcatggctcacgctcagtaaatatttcttgtgatggtgaattaatggcatgagctcatgggaatacattcaaacagaggtgtcaatccgcctatgcatatctgagcttaaaaatatgcacacacataacacatacaggcaacctcaaacatccccagggggacacgaaggactcccctcatatacacagcattaagatttgtaagaggtgcacacagatgttgccctatacggcgcctgcatattaatgcccacttctggctgggtgcagtggctcatgcctgtaatcccagcactttgggaggtcaaggcgggtggatcacttgaagtcaggggttcgagaccagcctggccaacgtgatgaaatcccgtctctactaaaaatcgaaaaattagccgggtgtggtggcatgcacctgtaatcccagttactcaggaggctgaggcaggagaatcacttgaacctgggaggcagaggttgaagtgagccgagatcgcaccactgcactccaccctgggcgacagagcaagactccatcttttatttatttatttatttatgtattcatttatttgtctcatgggctgagcgaggggaccccggctggtggagggacagctgcgccctgcaggccgctgcgtccgggcagaccccggcctcttgtcgtgcccccggcccgcgacaacccgggcaggatgggcagcaggacgcggcggggcatccgcggagcccgtcgggaacgctctcttggcctccggtgccgggcagcggtgggtgcggcacccacagtgcccacagcgcccccagccctgggacgtggctccagcccgcccccaggcaggcggcctccttcgccgggagcacgtcgcctgggcaacatggagaaacttcaactcttaaaaaaacaagacagccaccacaacaacaaaaagaacagatataagccggctgtggtgactcgtgcctctgctactccagaggctgaggtgggaggatcgattcaaccaagatacagtgagactgtctctcagagaaaaagtcaaacaaacaaaaaaagaggctgtgtaagaggtgactctggggacagtggaaaaacactaaggttttcaagtggtgttaaaagccactaggccttggggaccattgagcaatctacaaagcacggaagcctagatccctgagctctgcctgccaagtaccaccacagctaacatgggagacctccccgacagagactgaaatttgcctcccgaggaaacaagtgactacagacatctgtcccaggacagtaaacaagaaagcaaggtctcacaaaaacaaaaacagctgaccacagcatacaatcactgagaccgagcctgcgactataggtgaaaaaaaaaaatgctgtccattattcataccatgaaagaccaggggaaagtgggaacgcagtcccctactactgttgtgggaatcaggagaacagagagaccaatgggtggaacaggaggatttattgactgcactgaggcccagcagatgaaaatccaaaggctgagccccgaacaaagacagggcttaactttatagacacttctgaaagggggtcggctagtttgaatggcgcggcgggaatttgatggcatgaaactcgggggcaggcaagagggcttatagaagcagaacaaaggcagctaatcaaactgtcacaggtcttgcaatgcaagtatagctggtgaccttgcagctgcactgaagggaaatcaagaacttaacaaaacttgaataattagaaatgggaagggggaaagagaaggtagtaaaggcatttgttgttttttcctcttatctttgttggggcttactgtgttgagagagtctccggaactcactcctcgcggctctgacttttcagatcgtgttaccgaggatctactagggctctatctatggcaggtcttggagtcagccaagtacagggaacctgtcttttccttttaacttctgccttattactacaagttgtacagcacaccatgcctggttttcatcagcaatgtttcctgaggttacagaaagatttctaatcctgggaggaaacactcccttgaagcaaaagtgttctcccccaaaaaatgcaaggagctatcttctagatagccaggcagataattctcaggttttgccccacagaatctctatctaaaatacagcagtggtcatgcctagtgaaaagtttgagggaactcgcccagtgttgggtttcttcagagccatatatatagatataaccaaatatcctaaaagacactgcccttcatcattccatgctgttagacatttacaggaccatggatggtgatctcctccagacaaaaataaatgctggtgcagaataggtaagtgtattataatttgaggacatcagcttttgggcattttaaaccatgggtcagacatgttagagcaagaggccaggttgatagcaagagggagtgtttttcttttaatttgtcaatagcaaagtgatgtttgccactgtgatttcagagtgaggtggcaatttgttgttgtttggttttgtgggtttttgtttgtttgtttgtttgtttgtttttgagacaaggtctcactgtcacccaggctggagtgcagtggcatgatcagggtttactcctgccttgacctcatgaattcaagcaaacctccttactaatcctcccgagtagctgggattacaggcacgtgaccccacaccctggggtgtgaactgggatttgatgttttcagttggctctctaatggaataggttcccttactcttgtagaatcagattgtcttcatgattatcattcttgtgtgcattatatttctactaccctgctatttttttttctatttttcttttttctttttatttttttctttgtgagacagagtctcgctctgtctcccaggctgtattgcagtagcaggatctcagctcactgcaacctccacctcctgggttcaagcaattcttttgcttcagcctcctgagtagccacctggctaatttttgtatttttagtggagacagggtttcaccatgttggcaggctggtctcaatctcctgacctcaagtgattcacccgcctcagcctcccaaagtgctgggattacaggcatgaactaccacacctggctctcaaaccattttagttaagcaaagacagatttgtctggctttttagtacaatgctgaattatcctccaatctatatttttaggaaggacctcgggaatggcaacttggagatatttggtgaaaatgtgaacctttcatgttctgcttcagtccctttttgaaaatccttccaatttaccttttgcaaccagttagtggccttcccttcttcaccagcatgtgagttaattgataaagatcagaatatttgggctcaaaggtttcaacagttaagtcaaattttctgccaaagcctacaggatcttggagcctgctttagaaacagaagagtgaaatgtatttaagtttagatcagggaagtcctttataatattcttaattcacgttttggtgaagtggtatacacaacggtaggctcccctcttcctgtgggtttgggttttaccttgaaaggggctgtcagaacagaagtttcagggaagggaccagatccctggggactttccttaggtgatggtgatggaagaagaggcaaggcaggacaggaaggctcaggtaagaaagactatgcaggtgcaggggcaggaggagaaggagcagttggaggtgaaagagacaaagcctcctcaatatttctcaaatcagaaaacatgacagtctacctccttcagcttacttcctcaatggaggcaattttctcagttcttttagaaattttagaaatttagacatttctaggtctcattggaattaagtctcctatttaatttgtctggttcaaaaaccaaatttctctctctctctctgtttttttttttttttttttgagacagggtcacccagactggagtgcagtggtgtgatctcggcttactgcactcaccacttgctgcatgacagccaataagtcgagagttgaggtgtaggggcagggaaggtgactttattccagagagccaccaaactgaacagatggtgaagtaacatcctgaagaaccatcttaaattaatactattttccggctccttgtacattagggaagggaggaagaaggaggcgattgaggtgaagaggtctgacaatgacagacatgggctgcagtgagagcccaaggggatggtgaaaattgttggtcctttgtcaggtcacacttctcttataaatcttcagcataacactgttacttgtgtatacaacctctctatcttctcaggagttagtttggggaagggattattatcatctgtgctttaaagttaaactgtaagctaaatccctcccatagatagcttggcctatgtgcagaaataagaaaaagcagttagcctggaagatgtcaccacacggtaggaagggttaggagcaaaatgcagtcagtcatgctaggcctccttttcattgccatatatttaatgtatttgaacacgtaagtttaattttttatactttatttttatttatttatgatttttttgagacagagtctcactctgttgcccccccaggctggagtgcaatggcgtgatcttggctcactgcgacctctgcctcctgagttcaagcaattctcctgcctcagccttctgagtagctgggattacaggagccccccaccatgcccggctaatttttgtatttttagtagagacagggtttcaccatgttggccaggctggtctcaaactcctgacctcgggctcccaaagtgcttggactacaggcatgagccaccatgcccagcctaaccaagattattaaaccattctaatttgtcaaaagagtcacactgatttttaaaaaataatgtaatgggccaggtgcagtggcctatgcctgtaaccccagcgctttgggaagccatagcaggaggatcatgaggtcaggagttcaagacagcctgaccaacatggtgaaaccccgtgtctactaaaaatacaaaaattagccaagtgtggtggtgtgtgcctgtaatcccagctactcaggaggctgagacaggagaattgcttgaacccgggaagcagtggttgcagtgagccgagattgcaccactgcactctagcttaggcgacagagtgagactacatctcaaaataaataaataaataaataaatataataataatgtaatgaactttttcatgtctttatataaaaaatattacattatttaaattgttcaaaagcatcaaagattcctctctgctatcaacttcatttattttattgtaccaaactaccaggaccattaatttaatctacagctaaatctattattttttcatgttagaaattcaacaagaaaatttttccctaatgaaacctcacatttcaagcataaggagcctgggcgagttggctcacacctgtaatcccagcactttgggaggccgagacaggtgtatcacttgaggtcaggagtttgagactagcctggcaaacatgatgaaaccctgtctctactaaacatataaaaattagctgggcgtggtggcgtgtgcctataatcccagctactctggaggctgaggcagggaaatagcttcaacctgggaggcagagcttgcagtgagctgagatggcaccactgcactctagcctgggctacagagcaagactctgtctcaaaaataaataaatagataaataagcataagtagtaaaaaaataacataaatttaaaaataaggcacagggtcttgctctgttatccaggctagagtgcagtggggcaatcatagctgaccaacttggaacttctgggctcaggcaatcctcctggctcagcttgccttgtatttttttagagatgatgtcatgccctgttccccaggctggtctccaactgctggcctaaagcaatccttccgcctcagcctgttgagttgctgggagtacaggtgcaagacatgcagcctagcattgtagtaaaacaattttcaacaaattcttaattttctttccttttttttttttttttgagttgggagtctcattctgtcactcaggctggagggcagtggcacaatcatagttcactgcagcctgagattacagtcatgcattatcatgcccggccaactttaaaaaattagctaatacttaaaaatttgtagagacaggggtttcactgtgttgcccaggctggtctccaactcttaaagtgctgggactgtagctatgagccaccatacctggcttaattttcttattttaattttatataagtgagtattattgttcctaagataattggggcagtgactcctttacaattttagagatctaatttgtctattcacttcactgaaagagtatgccaatttgtttcatgagaaaatatcctatatttgaaaagaaggaaaattccttccaccaaactagggtgcattctaaagaaacgaattgttctaagtaacatcacttaaagtgcaaacagaggcaatggtatctattaacaatgtttatcagtgaaggaaataaactgaaaatatgaacatcattagatcctcggagggccttcattgctgaaaatctgagtaatattgtgatactcttttgagtctggcaggacattctctttccagggcatgtaacagtgggtgaataatttcttttcattcatttccattaagggctgaacttccttaatgttctggagattattaaatttgatttgtatagttgtgaaaagtactcatattgctgattccattgcttatatgtgatcatataaatcttttctctttctgtagtgtggtttaaacttaatccttaaagggcatgtatttgaatttttcagctggttagaaacctgaatataccaatcaaataaaactgctccttacatgctacagatttagttttcttcctgtactaagatgtcttttagatacagtaaattcgttaaagccaagagcccctaggaaatgaagttgggtgggaggggggacatcgagtagtaagatcactcttgtaacagagatgccactcttgcagatattgacaaaaattgggcctataaaatgtttaccaaacattggaaagacaagatctgaacaacttatcattgctgcagtctcaaatatcaggaaatgccattattctcaggacaataaatagacaataaagaagactcacagaccagattagctgtcatgtatcaccaaacagggactggatccttgttaacacgacccaacagagattgtccccagaaattcacttcataacctcaaaaccaaaaacccacactgatggcaaaaaataatgatgcaaagaatgagagagaaagagagagagagagagagagagagagagagagagagacctgtcctatagccatactcagtgggtaaaagccaaagagctcaatttctgctcatgatacttaatagaacatagggaacatgagccaatagctcaatgggttcagatctgcaccaagtgcctgttggacgcaggattctactgtctccaataatatgtctcagatgcactaattttttttctctttttgagacagagtcttactctgttgcccaggctgcggtgcaatggcgcgatctcggctcacagtaacctccacctcccgggttcaagcgattctcctgcctcagcctcccgagtagttgggattacagacacacaccactgcgcccggcaattattattattatcattattattattattgtgcgtgtgtatgtgtttttagtagagacggagttttgccatgttggtcaggctggtcttgaactcctgacctcagctgatcaaaagtaggtgaggtcagaaaacataccctgggagaggctggcacaatgcccagaaccgctatcgctaggcctggggttttcctctgtagtggaatactagtgttcatgtagtgcagggacaaaaccaattagatagttctgggagttaaaaagagatgatttacagtgccatttgagaaggggtattaaggaatttgccagggcactgatgcgtgtcaggtgtaaacctcaggttgagagagagctaagtattttctgtccatgaaggtgataagcgagggcctgaagaaagagggactggggaggacactggcaccagaaataggaaagggcttcttgggggtgggaaggatgggtcacggtgctatctataaagttggctggcagtggatgtaggatgtgggagtgagacatcaaacatgaagcagtcgcttaaagtctaaagaaacactagatatatgaactgcaggagatagtagggaaactggaccggctcctcataaaacttcccgccttctatctccgggaggatcgcagggcatttccgccaagacaggtgagactgcggttctgacctgcgggcctccatgcatatgcgctagggcacctgggggccggcagagccgttcccctacgcaaagtaagagtgttatgtctacaacccaacggggacactgagagccccaaaggccctgctttcttcccagagaacagcgcccatctgcataatttctacctggctctatgaggtgagaacacactccccgctagcacagaaatcctacaaactcctgtgggggctgcgcttggaagcagaggctgtgtaagaggtgacttggggggtagggaaaaacacgaagattttcacacagggtgagaacccaagagactggagaccacggaccaatccctgcaaaaagcagccagggtagaaatggaagagctgagcggacttcacgatagctaatttgtgttacaaagccgatacggctgatgctcgctttttctcctatggcgtgcaggccacatgttacttcttattccccaggcctccactgtaggattaacaactaagacacaaaccaatacgaaaaaagacatgacccttggcgtacggtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagatcttcgggctctgccccgacacagcctcatacgcctcactctttacacacacggtcacttgccccgcgcactcccgagccctttccagccctgacacacagctgggattctcacttccgatccgcggtcctgaacccgctcccagggcacgggaactccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattcgcagactagaatgtttcggattacaaaagaaaccggttctcttcacatccttatccttgtgatgcagcattccgcttgcaattggaagccgtttaatatcagagagaaaccatatttatgaaagtaaagaggctgcttagatgactgcaaaccagccgtccttactggttttatcactggtaatgttataaagacagttgtccagtttcatgaatcttgtaggtttttttttttttgatgttgttttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaatattccaattcttggttaaagaaacccatcaagatgaaaccccagaacccattattctctcttgggtatgcccaagctcccctttcttgagtgtgtactttttgctttgcaataaatctcttctttcactatctgctgactcatctttgactttgttctcacgatggtgtcaagagcctggacaccacggctggggtcgagatcccaccagtgtccagggacctcccccagcccaccagtatcagattctattccattgctcaaatcacaaaacatcgagtggagagttctccttggagatcataaagtaaagattctgtggcatggtggccagttaggccactggaagcatggcaaaatattgaaaatgagggattaggtgacagtgtagtaactgctgaatactaaatacttgatccaggccccattccctggagattgacagggagacacattgtccaggtagtagtggagaaatgttttctgggtatctgaccagcctttgtggaaagaactggcaccatcctgcagatgtaaccgcctgatgggttcttcctgaccaatgtacacaaaaactcaattcatggagaccatggcactgcaggaaacggtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggcgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatgttttccatatgaaactgttccacttcaggtcatcaggcatcagttacagtctcataaggagtgcgcaatctggatcacgcacatgagctgtatcaccactcagctctcactccagcctcaggtatcagcaagacctcaccaaagattactgtttaattgtctctgtgtgtgtttttgtttgtttcaggtaacaactaatgttggaattatgaaaagctcttctctacttttaacaaagcttagtcacaaacagttccccagttgatgagaaaaactaaaacaacagaacaattgaaagtccgaatctgcaagttcatctctgagaaccgaattttacagccactccagatttgtactccaaatggatagtttgattgtagaaatcacttcccttcagtctgccaatgtgataactgcccaagagaaagtgatgcctacattcgtagataatcccctttcccccatcctatatataactggagtcaacagtagctggaggaaaatggcaagaacttggaatcaagattaggttagaataacactgctgtagacagtttatcagctcttcagcatatgtccattttccttgaaggatgagcctttagaaacctctgacaataaagtttattttacatccattcccttgcctatgattttttcatacaaatcacaattataaaactttcttgctccagctaaaagcaagaaactcaatcatgaatgtgttcactaaatatataccacagaatgatagcaaccagtctgaatgcatcacttgattccaaaattaaatgttagccctcagtggtgcaactacatgtatctccaactctggaagccacaggcaacatattcctgtttccttgcagggaaacagatctataagcagggcggcagtctcacacatgtacattcctgggaaacccaaggaaacaatgatagtgacgcagggcaggcaagcccccaaactgaaagagttttgctaatgtcgcgattggctttctatgttatttgaagactgagatctccatgaggaatgaagacaggtaatgcctaaggctgaggcatgacctcactgggtcaccttagctgtgaagtgaggtcagttgtcaccttgcaaaccttttggtaatccaaatcttggaatgatttctttaagaatttagacacttccagtacttttcctgtccttgtggggaaagcttctatccacctggtgaaagtgtctataaatactagcaaatcttgtagttccctgtaaggtggcatctgggttaagtctgtctgccagtcttcaccatggtatgttccttggtgttgtacaggtttaagcagggatcggggtatggggtggcttcctgagtggtaaccctttttatagtttagaacagtcccttcccgaagaatatttaggaaactaatttgaatggaaaatcccgtcccaaatgtgaggaatcatgaaaatgtttaattatttcccatctgtcagcctcaggaatagagtttgttcttttgtagcaaccatccagaggggtctccctggaagccttttactcagtccctttaatttccttaggggtatagtatggtgtcactgacacggatgcagtacctggtagtagcgcagcagcttgaaataccagggtttccttagttgtggccttagctgctctttccaccagggaatttcctctaataataaaagtgtctcccttctggtgtcccctgcagtgagtaattgttatttctttgggagttggacagcatctaaaagttccaagatctgagtaaagtcgtatgggggatcccttggctcttgatagtcccctttccttccctatggctgcatgagcatggagcaccaggaacccatatttagagtcagtcaacacattgactcttgagggttcatcctccccgcaggcaactggagatgtattgtccccagagggtacaatagagaatcttccgtcacaagtcagcaaccagcatatgtgagtgacagcatgtgtcccactcagaaatgagagtgtattagtccgttttcatgctgctgacaaatacataacagagtccaggaccaaaaagaggtttaattggacttacatttccatatgactggggaggcctcagaatcatggcgggaggcaaaaggcacttcttacaaggcagcagcaagagaaaatgaggaagaagccaaagcagaaacccctgagaaacccatcagatagtgagacttactggctatcaggagaatagcacaggaaagacccgcccccatgattcaattacctcctcctaagtccctcccacaacacatgggaattctgggagatacaattcaagttgagatttgggtgagggcacggccaaaccatgtcagaaagggatgaagtgacagcatatcctgatgtgtgtgatggtttcatgagttattatctatttcaaaatttattgcaatgtgtggaaaagaacaaggacttgtactatctgactttaaggtttactataagctatcagacacaaggcatcaagagtgacaaacggataaacagcctgagttagaaaacctgaaattgatccacagctatacggtcaataaatgggttttcagtaaaagcagttcaataaaagaaaataaatcatttcaattaatgaacttctatatggatgtggggagaccaacaatgttattctccctcacgttacacacaaaagtaatttcagccgcattacacaccaaaacttaaaagttaaagatataaagcatttcaaggatactttgtgacttgttggcaggcaaagattagcctaccaacaagcaggacacagaaaaaatacatatataagaaagacatgataaatgagacttcatcaacattagccacaccttctcatcaaaagataccactaagaaagcgaaaaggcaagcaagccacagacagagagaaaatacccacaaaacgtatctgacctccacatcctgcaattataattatagtggtctggtacactgcacccagtttctgctggatggagtattttctgggtgtctctaatgagtaagagagggccccatgggatattccttcagttcccagatgaacagtgggaaagactccacattgaccaacctcgggggcctgaaaacccaggtcctcaaggagggtagagtatacctggaccctgacccagacccctggatgggctgtgccaagagacccagcaagggaagggatttcctcctgcctcaggttctctgttcttctgtggttagaccacctgaacccaactccctccccaagcactagagatgggcttttccaagggctggggatcttgctgtcctgaggacagctgagcaagggggtcgaggaggagcttgggttgtggaggagaggaaaccgggtaagatgcgtgaagcagttggctataccaggcacagagaggacccgctgggacccaagagcctgcatgtgaagccaggccttgggccaccttgtctgtcaagggggtgcctacttccatggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctgatggagcctgaggcaggtgtgggaagatgtggattgtctaactggaggttgggagtccagggtgtagaagcagcttggagtgcaggatttggtggtacgtgtgtggcagtaggcaaaagaaagagacaactggccgggcgcggtggctcacgcctgtaatcccaacactttgggagaccgaggcgggcggatcacgaggtcagatgaagaccacggtaaaacctcgtctctactaaaaatacaaaaaagtagccgggcgtggtggcgggtgcctgtagtcccagctactggggaggcagaggcaggagaatggcgtgaacccgggaggcggagcttgcagtgatctgagatcgcgccactgcactccagccactgcactccagcctgggtgacagagcaagactctgactcaaaaaaaaaaaaagaaaagaaaagaaaagaaaagaaaagaaagagacaactgagccacttgaaataccaagagaattcaaatttagaaaattcccagggaactatgcgtgcaggcactcaccagatccacaaaacagctgctgcataactgcatgttgcaagcaagccctaaattgctgattttgaaacagcctgatgggttcacaaagacaatttctgaatagtcgtaagagcagaggtgcactaaagccactgtgccccgcaggcccggatcccagtaagttctttaaggagtaagtcttacttccatttatggaagatttttggagttgtccttggtcacccccaggaatgttttggttaggagtagaattttagatgtcatcaatttaaaaattaaaactaaaacgctggaactcatagagagataaaattaagagaatacattcactatcctgagtagaaagatttcttatagaacataacaggctttaaaaataaagaaaaaaggccgggcgcggtggctcacgcctgtaatcccagcactttgggaggccgaggcgggtggatcctgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaagaaaaaatatggcaaaatttcatctaattaaatgctttgagaactaaaattaaaatccaaagccactggacagactgcttcttggccaaggagaccccagagaagtcttaaatactgagttcctgcccagtagttggaatctcagacacctctccttatactctctccctttgtggtttagacacaactgaccagcattattgttaaaatagagatcctaagactgacagaacagactccttgcagtaggaagatacggtatgataaacgagacctaaggccacgccaggcaaggtggagtcatgcgcccctcaacttaaagaataaactatgttctaattgccacaggtctttttcttcttcctttttttctctagctaaacaagcactggccttgagataagcaatgctgaagcacttgcagctcacccattaccataaactgactgagccctccctacacaagccataactacagctttgattggacaagagactgatttcagtaacttccccttgataagagagcactggctgtggacgggttctggacggtttacagaggctgtgcacttgactgcctttgtgtccctgcttccccttttgaagcatagggcctaattataatgtatttaaatgttgtctccaccccaaagtgaacatgggttgcatgtaacaggcatgtttactcagcatgcatgcagcaggatcccttcatgaatattcagagctcctcctattccctgttgaatatgtatatgtggcccaccacatcaacataaatccctgttcccccctcccctccctggaaacgtacttttcaggtttcagcagcaagagggtatgcctccctgtctgtcagaatggccaccttgcaggctgtaaccctttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaaaatcacaagcattcttatacaccaataacagacaaacagagagccaaatcattagtgaactcccattcacaattgcttcaaagagaataaaatacctaggaatccaacttacaagggatgtgaaggacctcttcaaggagaactacaaaacactgctcaacaaaataaaagaggatacaaacaaatggaagaacattccacgctcatgggtaggaagaatcactatcgtgaaaatggtcatactgcccaaggtaatttatagattccctgccatccccatcaagctaccaatgactttcttcacagaattggaaaaaactactttaaagttcatatggaaccaaaagagagcccgcatcgccatgtcaatcctaagccaaaagaacaaagctggaggcatcacgctacctgacttcaaatgatactacaaggctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccttatttaataaatggtgctgggaaaactggctagccatatgttgaaagctgaaactggatccctgttctcattgcttgcacctgggagacacaggttgcagtgaactgagattgagccatggcactccagcctgggtgacagaacgagactacatctcaataataataataatagtaataatttactgttctcataaaaattagcggatggggaatggaggcaagccggtgcaaaccatgacaactagtttagattttattgtcaactcatgaaaaactcgttctcattttgtgtttttaaaaaattccactgatacagccgttttctctaccgaaaaagactataaccgcattatttcatcactggaagctacagacagagggcccttgagaggcggcatcttcacctacgggaatgtttcctgctcaattgtgagacaaagagcatgtccaagttttcctataggccaggccgccccctagtttctgcgctgtgggctaaactccagaagctggcgcccttcagggccagaggtttcctgtgctctctggaggctgctaggattaaaggcaaagcaaacgacaggtctattagccacagttgcaggatagaaaacactactgtgactcagattagaacagaggttgtggcaaccacaactacaagtattaaccactacacgaccacaaagtctgctgacaaccattgcacttcttctatttttttaatgtaaaaacactcacactattttatctggtttattctaggacgtccgcagatttttgtgcttttctgtctttcatgtgcttctccctttctctccccattctgctacataatttaaaaaaaatctcttctctcaggatccagccactgcctctacaacaagcctcctgggaggtctctttgtcccattgacatctctgccttctttcgctgcttttttttttttttttttttttgacggagtctcgctctgtcgcccaggtggagtgcagtagcgcgatcttggctcactgcaacctttgcctcctgggttcaagcgattctcctgcctcagcgtcccaagtatagcgtcccaagaatagcaggtgcatgccaccacattcggctaatttttgtatttttagtagagatgggatttttccatgttagccaggctggtcttgaactcttgacctcaagcgatccatccgccttggcctcacaaaatgctgggattacaggcgtgtgccaacgtgcccggccaaatttcaggccaacacctgttgacacacattgccagacacacggaatccctcgcggaacaccgatgggcccacaaaacacgcgggggctgcggtcgctgatgatgtgagcaaattcgattcacggtgtctggggtacagccctgagggttcactggccacctctgcgcaaggaccagtctccgccgctcccctcatctccacgcagattcttgcccacacacctcccctttctttgggccgatgacaactcttggacctctgaggtgactgtcctgcccgcagcttctctccttccaagagtgtcatttcttgatcctctccatagtggctcaacggtaagcccaaggtccagcacgcgaatcaggaaactgatggttctttgggtttgcagggatccttccagtgaataaatgaaagtaacaggtaccagtatcaaaactgcagtgactcaccagagacacttcatgcttgccagcttgctaagctgtttgagtccaacaactgcatggggtcctgggttagtctcctgccgctactttggtgagtgttgttgtcactttaccttgtggtggccaagcccctaaatgcactcttgggttatgcagtataattttcagcgtaaaagacaagtaaagagccatagcgaagtgaaaaacaaccacgtgcagtggccgggaattgaacccgggtctcccgcatgggaggcgagaattctaccactaaaccaccaacgcctctctggaactaccccctggaggataacagaaaagagtaaccacaaagatttagaaactgttctaagcggttttttcaagtgtcgactaaaagctaacaaagacatccaaaccaaatgtgtttttataggaaacttttattagacaacgttataaatatcaaaatagctcatttgtcggatcaaactcttaactctgaaaaaggtctttctacctgcattacaaacccctataataaaacatcagaaattcattcatgtttcttttttctaatcctaaatcttccatcatcaacctcaaactgctgccttagaggttctgagaaggtaacctaactggtagtttaggtaagtaaagttcaaatccagggaggaaataagaagcagaagcagaattagaagaaagacgaaataaaaggacagaaccacggtagagataatgaagaaacaaaggttggtccactaagttagtcttttgtcgttggttttttttggcaaaagagtaatgatcggtctcgtaatcattataatactattatttgtctgcttgaagatgtataaagcatttgaaggaaatgtgatgtgaaaagatgaagaacgcttgccgtcaatgtttcattgtttgggagaatcccatttcctaagttaatatgctttgatgtgttagctatgtaagcagtagactagtttaaggaaatattgacggtcaaatattaacatattagtcttttgatgaagttcaaatattagagagatttctttcctcaattttcaatggagacattcaactgaagagacaaatccagagttttctccacatgttgggtctgggagtcattatgactttttcaaagacaggagctgtgacatggaatcatgcttcttctcaagctgagaagccaagctaggtccaggctgagtcataaacttgagcccaccaaggaaatcatccttcacattgacctcgcagagctttggctgttctctgttctttgcccaacacccaagacacacaccagctctggccaacaaaccttaacatatgatctatatcaaccaaagctacatttattcccaaatctccttctaaaatacaaacctgtactttctactctcaacttctaaatctaccaaggcctcatatgcatctgagtcacagatgctaaaacttaaccggttttctgaggattatttgaggaaggggtatgcatgcaaatgtatatacataattcatgtgatttaggaatatggactctatgacttccagatgcagatttagaacctttttaaaaaatattttgtttttgttgtcttgcaaatcagccagatctgcaacttaccagagtaaagccaaaccaagcgggacccttaggaaatgcgctaagatgtcatccactttcagtgtcagcctgtgaaaattcaggcgacagaagagaataaagagaatcttaaggaatttctggaaccaaagctaatattaagcaggcctcttgctggcagaccagtggaaattgtacctggtcaacaatctgtctagattgaggaggtctaaaatgtagccacaggttcaaatacttttctgtttgtttcccaacctcgattaaactcacaaaatttagggaccaaaaaaacaaacaaacaaacaaaaaaaaaaacaaaccacgacgttcccacccagtctcgaatcagggacttttctcgtgtgaggcgaacatgataaccactacaccacagaaactgcatatgcaccaaaaaaggcaaaatatcatcatgaaaatcttagatcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcctccgagccctgggcgccccgtgcctctcaggagggtggacgccgcccttccagggatgcggaccccgcctcggggccttttccccggcgccggccgtcggggctcttggctcttctcgtcctcccaggaaccgtagaaccctccttgccctccctcccgtaggccgaggggcgtgagctgcgcctgtttcctcacggaccctttggcctcagcgcctcgatgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacttactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacataagccataggaggcatttaacagcaaattctaccctgataaagtatcgcactaaaaattttagtatgggccgggcgtggtggctcatgcctgtaatcccagcactttgggaggctgaggcaggcagatcataggtcaagagttcgtgacaagcctggccaatatggtgaaacccctcctctactaaaaacacacacaaaaattagctgggcatggtggcacatgcctgtaatcccagctacttgggaggctgagggaggagaattgcttgaacctgggaggtagaggttgcagtgagccgagatggcaccactgcactccagcctgggtgacagagtgagactctgtatcaaaacaaaacaaaacaaaaatttaccatgccactgttcttcaactgttatatatatgttaattatatgtccctagataaattttttgggagctgggcctccagctgggatactctctggaggagactcttcaggtcctttttggcctgaagtcctggagagtagaaagccccagtgccatcagacagccacaactcatcctcatcagtgacactatgaggtgaagacccctccagggtgtcaggagctctcagcttccagggtctttccagactagatgaataatcacttgtaaccaagagggactggacccggttcttgaggttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttaccactgtgtgaaaaataggcataggaaaataagacttcgaataaatatatcagcatgttaacatcagtgtattggggcagtggtagtcagaatgagaactaatccacagcattttacctgatgccagacactgttctaaagcattttataagaatttactcatttaattcacattagtatctgatggggtaggtagttcctttattactattttaacatatgaagaaactggggcataggaaagtttacaaattgggatttgaagcaacaagtctggccccaggatcttttctcttaactgccacactacacttcctcaagaatgagagagactgtgtttttcttctcttctggttttctttttttttttttttagtttgtaagcaaacatttatagccatgattccacagatgtggtaagtaaaccaacagccattcctaaataaaatacaagaatttccatcatgcatagtttacaggcttggtaagaagcagtctctttaggggctagatgcttaagaaatattcaacaaacaatgaaatcttggcttttttttttttttttacacaaatgtttggttatttagccacattagtgataaaacatattcatattctaactgcaagtggaataaacattgcaacaaaaatgcaacccaatcaaaatcattagtaataactattactccctcttagcagtaagaaccattattcttggatttcaaacattttattttctgtgcatagcttatagcactgtattataggaatcagagtgtataagcaaaaaaatgaaataaaacttcttgaagaccatttccattatttatgattaaatcaatgaaactatacaatttccacattaaatacaaattagtaaaagaattcctccaagtagtattgcatataagctacaactttaccccaactattttaatcactatgattcgagatttcctaggatttaacagcccaagattgggctgttactacctcagcaagaacaatcaccagtaaatacatgaactggggttatagctgaatttttagaaactctccagacaaaccacgtgttagaggaggtaagtagaaaaactaatgtttgagctgtgctattcctaccaggaactatgtcaaatatgcaaagttcaaacattcttagtaaaataatatgaaaggatctatatatactgtaaatttagcaaaaacacttttatgtacagaagcctaaatatcttaggaggtttagaataccaatgaagagaattgttaattcttcaaggctggtttcttatgaggattaaaaaccagcccttagtctcagatgcattccacctagatgtgttcacgaactccatagagtaagaaatataaaccatgaatatgtactcttaatttccattcttcaacttaatgttctatagtacttcagatttttaaatccagagtttggtgtacacttaggaaattatagtaagagtagattagagaagatttgcttgttttccttttgaagccatgtgaaggtttattaccctgtgtattttcatcactgaaaagttccccggtgactaataaaataaaagtgtcacaagctacatgatggatctcttcttttaatgttgcatacagtttcagtttggctagtgagggctaactagctcagccctagtttcattttattagagttgaccactaaaaactaaataaggaagttaccagtaaagctaattcccaatacaagcaaaaaacaaaaacaaaaaacaaaaacaaaaccattcgcataataaaatatatccttaacacaaaataagggtataacatattctgcagcatgacattttattttatttctcagctgtagctttttcattcagaaattggagaccatcttttcactgagttgttattccttcctcttcccttagcttagggatatgttgaaaaaggcttttcaacaagtattttattttttacaagttgctatgaaattaaaatttatatatatatcttaagtgtttataaagcactcaaaattgtagcttacatgtatatgacttctgaaaataaaaatcacacttctaacataatctttctgctctgcaaaaatattctacatacatgcatatgatcaaaacaatcttttcatgtttggggtatttcttacacatagtaaaagaaaagtcaacaattatatcagtacttcccctgttaagataactgagtgccacctagtgttcaatttctgcaactactaagcttacaaattcaatactgctattaaaacccaggttctgaaaacggcattttggaaatcttttttttttttttttatgtttacggtggcaaaatacgactatgaaaagaacatgatatcaaaatcagtataaaaatagccacaggctacttaaatatgacaaacagacttattttttttcttcaaatgcagacttctgcctccctcaaattgtatcaaaatctcaagggaatatctaggtaactggaatatacacaatgactctatacaatcaagaggccagggcttaatcagattccgtgaggacaaggcaaatgatttcttcaaaacacccattttcttactggaagtggtaggaaaagcagcaatgcatggttttttttttttttttttttgtaattagtagacatggtcttctacccataagctccattacattaaaagaacaaagtgggcttaacatctcacttaagataattcagcattattatcagttttaaaaaaaccaaaaatatcttagaaacaaatcagtctgctttaacaaattgcattcatgctaatgaaattttaatcttctttgtcatgatcaaaatccaaattgtaggacaatcttcagaaaagatggaatgtaaaatgttgagttcaatttagatgtcatcaatatcttcatcatcatctccaatgtcatcaaactgaatttcatcatcatctccaggaccaaatgtatcagtttcattgattttagcatgctctggaagctcgccgtatgcctgcagacttctagcttcgtctgcattgtattttaaaattacatcagctttgttatcctggtagtctcggagaccaaccaaaataatgtccgaggtatttatccaaaccttttttctcaattttcctctgatgtgacataacctctttacaccatcgaaacacattgcttctagccgtccatttcccaacattttgattacctgagcatactcctgaccatcctctttgaataccagttctcttttttcagattcattctcattcttacccctgcgtctatttttacctcctttacctttattcttgggcatggcggtggcggcgacctcgcggcgtctctgacttctttccgggtagcggcgaccgcggcggctgctgctccgaggggcgacacgagggagcgcgcgggaccaagtaggtgctggaggccaggcaacgtgcgcgggagaggctggcgacccagctcttcggagatccgcctgcgtccacgctcggcggcagcaaaatgctcttctggttttcaatgtggtgggtggccctatggttgtagtccttttataatgcaaaacaaaattatttttaacttacggtttgcatgtttccaaaacctcatgtggtctctaagtaggccttagtatttctataataatcagttggctagaactttatattattattattattattattattattattattattagcagtgtgccacaaactaattgtagaaattcaaacttatacgcagcctcattttgggtaagagttctcctattaacctcctgtcctcctcttccccactacttgtcaggtgtggaattggccaacagcacccaaatgtgatagctgactccagggagggaaggtgagccccacaccctgtgctcttaccgggactggtggtttcctcctgttcagcctcattcttgctttggccacaagtctcatagcccaggtcctggaggtccacctggacctgtttactgtcctgcttcagcaagggttcacctgcgtgggaagagacagcaggtgttacagaatgtctgaatttcccacatatgccctcagcctcaatggcacataccctaaccttgtggggcagggagggcagatccacagtgcgagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccattgaagctggcaagtgctttatcagcaggggttcaataaatgttgaatggagctgaactaatttagagtcccaagacacctagacctgcactgtccaataaggtagttagtagccacatatggccactttatactaaattaactaaaattaaataaaaccaaatgtccaagttgcactagccacacttcatgtgctcaataaccacgttatgtctgtatagaacatacagagcttataagacgtacaggctagttctttactagtaagtcatagttacctactaagtataactctgtatttctccagctcgttcgcctgagcaaagacagtggcttctgatagcagcagcttctcctggagatcttgatagcgttgtttgcattgtgacagctgggagcgcaggtgctgggtggaccctggtgggctaaacgctgattgggcccagtgtcacaaggctgggactggttctccaactgtgaaaggggccaagacaaggatcaggacagtccgaggccacccccatgcagtgatgaccacggcccgttgtgaaccccgtggactttactcaagtctgtcacagcacttctcatgccatttggcagtgacttgctttccagatggagctcctggagtgctgggataatgttttcttcatatctgtatccacagcacacagcacagcgccaatcaagtctacagaggagctcttaggaaacgttttctcagtggtcaaaaagagaaggggtggaaccctccactcatctcccctcacattctgtgccatcgattctctcagaatcccctgtattccccattttactgaatcttcagcatggctcctcccctaaacaggatcccaataacccatctgaggtccaggaacagacacctgtgatgagctgtgaccaaaaaaaaaaaaaaaaatggcattgataaggaagggatgtcattacatactacttgtctgggctgcctcataacctgatgcatccctatgttacagcagttaccccctcctattaaaattacctgtttatgtgccatctttccttaccatattaagtatctcaagggcagccattggttttattgccccatgccaatgcctagtgtgttatctgaaaaattaagtactcaagaaatatttatattgtaaaaggctttctaaaggctgaatgtaggctgaatattattactgttgtttgtggtacaaagagacctttctcttggtacctcttgattcacatgggagaacgttttaaagtaaacactgtcatctcgagcccttctccagtggtttttcattccatctaagcctacattgacttggtgggcatccactgtgaaggtagccccaaggtcaaggctctggggtctggggcaaggcctcacagtcacattcccctcctcttggtgttggtgcttcccaggagaaccaaccagttctgtgtttattctgtcgatggtgctggtcagatgcacaaggagctctggagtaagtttactattcccttctttgctactcagcacaagttgttcttgaggaggttgatgatattgtgggcattcttcagttttccctggagctttctgaactcagcctgaagactactctcactcagaccctctttggcaaccacagtctcaaccaccaccttgcccttctccttgtcttcctcaatctcccatccctcagacatttctgctctttcagctctgcattctcaaggcaaagatgggttctgggtctccacagttgccagacttttctccaaagccaccttgaggaactaaaagaaaatcatgctttgaagaagttaggccattaaagagggcccaagagaaacatgagattgcaaaggtagtttttgatgagaacaaaaacaaacaaaaaaagcagatctaaaatgaactccctacccagaacctccttagtcaggcaataagagcaataagatctcaagactaagttttattattattattattattattattattattattattattatttgagacagggtctcgctctgttgccggggtggagcgcagtggtgagatcatggctcactgcagccacgacctcctgggctcacgtaatcctcccacctcagcctcccaagtagctggaaccacaggtgtgtgccactacacccagctaatttttttttttttaatcgagacggagtctcgctctgtcacccaggctggagtgcagtggcacgatctcggctcactgcaacctctgcctcccaggttcaagcgattttcctgcctcagccttctgagtagctgggattataggagcgtgccaccatgcccagctaatttttgtatttttagtagagacggggtttcaccatgttggtcaggctggtcttgaactcctgacctcaggtgatcattctgcctcagcctcccaaagtgctgggattacaggcgtgagccactgagcccggcccacccagctaatttttttttttttgaaatggagtctcactctgttgcccaggctggagtacaaaatggcgtgatcccggctaactgcaacctccgcttcccagattcaagtgattctcctgcctcagcctcccgagtagctgggattacaggcatgtgccatcacacccacctaatttttatatttttagtagagacggggtttcaccatgttggccaggctggtcttgaactcctgacctcaggtgatctacgcgcttcagcctcccaaagtgctgggattacaggtatgatccactgtgtgcagccccgtgcagctaattaaaaaaaattttttttcgtaggcctggtgtgaaggctcatgcctgtaatcccagcactttgggaggctgaggcgggtggatcacctgaggtcaggagttcgagaccagcatgaccaacatggcaaaacccggcctctactaaaaatacaaaaattagccaggcgtggtggcaggcgcctgtaatcccaactacctgggaggctgaggcaggagaatcacttgaacccaggaggtagaggttgcagtgagccaagattgtgccattgcactccagcctgggcaacaagagcaaaactctgtctcaaaaaaaaaaaaaaaaaggccaggcttgatggctcatgcctataatcccacaactttgggaggccgaggcgggtggatcacttcaggtcaggagtttgagaccagtttggccaacatggtgaaacccatctctactaaaaatacaaaattagctgggtgcggtggcacatgcttgtaatcccagctacttgggaggctgaggcaggagaatcacttgaacccaggaggcagaggttgcatgagcccagatcgccactgcactccagactgggtgacaagagtgaaaccccatctcaaaaaaagaaaaaaaaaattttttttttttttcagaatgaggtctcactgcattgcccaggctggtctcaaacttctggactcaagtggtccccctgccttggcctctcaaagtgctgggattacatgtgtaagccaccatgcctggccaaagacttacttttacaggaggagtataaaacatctcattagtaattttcataattgattatgtgtcgaaataatatttttgatattttgtgtcaagtaacactactaaaattaagctcacctatatccttctacattttcactgtggctactagaaaattttaaattacatctgtggctctcattacatttctattggacagcactgggctgggtgagatgactaggggcagaaagtacattctgagggccagacaatcaaggtgattgatactggggttaggttaactgaagggtagaaaaggccaggttaataggaggcagggactgagtaaccgggaacaaagttatcagagcatgagagagagattctgggggtcagccgtctgggatattatagggaggaaggaggctgtgctacaagggccaagagacaggaggatgcactcaagttggcctggatgaagggacgaccctctgcgacttgggtgggggtaagggtggcaggctggggccagccctgcactcaccgcttctgcttcctagaaggagaaacagtgtcacttggtacctccacctcaggggcgcagtcaagacccgctgccaggccagcctctgcctgaccgccggctcacctctcttcttccagcttcttccgcaggaggtcccacctccaggcgggcatgctggccagccgggcctcctcctcctcctgaaacacaaccacaaagcttcagagcctgcaggggctgggagatagggggcaccctcaacctggggacctgaaggagtcagggtcacaggaagtgaccctttggatgcatttctgtgggacaagtggatggaggtgcctggtcacaccccctcagagctggcctcctttctcctagtaacccagacccttgtgtcctacaggaggcaccagagagatcagagctgagtgggacagaagcagagaaaaagtagccgggacccagaggtcctgagcctgattccccacaggggcaggtggccaatggccacaggtccaagatctctgggcagacgcagatgcgggcccccacccagcctcttggctcagggagattcaggctgcccctggctcccctgagaaggaccttcagcccatggttgccctcttcccaacagagtggatacgtgctctacaatcgtggggctgcaatgacatcaggggcaggtgtggtgtccaacataggcagtttacagcaaacagttttatttcctgaatattacagaggagaaagggtctgtacaccgcacacttcacacagaacactgcacacgtggctcccttgacctcagccaaggaggtagctgtgaactccagtggaaaaccagagagcaggccacactgccccagggaggagccgcagcccctcactcagaggggcttcttctgctgcctggctccacacagagctcagcaagaccacggggccagagggggacacctggtttgttctgtgcctgccctgcctatccgaccaacgccccacacaacctgctcacgatgggacctcagaggctgaggcagcctggtcctgggccctccgggctgctcaaggccacagtcctgggttcttcccgctgcttcacgcctctggagggcgtcagacaggcgtccaggcccacgttaagacgctcgagggtgaactgcgaattccgaattccgctgctcagatgtcaaacagctctgcctccttctccttccagaaggagaagctgcggtcgatgtagcggcagatgtcctcgttgctgaattcgcccatctcagacactagttccaaagggtcttcggcgggggcttcggaacccggagagtctgagatccggggaggcgcggcggggaggcgcggcgggccggcgggcgggcgggcggtggcggcggctgcggcacaggggccagggcctcgcgctgccccttgggcgggtcccccttctgaaccggagcggcctcttcggtccgctcctgttctttccccttctcttcctttttcttcgcctgttcttcgggggccggcccagcctccaggccgtttccgaagaacctgtgcctgaggtcctcgaagccgtcgctccagccgcgccggccggcctccacctcctccagcaccacgcggtggaagaggcggatgcgctcccacgggtggctgtccagccggtggaacatctcgtagcacagtaggtggcggaacttgcgatcctcgcggctcaggcccatctccggtagctggaagtagccgagcatgaagaggtcgagcgtgaggctttcgtagcgcgggggtgcgccgccgtctaggggcgacaggaagtgctggggccagtacacgccgtgcgccaggcccgggcttggcggcacgtgccgccgcaggctccgccagtggtgcagcagcttgcccactgcctgccgctgcctcagcagctgccgcagccgttcgttggggctgtgggcctcgcccttgctcaccggcagccggggggcgtccgtggcctccagctccggccagcacgggcggccgtcacgccagggagcagtctgcctaggcgcgcctggtccgcggaaggcccggtccgaggaaggcccagaggcgccagtgctccaggaagaggtaaacgatgcgctccttgcgcaggtcgaggtagtcctggacgccgcgcagttccgtgcagaggggcggccggcgcgccagctgctcgggctcaagtagcgccgcctggcaatcctgtgcctcaggcgggcccagggtgtccaggggctcccagtcggccagcgggccgtgggcggcggcggcgctgggctggccagagccggccgccacgtagtcctcctacaggatgggctcgcggaccggggcgccagcggactgcgggggcttgcggcgcggacagcgcgggggcgccgcgtccagtgcgcgcagctcgtaggtggcgcggtgatgctgcacggagacgccgcactcgaggatctcgcgcgccacagcctcgcggcaccagttgagccagtgcgagcggcccaggcaaagcggccccggcagtcagggcgcctcaggcagcggcgccagcggctggcccgtgtcagcggtcggcagctccgccaggtgcgcaggccggccgcccagcgcggctagcagcgtggccatgctcttgagcagcgtggagatcttgctgcaccaggcgggcaggctggcggcgcggccatgcattcggcgcgggtcgacggtgaagcgcggctccacagggcgacggagatgggcagcagctgctcagctccagttgctccaggcgcgcctccagcttctgcgccttgtgcagcacctgcaggttctcgattgctgctcgatgcggaggatgtcggcctcggtcatgagctcgccaaagggccagaggatggcgttgtgctcgcgggagtacctccagccctcgcgggggtacctccagccctcgcgggggtagcagcacgagctggcggccgtcagctaaggcggggaagacaagagaggggagggaggcgcgtctccctctggcccagctcccgccgtggcgccaggaaccttttgcatgtcctgggtggtgtaatggctccgcggggctgcgtctgcagggagggaccgcgtctggccggcggggggtgacgctggggtgaggcttcggcctgagccgccgctccaggctctgggcagtgtccactttggtcgctggcggggggcacggccggttgctgctcgctgctgcggcggcaagaacaggccagcagacggggtctccatgcctggcttgttcgctcattacaccacccaaggaacttgccaaaggccttgaagctgagaggcgcggtggcccgccccaacccatccgagggcggctattgtgaggcctctcctcccagactcatgaccccttctccagctcccctgtggcccaagccttccgctccctgtggtcaatgttttatgtgcagaatgagaggccactcctctcttaaagaggctgcagctgcagcttccactgagctgcccacccttcccctcccttcgtcgtgctggacagctgggcaccgtaatattctcatttgctcacttttctccacctctgatgtccagttttcccccctgggcctgccatcgcctccacagaggtccctgattcatcttggccctatgggatccactccccacatacaaataggaagcagcctcttccctgcttaacactccccgcacccggctccccagtgctccaggagaaagtccgttctcttctgggcctctggccaggtcttggtaacctggcccccactgaggtctctccagctcagcgacccccttcctccaggacagtcagggccacatccactctcacttccagactgccctgtcccacctgcggctcttcagccccctctctgcctggccacccctcactcgtcttccaagtgttaccttagacatcacctcctccttccctaacacaccccccagcccacgtataaggtggccggttagggctgccccagtcccctgcgttccccattgcagctggctgtgttgcatcagcccaggtacttctctccactgccacccactctctcacactgccccattttgtgtgcttggtgactcgcacacatgtccgcagccaccttagagcaggccttgatatgttcaccatgaatccccagaggctacaagcgtgtggggcacataaatggcactcgggggccaggcgtggtggctcacgcctgtaatcccagcactttgggaggccgaggcgggcagatcacttgaggccaggagttcaagaccagcctggccaacatggtgaaaccccatctctactaagaatacaaaaattagccgggcatggttggcgggcatctgtagtcccagctactcgggaggctgaggcgggagaatcacttgaacccaggaggtggaggttgcagtgagtcaagatcgcaccactgtactccagcctcagtgacagagtgagaccctgtctcaaaaaaataaaaaataataaaaataaatggcattcggggaatagtttttggatgaatggaaagcaactcatcctgccagctggtgctgatcagctcaccttacagagaaggaaactgaggctggatgaggctcagtatcggcagctggaaggcggcagcgcagcaatggagaccaggtccctaagactgagaccaaagctctcttggctactcagtgtggtccttggaccagtgtcatcagcagcctcacccaggagctggctagaaatgcagaacctcagccctgcccagacctcctgaatccgaacaggccttttaaccagatcccaggtgctgggcaggtgaaggagagtctgagaaaggctgctgtctcactccaaggacaagctgctgggggtgtgtgtggagactgggacaagccccaaacggggtcgtgccaccctgatttccctaaagaagatggccgggcacagtggctcatgcctgtaatcccagccctggccaacatggtgaaaccccgtctctaataaaaatacaaaaaaattagctgggcgtggtggcatgcgcctgtaatcccagctacctgagaggctgaggcaggagaatcatttgaacccaggagacaaaggttgcagtgagccgagatcgcgccactgcactccagcctgggcgacagagcaagcctctgtctcacgaaaaagaaaaaaagaaaaagaaagaaagaaagaaaataggaggtcccgaggttggtgttgggggtggcgtgggggatgggctgtgcatccagatgcagaccccagggctccctgggcaccccgccccacccactttccacctctgctcctcctcctcctccatcttcagctgcatcttgcccaccatcacctggcgcttccactcgggcttgggacggccctgctcatcgtgcgtggggatgagcgcctccacgtccagctgcacccccggcgcaggagtagtgggcggcaccggaaccaagcttccgttgagcagcggctgaaaccccgcagctggcggtgtggggctccggactggtaacagtgcaggtgacacagacggcagcggccaatcgggctgcagggagaagcggtggggctgagcgcctggtggcctagggccagggaagccgggtcgcaggctcctgctgggcccgcctacctggaaggccggctgcctgctgcctgagaacactgtggtcagccccttgctctgtggcgtcggcttcaggctcttgcctgccttaatctcagccagtagctccgagttgtcgcccatcgggaacatcacgttgaaagacttggtgcctatgcagaggcaggagatgaggcactggccagggtggggctgcatccctgccacccctcacccgcccctctgcagcccccttcccaactccagattggatgggtgcccatcctcggggccagcgggcagctctccagatcccaggtcctgcaggcagctttcagggcccccagaggcaggcccttggttccccgactgtggcaaccccaccatcctcccccaccctactcacgggatggagggcccctgcctggagacccctgggagttcatggtggctcttgggcatatattcctgcccagccactgactgcccagccccaaaacactacctggaatcagccaccggacctttgtcccaggtttcctggctcagcccggctgggtggagcctccctctggccctctccctacatcagcaaagcctcagtgacccttgagctgagtcaattggggcctccatggacatgcagagtccagaccccagagtgccagtaccacctgctcccctccctcgccaccacacccacagacagacgcacaagcagacacattggttgcaagccgggagcacatttatggcaaagcacggctcagctctaggggaaagcagagcccttactaaggccacaggaggcacccaggaagaagggcagcaggtaatatgcaaacacccagggcagagggtgcattttctggcttagccggaggaggcgaatggagatttggagagataggtctcttgagtcccgatgaaggggtcaggtctgggagggaggaataaaatgggccgacagctcttggattcccaggctggggatcccagagtgcagtcaccgggaggagaagagtaggagaaagggaaaatcggtgtggcttactcatttatttaggcaaaaccatcagccaggcgcagaatgcttgggtgcatatgtgggtatgagggtaggtatgaggtgcaaggccccacccatgcatcgaggttctctcgcctgccagcccctgcccctgccctttcctcaaggctgggcccctcctcccgtgcttttcctgcctcttccccccaccccgcgcctcagcctcagccaggagccgcgcacgcagctactcactcttcctgtgcctcaggactctcacttctagggaccaagaggagagaagtgacagcggagttaggagggaaagggggccaggatgagactgggatagcaggggacagggagcgggccagggagagcaggaggggggaagtggagaagagaggaggagcatttctgcccatctgaccctggctcaggctgctctggggccccatgagggtggtccatcgagttcctggtttggctggtgcccctgagggctgggcagggcagggccaccagtggctctagcccccagcaagggcctccaccttggcactgggttggggtagggcacccagccctggctgtgctgggtgggggtgtctggggaagcccagagtatatttttctctgcccttagcttcagccctgctgcagactgtggagggaaggagaaggaggctcggcaggtgctggacatgcttccatgggctctggtctgcaggggctggggctccataggaaccatagggggacaagctctgctctgcactcctagtcagggagatgaagctttgaggggtgccactaagcatgatctctgccctgagtggctgggtgatgaaggcaccccagccaggctgggatgggagcaccacatctaggcaccctgtcctgggccttctaggtgtcctggcagggggacactgtcccaccctacagaaaagaagcccaggaatcctgcgccagtctagctcttaaaaaggatgcctagggaagtcaccggggagggagggggaaacatggtgggtcacagctttgcccccatagccaggctctggctggcccagggcccctggcaggaactggctaggaagagttcctggcatatctaagaaggcttcaggtctgtgctgcttggaaagacaagagaaagacgtggagagaggaagagaggctcaggatagacaggggcagggggaagggtggccagctgcggggcctctctgaagctggttcgacttcaagtgtccctccagtaccagctcatcagaaacaccagcaccagctcatgggaaacaccagcgccagagctggaaggccctttctagcccgtgggaggcaggcccagagaggggaggggacttgtccaggccacacagctagagggtgggaggcaggcccagactggggaagggacttgccccaggctgtgcagcccggtcctgctttggcaggacctcaagcaacccagagccctctcttagggtcaagtactcaatgcggtaggggtggccggaagaccatgtagaagaggaaggacccgggcagtgacagctggggagggggtggtgtctagatttccctcccctttcagggctagcgccgccccccacccctcaacctgcccctactcactgccggtgggcgaggaggagcggcgctgcccgcagccagggccagcgccctcgaggggcagaggcgggaccggcggcggcgaactcgcggcctcgggcaggggcggcggcggcggcggcggcggcagctgctgctccctggacgccttggggtccgcggcgcagccgttaggcacgtggttcccagggagttccgcctgcggggatgaaggtgggggctcacctcccagcttagggagaggctgaggggtctgggtcacatctggccgggggcgcgtgcagagccgcggtcaggtgtggcagagcagttggggcccacgtagcatccgcgacggctgcgccgcctgcgggggagcggaggggccttcgagcgagccgcgggcggcagggccgaggcgcgggcagccggcgggcgcgggctggcgggcacgcacctcctcgcggtgcgccatgcccgggcgtgcgaccagcgtctcgccggggcagcggcccagctgccggtagtagtcccccgtgctgggctgcttgctgaaagcgcggggcttgcggctggagtcctgcctccgtagcccgtcgtggccgtcgcaggagctcggctgcgggaagacagtgaccggtggggctcgggcaagtgcccggtaggcgccccccacgcctccccacccagctcttcacctcctgggaactcgcggccagcggccgtcggggggtgcagcagccgacttcctagaccccctgttctcacggtgggcagcgggcgaggttcatgggggcctcggtggaagggcaggctccgcccgccttacagggaggggttctgggcaccggccaaggggcacagggtcccccactgaggccagaaggggcgggcccaggggcgggccggcccagccccgacgccagggggagctagagaaggggcacctcccagcttagccttcactaggccctcggccgcactccgctctcggctgtcagaaggactgcgggtccccagggctccgcggagccctgtctttcgggggtcccgggccggagggagccccctccagagcctgtgctctccgaggctccggcttgccccggaccccgcttgtccgtctaggggctgctccaacctgccacggtgctggtggtcctgctgtgcacctggcggcgggggcggcaggacccgacacctgctttacgtgatacttcctctcaggttacagacgcccgcgcacggccagcctatgggctccgacggcctgacatcacccggggcccgccaatcccaggccgaaccccccccagccgtcgcggatgccacgggggcgccaactactctgccacacctggccgcggctctgcacccgccccgggccagatgtgaccccgccccctgcgcctctccctaagctgggagctgagcccccaccttcatccccgcccgagaggagagagggctgaccgtgggcagagggggcctctcatatttggctgccggctccgggtcgcgtccccaccgtttccctcctgcatctggaaaccatcgccatccacgaaagcgacaccgacacccgcgctcaagcctcggatttcaggggccgtaaggcggggtcgggtgacagcgcggcttcccgccccgtcgcagctgcccccaactaggcccagctcagtgagggagagtgaggcggccgggccaaagactgagtgaccgggtgggggctgtcccctgccccactctccagcccatgcgtccctgcggtggcctcagacccttcaccccgcccgacctggctcacgttgcaggaaacgcgacaccgcaggattcgttttctgggccagcccgccggctccgcgccccctgcagcccggaggctccgacgccacgaccctgctcccacctgcggtcaggcacccgcgcgggaggcgccgcggcgacacaaagagccctttgtagagcttcccggcccgggccctggcgtctgcggcccagcacgcacacagccgggagggacgcacacagccgggagggggctcgcacagccaggaggtgacctcacagacctggcacttgggctcagcggtggagagggggcactggctgggccacctgtcctgtggatttgggcggggcccacagtctgcgccgggagctcaacgattccagggcccctgcagccctacccgcccggccccctctgcctcccagagatgaaaggggaaagccactgtgggagcttggtctaaggtggcgtgaagagggcagctactggagctggcctgcaggtttggtgtccctcccatgcctcccttgcccactggccttgtgacctgagtcaccttgtatgaattggccctggggtggctttgccttgggcttaagagagaactgcaaggtcccaggctccagcaggaccccagggagctgccacaccacatctggccacctgtgacctcaggctgtcccctcacctcttagaccatccttgctctgttcctgtggccagaacgccagtgttccccagggcaccctgccgaggatacccgcaattgctcagaccagacctctgccccaatccctgctccagagcctcagccaggcgcctgcaggccccagacatccctaggcacctcacacttcacctacccaccctgccctcatcctctccacacaggctcgcttccctccagggctcccagctcaggcctggccctttcccccaggagctcaagccctaaactggaaccagccacagcttcacttcctcccagcccctactgccggtgggcgcccagccctgctagtgcctgctcaccttcctccctccctccttccagcccttacctctacagccatgccactggcaccttccacctggcagccacctcccttgggtgacactctccgactgagcctggggctgtgggggtgggggggcatgcttggggaggggcagtctccatgcattctctgtcaactccatgacaacccggccactcctgtgcaagaggtggcacaggcccagttcctggtgaggaacagctgtctggacctgcgtccttcaccccccagctcccatggagggcagtgacctgctcttactctcctcccagtccagtgtccagccctgacccctcgtgggactcgccaggagctttgactcttgaatatgccatggacccagggacccccaccctgtgcccactagtgaggccaggcctttggcctgactggcccccatcagcccagtacccctgctgggaggcaggcagtgggtgagggctcactacctccttcttgagggcctctgtctccacgtggcggagtttgttcttggtctgcatgtagatgtcagctgcctgtggtcccacaggaggcttgggagatgggtagctaggtgggggtgggggcagttgggtgcctgggggcgggggtggcggggggaagctgggtgggggtggtgggggtatgggcttcccaatcgtgccccaaggcaggcccagctctgggttcagcatgtccatgtagctctgtatgtctgcagctctagtgctggaaagccctggggaggcagaaggaagggccagatttggaagcatgcagacagcctttcccccaagaatgagactctccaccacctggaaacaacttgccgagggccaaggtgggctccgggcaccacttggtacacctgttgtggcccctggcgttgctgggcttcctctccctggccctgccctgccccagcccagcacttattgggggaagaccaggcactccggtttggaggggaagcactggaggctttggtgtgtctagagggcagggtcacctggaaggggagggtctactccttgggagtacagatggccacatccaatctttgcagggcaccctgccaggtctggaggccaccatctggtggcgtgaagcaggcattgcaagtggatggacgcccatgctcagggcacggtcagggtgtgtgtacacacaagcctgcagtctgccgaggcgattgtgaatttgtgtatgtttgagtgtgtacgcatttgtgcacatgcttctttgtattgatgaatgtgtgtgcattgctctgtggacatggtgtgtgtgtgtgtgcatatctgtagtatggaaatagagcattgtgtgcttgtgtgtaaggtgggtgtgtgcagatattagcatggctctgtatgtgtgttcatatctgtatgctgtgtgtacacatgtacaagtgtgtgcttttgtgtgtgagtagctaagaataatgaatggtgggtggcacacgtggattttgtgggtggggagagtacatgtggatgtacatgtatgtctgtgatgagcacacacaagtatgagtgacatctgtctctcaccagaaagggtgtcgcctccccatgtttaaaagcaagtgataagagtagtctccgatattggctgtggcaggctggcccaaggccaaccctcacagcccagcagtctggcttcagtctgctctccctccccctcttcctcctgggcacactcaccacgtggagggtgctggcccttgatgctggagtggctggaggagcaggagtcgtagttggagagggtgctggtgggcgagctgaggtcaaagttcagaggctggaccgacaccgtggtgttgggtgaggacatgcctgaatccggctgcttcgcctccagctccacggatggatcccgggagagcacgcagtgctccatgctctgaaggggaggcagggaggccatgaaggcaactgcaccccaagatgcgttgctctccaggccagggtcctactcagccatgcctttgccgtgggatcttggccaagccacacccctctctggggtctcttccccatcgctagagggtctttcaggttcctccgggttaagattcaagcccagccccgccaggcagaggacccaggttcctgggaaactccctcccctggctcctccctgattaggagggtggagagatcgacgaggagggggccttgagctgcaccccagggggagaactgccaggagatcggccttctccctcacagatcggcacaggctccatggggaagggcacagcacaggcccatccctagtgacctggctggcaagccagctctccttgccagacctgggacctggagcagactcccaacaccagcccggcctgtctcctgatggggcccttggggtaagggtagggcctggatggccagctgagcagtgatgggcagccagagctcaggctgccaggcctgccattcccccgccctgcccggtctgtgcgtctgaccacaggcctgtcccctcccggtgcagagggggctgtggtaggggccctgcttacattgcccatgctgcccctgctgccggcaagcccgcttgctccgctgcctcctgcccaggcctgctcctccttgccccgtgccccctccctacctaagaagtgtcacaggcaccctgggagagagaggcaggcctggcaccaggtaacggctcagcggccgcgctcattggccccgtaattaggggctctgctggagtgtttgccttttctgggccagcgtcttctgtggcttgggtctgtccctgcctcagctgggcctgcttgagtgaggggaccagggcacacacaccccacccattccaggggaccaggccctgttacctaccgcaggagtcaggggagccataggaggtggcatgggcagcacccaaaggtgctctttacctgggcaacagcagtgggtgctgagggcaccaagccctgacccctgtaggcagcagataagaggctgggccacagcaggtgtactgcgcctggcctgagccacccagctctgcagtctgggactgtggcttcaaactttccctccccgacttactagctatttcaggcgagtcacctgtgctttttgtgcctatgtttctttatctgcaaatgggggtaacagcactacttgctctgctgagctccaggacatggcgcccagtaaatgccatactgtcaaatttttttttttttttttttagacggagttttgttcttgttgcccaggctggagtacagtggcgcggtcttggctcagtgcaacctccacctcctgagttcaagcaattctcctgcctcagcctcccaagtagttggaattaaaggcacccgccaccacacccagctaatttttgtatatttagtagagatggggtttcatcatgttgaccaggctggtctcgaaccctgacttcaggtgatccacccgcctcagcttctcaaagtgcaggcatgagccaccacacccggcctgtcaacttttttattttattttattttatttttagacggagtcttgctctgtcaccaggctggagtgcagtggcgcggtcttggcttactgcaacctccgcctcctgggttcaagcgattctcctgcctcagcctcccgagtagctgggactacaggcgtgtgctaccacacctgactaatttttttttttttttgtagttttagtagatacggggtttcaccatgttggccaggatggtcttgatctactgacctcgtgatctgcccgcctcggcctcccaaagtgctgggattacaggcatgagccaccgcgcctggcctgagccactgcacccagccaactatttttttaatgtactgtgaagagtaactgagattacacctttaaggcactcggcagggtacctgcctaagtcagaatccaatgaatagtgtttgctgtcctatgaccactagcagctgcatccagacaggccctcaggtgccctgggctctggtgccaccccccatggtccctcgacagagtcacaggctctcttaactgatggggacccaccactgatgcagaaatgtccttccctgtgtccatcccggcttatataccctagtgacagagtgctgactacctgctgggccattcattctcttccagagactctttctcggggggaagttcaccctcaggcccacctgcagcctctggcctctgggccttgctgtgttctgcagcccccagagccaggaccatccccctgtgctggcagggacgacagatggacagacggtgctcagggcacagaccatctgccttcttccctccgggcctcatttcacagccactccatggccaggctgccccatggagttggtccgcatccttttggggttggctgtgaggcccactctcttccctgcctattgcctcaaagcaggcattgtaccagatggtgcagagccctcacttggagacatccacagctgagttcaagtcccagtaggtcacttcgtggctgtctcaccataaaaacataatttaaaaagagtagcatgggtttccagttatgacccagccatgaagtcagctaatatatggtgcaggggcagagaggtggctcctggtcaggccatcaaggtaggttctccactctaccacttactggtgatgcgatcctggtgccccgcagactccctttacccatatgtggaacgggacacttacactctcttctgcagagggtggctgtgagttatacccaagctaatgtctatgggtaggtgaatgagcctgcctgttcccaatggggcctgtcttgtgatttctccagccttaccccttggggtgaccctgttcttccctgtcctctttccgttaacctttgtgcctctactccctcagtccccagcaggcagtggttctgggctgacaggtcgtgtggggtagcgggcttcacgtctctgaacctcagcttcctccttggtaaaaggggtgacgacacccaccactggggtggaggggcgagaagagagaatgcaacaggagcagcgcagggatcgtaccaggttctccaccgtgcgcaggcagtgggtgcagtggctgtggccgttgaagtccgacaggtcagcggccgcgtacccgtcgcggtcgcggacttccagctccgcgccgttcactaccaggatctggcagcactgtgggggcacgcagtgaggacccggccgcggccacgagctgggacccccgcgcccgggcagggccgtgcggagagcgcggtgccagcagagggcgcgcgcccccaccccgggcccgcgctgacctctagctccccgttctcggcggcgtcgtacagcgcggtcccgccccacaggtcagccgagatctccccgccgtgcagcagcagccagctgagcaccttgctgtggccgcggctcgccgcgaagtgcgtggcggtggcgccgtctttgtcctgctccgacaggctcacgtcggtgcagctcacctgggcgggaggggcggggagagagggccgggggatgggggccaggcccctgcaggccccgcccacggtcctccgccccactcctgatggccccgctccctccactccccgccctgccggctccgccccgtctcccctccgcaccgcccgggcccggagctcaccaaccacacgatgaccgggctgtggcccatctgcgccgcggcgtgcagtggggtcatgccgtcgtgggcgcgcgcgtgcgggtccgcgccgcattcctgcaccaggtactgcgtcacctccaggtggccctcctggcacgccaggtacaggggcgtggcaccgttcttggtttgggcattcactcccctgcggagacacagcgcccaccgtgggctttcagcgcctcaccccctccgaggcctccttacccgcccccctcccctcccggggagccctggacggcagggagagtgggcgggagagggccctgtcaccggcccgctgccgcccggggggctccgcctggactgagtcctgagccaccctccctcagaggcccctgagggcgtcccacccagcactgccctgccctcagtcccacttttttttttttttttttttttttgagaagaagtctagctctgtcgcccaggctggagtgcagtggctggatcttggctcactgcaatctctgcctcccgggttcaagcgattcttctgcttcagcctcctgagtagctgggattacaggcatgcgccaccacgccccgctaatcttttgtatttttagtagagacggggtttcaccatgttgaccaggctggtctcgaacttctgaccttgtgatccgcccgcctcggcctcccaaagtgctgggattacagagccaccgcgcccagcctcagtcccactttttaaccgaggtctacaaagatgtggtgagctggcctttcctcccctctcgcccactgtcaccatgagtccccacaactgctgtgtctgacctctatccctttcatcgtgtgccccctccatctggaatgtccttccatcctcctccctcttgaagactcagtacccatccctcctccatgagggccaccctgatttatttcccccttgctggcctccgccccacactgcccagggccactatgagcatgacctgtcatgcttggttgaccataactgattttgacctttgcctcccccagaagactgagttcccagcgggcagggtggtaagggttgccagacaaaatgcagttcacacagttcaaccggaatttcggatgaacggataatgctttagtattctatatcccaaatattgcatgggacatacttatactaaaatacaacttttttatctgagattcaaagctagtcaaacatcccgggttttgttgttgctgtttttgttaatctggcagccctcgggatgtccactatgtactgaatgcttctgctgtgctagctctgggctacggcactggcaagcaggttcttctttttttatttttatttttgagacggagtctttctctgtcatccaggctggaatgcaatggcgcaatctcagctcactgcaccctctgcctcctgggttcaagccattctcctgcctgagcctcccaaacagctgggactacaggcatgtgccaccacgcctggctaattttcgtatttttagcagaaacccagttttgccatcttggccaggctggtctcaaactcctgagctcaagtgatccgcctgtctcggcctcccaaagtgctgggattacaggtgtgagccactgcgcccggccatcaactattactgtgaccatcaactgagattacaccggtaaggcacctagcaggggacctgccagaatcagaattcagtcaatggtgcagctacagctggggaggctcacaggtggggctgggactctgtgccatcacccatagtcccacaacagaggcacagactcagctctctcctcggtcacacagttggtaagtggcacttgaacacccatctgtctgtgcatgcagggcctggctggcaatatgggcatgcagggagtgaagagatggaatgtgtctcaggggctcctcctagggcctagttttcggctgtcactgtcccttatccttgctctgccagcccagagggggcctacctagggaacagcagggctgtcctggctgctgggctgttgggtgtgaacagcccagggtgcagttgccaccaaaggacactaggtggagccacaacctacccccagacccaggagaagttccaggttgggggccacgacctattgggttccagttcaccttttgtgcctaggaggccaattcctcacaggacttgacatcctgcccatctacctcccccagtctttcaccccgtagatcaaccacatgctccaccctgcattcatccctcgttcacccatccaactgcccatccacttgttgcctgcccatcaacgtgcaccaggctacccccctttgcccacccaccctcttgttcccaacacgactcagcccctcttctgacccctgtcacgtgtgccctctccctccctctcacacacatcctgagcccctcccagctggcatctccctgtccctaaagccctggttctctgtccacttccctgactcctgagaccccaaggctgactctgactgagacccctgactctgcagcccccatggacccccactcactgatttctcctccctccccactccctagacacagggctgccatttgctggggctgatgctgagccgggcacttcatgatggtgcggggagcaggcaccatgcctggtgatccagagggggtcccgtcaacacagatgagggagacagaagacccagctacgtatctatcttcagaaacatgctggctcgtggctgccagcctccacaccccagcgccagcgtcacccccacacacactcacatactgctgcatcagaacaggctgttgaatatttcatgaccgacgctcagcggcctaaattattcaccccgtaaccaaggcacagtgagtgccggggtctttgggatcaggggctggtgggggcccactgggttctttctgcagaggcccacggcggtgtacacagcgggtggggggccagacctgcagtgagctctgctctctcagcactccctacttggcagagatccatgacccaggggtgcccagccagccagagaaggtctgagaagctggcatcaagcaggatctgagcagcagggggaagtggtacccacggcctcctgcagggccgctggctggcactcccagcccaagttcctggcacggaatgagccctcagtaagtgctggagctcatcaccattctcattagtattccaccatctgcactcatgcgccccattatggagtcagagcctccagcttggaataccccagaacatgaggcagatatgctgttgggctgggtgggaaggggtcctggctcaacatccccttccaccttggcctgaggacaagaagaacaatgggcactctcacagtcactggggagtattacaaagatatggatgagcataaggaccaaaatgaaattcccatcacacacctggaatccaagcacctcgggaggccaaagcaggaggactgcctgagcctaggagttcgagaccagcctgggcaacatagagagacctccgtctctacaaacaatacaaaaatgagccaggtgtgttggtgcacacctgtagtcccagccactcaggaggctgaggagggaggatcacttgagtccaagaagttgaggctgcagggaactatgatcataccgctgcactccagcctgggtgtcagagcaagagcctatctctaaaataaataaataaatgagaaaataaacaaaattcccatcactagagagaggaattaataaaagtaataatagtaaataataataatagtgatagcagccaccatttactgaatgattactctgtctcaagcactgtgatgagtacaacacacacgttctctcagctggtctttgtaacaaccccacaggacaggtgttagcattgttcttctggtacagatgaggaaactgaggcacagagagctaagatcactctgtgagaaagaggcagagccccgatttgaggctgtgtctgatgcagagcctgcttctgactccaaatgtgccacgtctacaccccttctgctcttggtcggtctgtccctctgcctccctccctccctcccactgcacagaccactgcccttccccacagacctcactgctgggaactcaggaacactctttgacagctgctggggcacagccccgcaggaggacctggctcgagtcccgtgcctttgagctgtgccacagtcttgcttcttgtctctttgtgttcccaaacccatccatgaaatgggggcaacagttgtcatcctgacctcgtgcagagtgcctgagaagtgcctgcagagccctgagcacaggcctggtgcctggcgcacagccattgctgaactttaggatccttccctgtgcctgggaggaccagccaccaggggggtctatggctggcctggcctgtccgggtcctgccaagtacgggccaggctgggcatcatttctgctgtggggaacactacctagaggggagaggatgggtcttgggggagacctctgactcccagacccttgccagctctagccctgaccacagtgacagctgcagaaaagtgctcccagaccaagcccttgccctttgccccggctttgacccaaaccctctttgtaggtcagaggcgccctggcgatgatcgtataaatcatgatttgttttctttctcctgggaacaaagatgctatggatgaactgtaactattcatcaagtcacctctgattacacaaaagaaacatgggtcccccgtgtgggctgtgggaatctctggcggagactggtgccagctgactgccagcaccgccgcagggagtgagctgcccatggagccagagtcgggctgcagaatgattcccgcagcccgccccactgccagtcacgcctccccagagggaggccaggaagaggctgtccctccgaggatcagtctggttgtggcccgtgactgctttcaattgaaattcacggagcctttggtggatctacggctctcggtgtcctccagtcaaacttcccggcctatgttaaaagattcccaagtaggcctggcccagggaagaaatgcagccccgatttgagaaaggttctacaccccagcccatcagctagcatggaatagttccagaagcctacagttgcctgcaactctcccagcctcccaggtcttcctcctggcccgtaattaggccaaatttgaccccccctgaggcctctacacctccccacatcactgccagttccaccatggcagggctgcgaggccgaccctcttttcattaggttctcagctctcctcccctcaaagatgcctggcttccctgacccctcaacttaaagaaccatccccatcgcttcctaccaaactcctcatttcactatatagcacttgccactcctgaattatcttgttctcctattcctcagacccatacatgcgtggatagaagaatgtgtggctgacgtgatgacaggccgggcagttgagtgcacccacttgctgtttgttgaatgaataaatatgagaagggacatccaggccaggagtaggggatgtctcttcactcatggccgcagcctggtagagcaggttagatccacttgccagataggctcggaaatgcccagaggggagttttgtctagggtcacatgcaatgagctgtaggcagagtggacaagtccctgggattccatgccccactcattcagcagatgtttactggagtcaggctctgggcatacagagccgggaagacaaagcccctggccttattagtcacggacagacgggatgaaaacacacatctgtctgtgtgatgcagggcccagccagaaatccgggcatgcagggagtgaagagatggaatgtgtctcaggggcttctcctaggggttagcttccggctgtcacgcaggatgcacacagaacgcaaagccaggcaaccatagggcggctgggaggccaggtgcagtggctcatgcctgtaatcccagcactttgggaggccgaggtgggcggatcacctgagttcaggagttcgagaccagcctggccaacatggtgaaaccccatctctactaataatacaaaaattagccaggtgtggtgccatatgcacctataatcctggctactcaggaggctaaggcaggagaatcacctgaacctgggaggtggaggttacagagagctgtgccactgcactcaagcctgggcaatagagcaagagtcgagtctcaaggaaaagggcagcagggaacaaggtcagcgggaaagtgagtgggcatcatgggcgcgggtgacaatttcagcgaggctcagggttggccttgctgaggtgaggtctgggcaaagacttgcaggaaggcagggagcaggcggggatctctgatccctgcagagggatcagcctctgtgaaggcaggggtgctggcctgttggaggggaccacagcccggaggagggacagcctctgggccattgtaaggaagtgagcagcattccctgtcagtggccagaagcctgtgacgggaggtgctcttttttttttgtgaaacggagtcttgctctgttgcccaggctggaatgcagtggcacaatctcagctcactgtaaccgctgcctcccaggttcaagtgattcttatgcctcagcctcccaagcagctgggactacaggcgggagccaccacacccggctaactatttttccccctgagatggagtcttgctctgtcgcccaggcttgagtgcagtggcgcaatcttggttcactgcaacctccgccttccgggttcaagcaattctcctgcctcagcctcctgagtagcgggattacagacacccaccaccatgcccagctaatttttgtattttttagtagagacggggtttcaccgtattggccaagctggtctcaagttcctgaccttgtgatccgcccgcctcagcttcccaaagtgctgggattacaggcatgaaccactgcaccagaccaggacttgcattgtcttttcttttcttttctttttcttttttgagacggagtcttgctctgtcgcccaggctggagtacagtggctcgatcttggctcactgcaagctccgcctcccgggttccagcaattctcctgcctcagcctcccgagttgctgggactacaggcacgtgccaccacacccggctaatttttgtattttttagtagagacggggtttctccatgttggccaggctggtctcgaactcctgacctcgtgttccgcccgcctcagcctcccaaagtgctgggattacaggtgtgagccaccacacccagcaggacttgtgttttcaaaggctgcgggtggacatggacgggtgaaggccagggcctttcaggcttactgaggacttccccttttccgttctgtagtgcacagcctcacagagccttgggcccagctgagcccaaggggttcaggtagcccccacgtgaggcagaaagggggtttctcagaagccctgggatgccccagcagcgtgctgcttacagagccccagggtccaaggctcagctctcccccttagaagggtagggcaggagcactagccccggttagatgacagctgggaccaggagctgctggtggagacacgagatggtctcctgctgtgaggggcttccccggactccaccaggcccttcctttcccagagcctccacgtgggtcagggagtcaaggacggcagccacctcctcagtgtggacacaggccccgcccccacgccctgcagccaggtgaactgacagacaccaggggtagatctggggctgctgataaaaaggaatgagcccccacggcctgtggcagaatcagggaccaccccaggcagagcctccagccttctaagggggagagttgagccctgggccctggggctctctaagctgagagttgctaggggcttcccaacaaactccctttctgtcccaggtgggggctgcctgaacccctgggccgtgggagcagccagactccgtgaagctttgcacaaaggaagggaaaaggggaagtctgcagtggacttgaaaggccctgagtgattaggacctggaccaggagtgggagagagacccagagaggaggtacagcctgctcaaggccacacagcaagccagtgatgaccacagctggtgaatcagcctctctaaaacaccatttctgtacctgtcagctccaccaggcagggacgcttgtctggttcaccagcatatcactggcatttagaatattgcctggcacatagaagatgctcaataaacattagttgaatgagtccatctgtaaaatgggctgattacatagctactgctcggggtggttgtgtgactcagatgacactgggtggtgccagacccctagaagatactcagcaccaggttctttttttctttcctttcttttctttccttcctttctttcattcgttccttttttttttttttttttttttggacagagtcttgctctgttgcccaggctggaatgcaatagcatgatctgggctcactgcaacctccgcctccctggttcaagcgattctcctgcctcagcctccctagtagctgggattacaagcatgtgccacctgtacaggcatagcccagccacacacccagctaatttttgtatttttggtagagacggggtttcaccatgttggtcaggctggtcttgaactcttgacctcaggtgatccacctgcctcagcctcccaaagtgctgggattacaggcgtgagccaccatacccagccccaggtactttccaatcccattccagtctagtctggtcaggggtaggggaggctttgggggaaggaggcacctgctgaagttgataacatctctgggctaactggttttccagcttgctgtgactggcagcacccacgagcccaggggaagagactggagcctcctcactccccagcctggaagctcaagcctcagggtcccagctgatccccagctccccgacccacacagccctgtccagctgctcaggccctgggacagccagaagcaggtgtgaggggggcagagtgagctcctgggccccaggaccctcctgggagggtggccactggccttggggccacctgctcttcgcccctcctcactctgccctgaatgggggtctggaccccttgttcccctccatcagccactggagctcctgctgggagggccaaccctcccaactcaatctccctgagacccagagcctgggacttgcccagcccagctcctgccagccccgtacctcccaactgagaggtcctttttctttttcttttttttccccacctggagatggagtttcactcttgttgcccaggttgtagtgcaatggcgcgatcttggctcactgcaacctccgtctgccgggttcaagcgattctcctgcctcagcctcctgagtggctgggattacaggcacgcgccaccacacccggctaattttgtatgagagatcccttttctacaagggctcagagggagggtcccacgtggcagcagccccgaggtcactgtgacaagtcctctgcttctgggaagacttggccccatgaacgggatagacagggaggtgtgggggatgtgcaggacattcctgcaatctcaagcactttctattataacaccccaaggtgtagccctggaattagctgagcctccccgaggctgtccagccttccagctcctctgcagcgtgtcacttccatgtctcatggccacccacagcccctccctgggcaggatcgagtttcccaccagcaggtccgggagcccttcctccctcagcactcacccacgcgccagcgagagagctgagccttgtgaataattcacagcaattcacagcaggccccagaggctcgcaagatcatgaagctgggccacctgggtgccctgattgggccctgtggcctggggcagctcaagcctctgccctacccagctcccagccttcatatccacagcctcggtgagcaggaatccctacccgcaagataggaggttaagtgggtaccccagcccccaaccccaattcccagctgctcttcctgcataagcccagcctggcaaccacagaaagacaccttcttatcagtcgagtcacatgctgctgtggggaacggagcccaagccctctgtccacctccctgagattcatggtgactcctggggggctggcagctcatcagtccaggccatctggccactgggtcggcaccagcgcccaatcacacacagcacctggcatggcctgggagggggtcagggttccccagccccggagccctggagggcgttccacagcacagccagtcttcctaacacctgggatccagcccacggagggatcgtggcttctcagtgaggaaggcttaggggccggcggtccccaccagcacttgcataaggcgggctcagcgtcttccagttcacacttgggccatattggtcccgccatcaggggcacctgcccctctcaagacctgtccttctcctctgcttgaagtgagggggtgggacaggtgcatcagaatcaccgccatgagggtggggacatgtcccaggtgtggctcccaggccccaacctggagagtctaactcaggaatctgggacagcctccaagaggtgttgacaggagccagttggaaccctctactcaagggtccctgggtccctcctagtctaaatcccactgactttgacatgatccaaaccctagtttgtttggaagtagtgaattcataccaaagcagccaccaagaaggcctggcagggctggttgtgaagcaccccttcctccgggtgctgcctgttgggtctcccactaaccaaaccagggagccccttcttagcaaggatggaaccaggcccagctcccttgtcctgggctgaggggaccactggagcccggcctggtgggtcctagggccaccctacatccacgccagtgtgcctgggcccaagaggctgcagctgtggctaccttgccacatggccatatggccagaactggcctccagcttgctccctggtggccaggggccctgcaggcacacccagaaactgaccagtggtggggacaggccagaccctctcacctcgtagctgctctcgtcctgaggctgggtccacattcacatttccatctcaggctcccacttagactaacgagggtcacccatcagagtaacccactccccgctcagacccctgtggcatctggcaccctaccctctcagacagggcctgggcagcttttcccaggatccctgcctccccaggcgcacctaagacctgagtctcttcctccctccccaagactcacacatgccacctgctctgttcgaccccccaccccacccgggggagctcccagaccactccccaggaggtttgggatccccatgcttcccttgatagtgggaatgggctgaggggccacaggagataacaagttgctttctggatggcctccagccaggggctctggggtcaggaggtggggtgggggttggggaggggcctttctcccttaactgcttggtaactaatggggttccctttctgcctgtttgactagggcctaggaggcgctcctgcccttgctgcccccaactccattctgaacagtcttgcaaatgagcacagcctgagccagagagagcccctgcggcagaagcagcccaaggggaacaggtgaccttggcctgtgtgcccagcctcccaggtccagctgcgtgcggccgggcagctgaggatgttgggagcacctgcttgcagggctctgggggcagccccagaaggggttttccaggaggggaagatttcatgttgagtgggagccatttctctggcctggccctctggccccaggatggctactggagggatcattgccctggagtgccagagaagtgtggaaaatcccaggcatcccccaaagccctggcccggcccacccagaggaccccttaagaggagtgatcttactcagggtagtgcctgacgagaagcctcagggaggggaagtctcctttggctgcagcgtagtggataggcagggcgcccatgtctgtggccgcggtgggatccccaccgccatgatgcaagagccagttcaccaccttggggtggccaaagcgggcagtcagatgcaagactgtgggaccagaattgtctttgtcctgtgggaggagagcgggttcaagtcctaaagcctgttgctgccccgcccctggcttgggccgctcccagactcccacaggcctggaaggtagctctgtgctctctgtcttccctggaagaattggccaggcctcactcagcagtggtttttttgggtcaagcggatcctgggtttgaatcctgcttctgtccttgggcaactaattggccctctctgaaccgtacgtagccaataggcagcaccgtgcagggttttcagaggctgcaggtcctgactgcgagctgcctacacgacaggcacctggttgtcatggcaggagactggctccaggcccagggccacagccctgactcccaggggctcagggaatgcctgaaggagtgacacagggttactgggctgagcagggccaggaagggtggctgtggggctgtaccaagctagcatcaggattggggggcagcccctgcatccaacacttgccccctctctctccacccttcctaggtgtcacgtgggaacagagacctccaccttggtgcgcctccagcaacccaacctcagtgccttagtcaggcaataagggccctggggactggtttgggtaggaaggacacaccaaatgagcaggaggaatttccccatagaggcgaagagaatccagagatggtgagggagaaaagcacataagaaattaaaaacaaatgcaaacaaacaaggttgaaacagggctggagggtgtgaatgtggtgattcttctcttcctgaggagacagggtcctgcgagttttgtcacaagtcaggaagctccatcagctctgcaacacctgagtcctggatggcgggagatgatggcttaagatatctgggcgcaaagcctgaggccctgcctgtaactccgactccctcaagggcagctgagagggaggactcagggcactggggaaagtcagcagacccagtcacagaattagaataaggtggagctacgcagggaagacaacaccaactatttcctttttcttattttattttattttatttatttattttttttgagatggagtctcgctctgtcgcccaggctggagtgaagtggtgcgatctcggctcactgcaagctccacctcctgggttcacgcctttctcctgcctcagcctcccgagtggctgggactacaggcacctgccaccgcgcctggataatttttttatttttgtatttttagtagagacggggtttcaccatgttagccaggatggtctcgatctcctgacctcatgatctgcccacctcagcctcccaaagtgctgagatcacaggcgtgagccaccgtgccctgccaacaccaactatttcattggcagtagaagaatcacactctgcagctactgagaggtggaggtgaagccaccctgccgagcagccaacctcactttttggttattatccttgtgccgatgctgccggacaaactctctctacaaatctcagcatgtggaagaaacagaggcaggaacaattgcccagcacctttctatttctcgaggacactcttgaagttattcatcaatgttttaattaaagcagatcttatcgcttttcctcaaatgggaacttgttcacttttagactttgttattgttcattttgggcttatctttggtcttttcctgtgctcttaaaagggtgcaaatcaaaatctgagttatgataatccacttatcatatgactaattacttcagtacaaggagttcctgcctgtctgtccaatatgaatcttactacgtcccaatgtcacattggcttcttttccttctcggtggcagcatttggagcttttacttaacttagggtcaatttcgacctctgaattttccacccctcccccacagctgttgctgggtcatgctgttttcttttatctctataaatattgtgacttgtaattgtcacttataaattcattctggctatactgaatcattcccccattatccaagtcatccaaatattcgatgtgcatttccacaaatcatgtagtggccccctgattggggatgatttgtagaattaattatatgctttagatctccattcaggtcttcaggtcaccaatacattaagcagagcagggccctgaacagcttatatggatcaacgattgacagagctgtcggggttgctgcaaagccactgactttttgctgttccccgtaacaaagtatgttcaaatctaggtcacaggtttgtggtagggtcgattcacagtatacatgtgcaacggcgttcagtagcatagcagttgaggttgtgaagacatgtgcacccaggtcaaagaagaaagatccttagacaaagccgctcaattcccaggcacccaatcttccttgggctttgtgaacctgagatttgacaggctcttgggaatgtctgtctctaagactctgttggcaggcttaatcaggctggtggccatctccatatgtgcccccccagcatttgtgacaaaataagggaagggggacccaataaagctacttctgaaagcttatgatcccacccctcatttaaactatgtgatgttgtcattctatataaactctttccaagtaacttaactaaaacacactttgccattagtcttgagtgtgggcacagcattattcttttctaggccttaagggttccttctgcttaaaaataatgtctaactttcatgaagtttacccatgattaaagtgccttctgaatatatattatcttgttctattggtttcaatatacctattttctttaaaaagaaaaaaatgatgaaccatgagtgttaacaccagaaaaaccttaaggtacatctgatctaatttcccactttaaagtgagaaaatcaaacagtgcctaggggtttgatttttccccaggctaattcgggttttcatatttccatctcaaagtggactttctttggctaactttaagttttaaacgtaaaggcctgaaaagtaactcaggatctagctttttcattagttttgatcgtgtatgaaagcaaatatttctttcccccaaatgaaaccccagggcttccagtatttgtagtgatagtgtgaatccattaggtctatttttaattatatctctcttattggttatttttttcacatttcctaactcatttgtgatattgcttccatataattcaactttttgtgcgctgggttcccatttgccccacaaaggcctatgtgcaaatctgatatcctgtttgaatgacattgttttgtttttaccttattgcttcctatctttcacaacaatgttgtcagttctcaacattaaggcattaaaaattagcttttctcaaatgctcagcatcattaatcattagggaaatgcaaattaaaaccataatgaatatcatctcacacctgttagagtggcatttgtcaaaaaggtgaatgatgtgttagacataatgcagagaaaagggaacacacacattgtgaataggtatgtaaattagtacagctggtgtggaaaacagtatggagtttcctcaaaaaactaaaaatagaatctaccctatgatccaggaaccctatttctgggtacatatccaagagaagcttcagagagtgctttgttgggttttctggaacccggcagggctcaggtgtgtggggatgcgctctgtgagcctgtgtttcctccgccgtgagggctcctcccgctcctgtaggaaaaggcagtgcccattttgtcttgtccatgtgggactccaaagggtccagacgcgacagaaaggcggcgaatcctctcagagtgggcaggggaggagatgatagaatatggggaggagatagaatatgggaatggggcagtagaggggtgggatttcatgaaatttcctgattcaaggctatcatgaagtaggcctctttgggagctcggccctccagtcgctggtgagggtaacatcccaccagtctctggtgaggtccagtcgcctccgccgactgcattgaaagccaaaagcagaactaggccagcaccgcggcctggcgtccagtgacccagcggtctgcatattccccagggtggaagcactcggacttcaggtttgaaggcaatgcggtcaccactgcaataagaaaagcaactagggaaaatggcaccttcttctccaaacttttgagacactcttgctctgtcgtccaggctggagtgcagtggcacgatctcggctcactgcgacctctgcctcccgggttcaagcgattctcctgcctcggcctcccaagaagctaatttttggcatagagagagagaggggggaagggggggggagagagattgattttaatgtcttcaagcaaaaagagactctttctgcctgttggccatctgctgccaggtgaacgtgaaaatccatcgagacgctttctgtgaaaaccgcctttatctctttgtccctcttaggttaaaatccgcactccaaaaccttattgaacagaaaaattacaaaaagcacatataagacgtttcagttttgtaaagggtaaaatgaaactgcccttcaggaagaatcagaagaccgacgagggagagaggagcgatcgtgaaatctaagtgggctgcccccgggtcttccagggttttgtactcggtggcttggcctgagttgatgtgcccatattttcaaacagccaagtgccctgagacacagcctttgctacggtacctgctgaaatctggaagtgtgattaactattacttaaattgagtggggcagactaagagacagcagcagtgaaggatgccctttgggagaaagacgtcgaggcgctgaggccaaagggtccgtgaggaaagagcccgcagctcgcgcccctcggcctgcggaagggagggcaaggagggtcctacggttcctgggaggacgcgaagagccaagagctctgacagctggcgccggggaaaaggccccgaggcggggtccgcatccctggaagggcggcgtccacactcctgcgaggcacggggcgcccggggctcggaagctcaaagcccgccggcttctgcagcttctggagcttctgggagccaagagtgtcagccggaaggatcccgcacacggcgcttagttctggaactggatacccgggggaggatgcgggatcccgaagcccgggtgtgggtccccgtggtcttcgtgttgggggtaggtgcggaacgctaagcctgggcctactgggagccatagtcttcttgatggctggtgcttattgggcttttttcagtcgaatttcaaaatgcagttgaatttcttactttggaaacgataatagaaatggctgacctcagattttcatgattatgttttgccttttccagtgtatgtgcagtttctgtagtatagtggttatcatgtttgcctcacatgtgaaagacccttggctcgagactggagggaaacatggttttttggtttttctttttgtccctaaatttagtgagtttaatcgaggttgggaaacaaacagaaaagtagttgaacctgtggctacactttagacctcctcaatctagacagattgttgaccaggctacagtttccactggtctgccagcaagaggcctgcttaatgttagctttggttccagaaattccttaagattctcttcattctcttctgtcgcctgaattttcataggctgacactgaaagtggatgacatcttaatgcatttcctaagtgtcccgctgggcttcgctttactctgataagttgcagatctggctgatttgcgagacaaaaacaaaatatttttttaaaagattctaaatctgcatctggaacttgtagagtcaataatctgaaaccacacgaattatctacatacaaaagattttgaatgcataccccttccccaaataatcctcagaaaaccggttaagttttagcatctatgactctgagatgcatatgaggcctttgtaaatttagaagttgagagtagaaagtacaggtttgtattttagaaggagatttgggaataaatatagctctggtggatatagatcatatgttaaggtttgttggccagagctggtgtgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatgtggggaaaactctggatttgtctcttcagttgaatgtctccgttgaaaattgaggaaagaaatctctctactatttgaacttcatcaaaagactaatatgttaatattttgaccgtcaatatttccttaaactagtctactcctttcatagctaatacatcaaagcatattaacttaggaaatgggattctcccaaacaaggaaacattgacggcaagggttcttaatcttttcacaccacatttccttcaaatgctttatacatcttcaagcagacaaataatagtattataatgattacgagaccgatcattactcttttgccaaaaaaaccagcgacaaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggtacttcttcatttcattatggccttttacccgtcttttacgctgcaaaattatactgcataacctaatagtgcatttaggggcttggccaccacaaggtaaagtgacaacattactcacgagagtagcggcaagagacattcaggacactaacccaggacccatgcaattgttggactcaaacagcttagcaaagtggcaagcacgaagtctttccggtgagtcactgcagttttgatattggtacctgttactttcatctattcacggggcggatccctgcaaacccgaagaatcatcaggttcctgattcgcgtgctggaccttgggcttactgctgagccactgtagagaggatcaagaaatgacgctcttggaaggagagaagctgcgggcaggacagtcacgtcagaggtccaagaggcttcagcggcccaaagaaagggaaggtgtgtggggaagaatctgcgtggagatgaggggagcggcggggactggtccttgcgcagaggtggccagtggaccctcagggctgtaccccagacaccgtgaaccgaatttgctcacatcgtcagcggccgcggcctccgcgtgctttgtgggcccatcggtgttctgcgagggattccgtgtgtctggcaatgtctgtcaacaggtgttggcctgaaatttggccgggcacgttggctcatgcctgtaatcccagcactgtgtgaggccgaggcggatggatcgcttgaggtcaagagttcaagaccagcctggctaacatggaaaaatcccgtctctactaaaaatacaaaaattagccgaatgtggtggcatgcacctgctattccggctacttgggaggctgaggcaggagaatcgcttgaacccaggaggcagaggttgcagtgagccaagattgcgctactgcactccacctgggcgacagagcgagactgcgtcaaaaaaaaaaaaaaaaagcagcgaaagaaggcagagatgtcaatgggacaaagagacctcccaggaggcttgttgtagaggcagtgggtggatcctgggagatgagatttttttaaaattatgtagcagaatggggagagaaacggagaagcgcatgaaagagagaaaagcacgaaaatcggcggcgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgccgcctctcaagggccctttgtctgtagcttccactggtgaaataatgcggttatagtctttttcggtagagaaaacggctgtatcagtggaattttttaaaaacacaaaacgagaacgagtttttaatgagctgacaataaaatctaaactagttgtcatggtctgcacaggcttgcctccattccccatctgctaatttttatgagaacagtaaattattactattatcattatttttgagacgtagtcttgttctgtcacccaggctggagtgccgtggctcaatctcggctcactgcaacctgtgtctccgaggttcaagcaatgagaacagtaaagaagctacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatatgttttgtgtctggcctttttctccagttacattcattatactcatgagatatatccacgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgctttttcgccagcgatgacagttgaagtggcaccaaattcttgtcagcatttggtgtactaactttgttaaatgtagctatgctctcagaccaggctggccaacatggcaaaaccctgtctctactcaaaatacaaaaattagctgggcatggtggcatgcacctgtagtcccagctactccggagggggatgttgcagtgagtcaagatcgcaccattgcactccagcttgcgtgacagaatgagaccctgtctcagaaaaaaaaaaaaagtagccatacactggtgagtggttagtgctatctcagtgtggaattaatttgtatttgcctaatgagcaatcctatgaagcatattttcttatggcttccagcatataagaaactctcctttgcaaaggcctattcgaatattttgccctattttatttggcttagctctatattactgacttacaaaagttctcttatatattcaagaattgagtcttgttttgacgttttttaaattatactttaagttttaaggtacatgtgcacaacgtgcaggtttgttacatatgtatacatgtgccatgttggtgtgctgcacccattaactcgtcatttacattaggtatatctcctgatgctatccctccccctccccccaccccacaacagtccccggtgtgtgatgttccccttcctgtgtccaagtgttctcattgttgaattcccacctatgagtgagaacatgcggtgtttggttttttgtccttgcgatagtttgctgagaatgatggtttccagcttcatccctgtccctacaaaggacatgaactcatcattttttatggttgcatagtattccatggtgtatatgtgccacattttcttaatccagtctatcattgtgggacatttgggttggttccaagtctatgctattgtgaatagtgccgcaataaacatacgtgtgcatgtgtctttatagcagcctgatttataatcctttgagtatatacccagtaatgggatggctgggtcaaatggtatttctagttctagatccctgaggaatcaccatactgacttccacaatggttgaactagtttacagtcccaccaacagtgtaaaagtgttcctatttctccacatcctccccaacacctgttgcttcctgactttttaatgatcaccattctaacaggtgtgagatggtatctcactgtggttttgatttgcatttccctgatggccactgatgatgaggattttttcatgtatcttttggctgcataaatgtcttcttttgagaagtgtctgttcatacccttcgcccacttgttgatggggttgtttgttcttttcttgtaaatttgtttgagttctttgtagattctgatgaaactacagatgagtagattgcaaaaattttctcccattctgtaggttgcctgttcactctaatgacagtttcttttgctgtgcagaagcccttaagtttaattagatcccatttgtcaattttggcttttgttgccattgctttcggtgttttagacatgaagtacttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcccgatagtgattcttcctacccatgagcgtggaatgttcttccatttgtttgtatcctgttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattctgtatgctgaggagtcatttttaaaataaatatattgcaaatgacttttcccagtcagtgaaaagtctgactgaaagctgtcaactgaaaaatcacacaatttataaatttagaagggagattttattttttataaatggttacagcctgcaaggtggccattctgacagacagggaggcataccctcttgctgctgaaacctgaaaagtacgtttccagggaggggaggggggaacagggatttatgttgatgtggtgggccacatatacatattcaacagggaataggaggagctctgaatattcatgaagggatcctgctgcatgcatgctgagtaaacatgcctgttacatgcaacccatgttcattttggggtggagacaacatttaaatacattataattaggccctatgcttcaaaaggggaagcagggacacaaaggcagtcaagtgcacagcctctgtaaaccgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggcgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagattccaactactgggcaggaactcagtagttaagacttctctggggtctccttggccaagaaacagtctgtccagttggttgagtggctttggattttaattttagttctcaaagcatttaatttgatgaaattttgccatattttttctttatttttaaagcctgttatgttctataagaaatctttctactcaggatagtgaatgtattctcttaattttatctctctatgagttccagcgttttagttttaatttttaaattgatgacatctaaaattctactcctaaccaaaacattcctgggggtgaccaaggacaactccaaaaatcttccataaatggaagtaagacttactccttgaagaacttactgggatctgggcctgcagggcacagtggctttagtgcacctctgctcttacgactattcagaaattgtctttgtgaacccatcaggctgtttcaaaatcagcaatttagggcttgcttgcaacatgcagttatgcagcagctgttttgtggatctggtgagtgcctgcacgcatagttccccgggaattttctgaatttgaattctcatggtatttcaagtggctcagttgtctctttcttttcttttcttttcttttcttttctttttttttttttgagtcagagtcttgctctgtcacccaggctggagtgcagtggctggagtgcagtggcgcgatctcagatcactgcaagctccgcctcccgggttcacgccattctcctgcctctgcctccccagtagctgggactacaggcacccgccaccacgcccggctacttttttgtatttttagtagagacgaggttttaccgtggtcttcatctgacctcgtgatccgcccgcctcggtctcccaaagtgttgggattacaggcgtgagccaccgcgcccggccagttgtctctttcttttgcctactgccacacacgtaccaccaaatcctgcactccaagctgcttctacaccctggactcccaacctccagttagacaatccacatcttcccacacctgcctcaggctccatcaggctactgtgcctcctgcagcaaccaggccagggggaatctggattcctattacacttctgaggaaggtggtcagggagtgtggaggatgtgggtgggagggggtgaggttgagggcaggagtacactgtggtcttctgtcttctacctcattggcccaggtgctgctctccctccggttgtctgctttcagccctgcctgggaaatcaggccggcgccctgatcttcctgactctcattttgtgaggaacctgaacggatgagccatcgctcttgtcccacacgttctgtccaaaaggtgccctcctctctgcttgctcgggggcctgccctctgagctctggcactcaggctgggatgccgcccagtacagaggctctgcagccctgcaggggtctgactgttccacaccagcaggataaaggccacagggcatgctgtggtggaaaagcattcagaggtgtgggctgaaggcctctctttccacagtccctttgaagacaccatggaagtaggcacccccttgacagacaaggtggcccaaggcctggcttcacatgcaggctcttgggtcccagcgggtcctctctgtgcctggtatagccaactgcttcacgcatcttacccggtttcctctcctccacaacccaagctcctcctcgacccccttgctcagctgtcctcaggacagcaagatccccagcccttggaaaagcccatctctagtgcttggggagggagttgggttcaggtggtctaaccacagaagaacagagaacctgaggcaggaggaaatcccttcccttgctgggtctcttggcacagcccatccaggggtctgggtcagggtccaggtatactctaccctccttgaggacctgggttttcaggcccccgaggttggtcaatgtggagtctttcccactgttcatctgggaactgaaggaatatcccatggggccctctcttactcattagagacacccagaaaatactccatccagcagaaactgggtgcagtgtaccagaccactataattataattgcaggatgtggaggtcagatacgttttgtgggtattttctctctgtctgtggcttgcttgccttttcgctttcttagtggtatcttttgatgagaaggtgtggctaatgttgatgaagtctcatttatcatgtctttcttatatatgtattttttctgtgtcctgcttgttggtaggctaatctttgcctgccaacaagtcacaaagtatccttgaaatgctttatatctttaacttttaagttttggtgtgtaatgcggctgaaattacttttgtgtgtaacgtgagggagaataacattgttggtctccccacatccatatagaagttcattaattgaaatgatttattttcttttattgaactgcttttactgaaaacccatttattgaccgtatagctgtggatcaatttcaggttttctaactcaggctgtttatccgtttgtcactcttgatgccttgtgtctaatagcttatagtaaaccttaaagtcagatagtacaagtccttgttcttttccacacattgcaataaattttgaaatagataataactcatgaaaccatcacacacatcaggatatgctgtcacttcatccctttctgacatggtttggccgtgccctcacccaaatctcaacttgaattgtatctcccagaattcccatgtgttgtgggagggacttaggaggaggtaattgaatcatgggggcgggtctttcctgtgctattctcctgatagccagtaagtctcactatctgatgggtttctcaggggtttctgctttggcttcttcctcattttctcttgctgctgccttgtaagaagtgccttttgcctcccgccatgattctgaggcctccccagtcatatggaaatgtaagtccaattaaacctctttttggtcctggactctgttatgtatttgtcagcagcatgaaaacggactaatacactctcatttctgagtgggacacatgctgtcactcacatatgctggttgctgacttgtgacggaagattctctattgtaccctctggggacaatacatctccagttgcctgcggggaggatgaaccctcaagagtcaatgtgttgactgactctaaatatgggttcctggtgctccatgctcatgcagccatagggaaggaaaggggactatcaagagccaagggatcccccatacgactttactcagatcttggaacttttagatgctgtccaactcccaaagaaataacaattactcactgcaggggacaccagaagggagacacttttattattagaggaaattccctggtggaaagagcagctaaggccacaactaaggaaaccctggtatttcaagctgctgcgctactaccaggtactgcatccgtgtcagtgacaccatactatacccctaaggaaattaaagggactgagtaaaaggcttccagggagacccctctggatggttgctacaaaagaacaaactctattcctgaggctgacagatgggaaataattaaacattttcatgattcctcacatttgggacgggattttccattcaaattagtttcctaaatattcttcgggaagggactgttctaaactataaaaagggttaccactcaggaagccaccccataccccgatccctgcttaaacctgtacaacaccaaggaacataccatggtgaagactggcagacagacttaacccagatgccaccttacagggaactacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctgtcttcattcctcatggagatctcagtcttcaaataacatagaaagccaatcgcgacattagcaaaactctttcagtttgggggcttgcctgccctgcgtcactatcattgtttccttgggtttcccaggaatgtacatgtgtgagactgccgccctgcttatagatctgtttccctgcaaggaaacaggaatatgttgcctgtggcttccagagttggagatacatgtagttgcaccactgagggctaacatttaattttggaatcaagtgatgcattcagactggttgctatcattctgtggtatatatttagtgaacacattcatgattgagtttcttgcttttagctggagcaagaaagttttataattgtgatttgtatgaaaaaatcataggcaagggaatggatgtaaaataaactttattgtcagaggtttctaaaggctcatccttcaaggaaaatggacatatgctgaagagctgataaactgtctacagcagtgttattctaacctaatcttgattccaagttcttgccattttcctccagctactgttgactccagttatatataggatgggggaaaggggattatctacgaatgtaggcatcactttctcttgggcagttatcacattggcagactgaagggaagtgatttctacaatcaaactatccatttggagtacaaatctggagtggctgtaaaattcggttctcagagatgaacttgcagattcggactttcaattgttctgttgttttagtttttctcatcaactggggaactgtttgtgactaagctttgttaaaagtagagaagagcttttcataattccaacattagttgttacctgaaacaaacaaaaacacacacagagacaattaaacagtaatctttggtgaggtcttgctgatacctgaggctggagtgagagctgagtggtgatacagctcatgtgcgtgatccagattgcgcactccttatgagactgtaactgatgcctgatgacctgaagtggaacagtttcatatggaaaacatccaccacccccttccatggaaaaattgtcttccatgaaaccagtccctggtgacaaaaaggttgaggacagccaaaaaggctgctttaaatgataaccttccccaaaactaaattacccctgtaaaatgaatgaaaggccaccaagttagaaggatgaaaggggcctgatttctactaagatgtatgcctcgttaaataattaccagccattattccagaagtcacaagattggcagcttccccaattactgctgtgaagaacatcactattgtagaacctaagattggcctcttgagatgtcttttcaggcttttgcatttctgactgctggaaggcaccatctggcccgaaaatcaaccagtcccttagcccccacccagaagctgactccatgcaggagggccattttccacgcccctgtgatttcatccccaacaatcagcaccacgcaagccctagccccctccccaccaaactatctttgaaaaaccccttacctccaagccttcagtgagattgctttgagtaataactctgtctcccacatgtcgtggctggcctgtgtcaatgaaaccgtttcctgcagtgccatggtctccatgaattgagtttttgtgtacattggtcaggaagaacccatcaggcggttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatattttgccatgcttccagtggcctaactggccaccatgccacagaatctttactttatgatctccaaggagaactctccactcgatgttttgtgatttgagcaatggaatagaatctgatactggtgggctgggggaggtccctggacactggtgggatctcgaccccagccgtggtgtccaggctcttgacaccatcgtgagaacaaagtcaaagatgagtcagcagatagtgaaagaagagatttattgcaaagcaaaaagtacacactcaagaaaggggagcttgggcatacccaagagagaataatgggttctggggtttcatcttgatgggtttctttaaccaagaattggaatattcacgaaaattcctgggtaaaggtggagatttcttggaactgtggtgccatttttacatcaaacactggtctcagaactgtcatggcactggcgggtgtgtgatttagtatgttaatgagcatataatgagggcctaggtaaaacctccatccaatccagcaccacgttgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacatttgttaaacatctcaaataagatgtagcccaggtatttgtgtcaaatttggattattttggtttcgtctttgcagaatataaaaaactaacatgaggtaagcactaaggtgtggagatggctgtgcaagagatgacaaagtccagcaccacgcttgagagtgtccaatcatctcttctgggacagcatatttttctacaatacggatttttgaaaaaaaaaacaacatcaaaaaaaaaaaaacctacaagattcatgaaactggacaactgtctttataacattaccagtgataaaaccagtaaggacggctggtttgcagtcatctaagcagcctctttactttcataaatatggtttctctctgatattaaacggcttccaattgcaagcggaatgctgcatcacaaggataaggatgtgaagagaaccggtttcttttgtaatccgaaacattctagtctgcgaattaaaagccattatttgaagaaggatgccccggctccatctggccaccgaaaggttgctccttaacacaggctaaggaccagcttctttgggagagaacagacgcaggggcgggagggaaaaagggagaggcagacgtcacttccccttggcggctctggcagcagattggtcggttgagtggcagaaaggcagacggggactgggcaaggcactgtcggtgacatcacggacagggcgacttctatgtagatgaggcagcgcagaggctgctgcttcgccacttgctgcttcgccacgaaggagttcccgtgccctgggagcgggttcaggaccgcggatcggaagtgagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagaccgtacgccaagggtcatgtcttttttcgtattggtttgtgtcttagttgttaatcctacagtggaggcctggggaataagaagtaacatgtggcctgcacgccataggagaaaaagcgagcatcagccgtatcggctttgtaacacaaattagctatcgtgaagtccgctcagctcttccatttctaccctggctgctttttgcagggattggtccgtggtctccagtctcttgggttctcaccctgtgtgaaaatcttcgtgtttttccctaccccccaagtcacctcttacacagcctctgcttccaagcgcagcccccacaggagtttgtaggatttctgtgctagcggggagtgtgttctcacctcatagagccaggtagaaattatgcagatgggcgctgttctctgggaagaaagcagggcctttggggctctcagtgtccccgttgggttgtagacataacactcttactttgcgtaggggaacggctctgccggcccccaggtgccctagcgcatatgcatggaggcccgcaggtcagaaccgcagtctcacctgtcttggcggaaatgccctgcgatcctcccggagatagaaggcgggaagttttatgaggagccggtccagtttccctactatctcctgcagttcatatatctagtgtttctttagactttaagcgactgcttcatgtttgatgtctcactcccacatcctacatccactgccagccaactttatagatagcaccgtgacccatccttcccacccccaagaagccctttcctatttctggtgccagtgtcctccccagtccctctttcttcaggccctcgcttatcaccttcatggacagaaaatacttagctctctctcaacctgaggtttacacctgacacgcatcagtgccctggcaaattccttaataccccttctcaaatggcactgtaaatcatctctttttaactcccagaactatctaattggttttgtccctgcactacatgaacactagtattccactacagaggaaaaccccaggcctagcgatagcggttctgggcattgtgccagcctctcccagggtatgttttctgacctcacctacttttgatcagctgaggtcaggagttcaagaccagcctgaccaacatggcaaaactccgtctctactaaaaacacatacacacgcacaataataataataatgataataataataattgccgggcgcagtggtgtgtgtctgtaatcccaactactcgggaggctgaggcaggagaatcgcttgaacccgggaggtggaggttactgtgagccgagatcgcgccattgcaccgcagcctgggcaacagagtaagactctgtctcaaaaagagaaaaaaaattagtgcatctgagacatattattggagacagtagaatcctgcgtccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctctttctctctcattctttgcatcattattttttgccatcagtgtgggtttttggttttgaggttatgaagtgaatttctggggacaatctctgttgggtcgtgttaacaaggatccagtccctgtttggtgatacatgacagctaatctggtctgtgagtcttctttattgtctatttattgtcctgagaataatggcatttcctgatatttgagactgcagcaatgataagttgttcagatcttgtctttccaatgtttggtaaacattttataggcccaatttttgtcaatatctgcaagagtggcatctctgttacaagagtgatcttactactcgatgtcccccctcccacccaacttcatttcctaggggctcttggctttaacgaatttactgtatctaaaagacatcttagtacaggaagaaaactaaatctgtagcatgtaaggagcagttttatttgattggtatattcaggtttctaaccagctgaaaaattcaaatacatgccctttaaggattaagtttaaaccacactacagaaagagaaaagatttatatgatcacatataagcaatggaatcagcaatatgagtacttttcacaactatacaaatcaaatttaataatctccagaacattaaggaagttcagcccttaatggaaatgaatgaaaagaaattattcacccactgttacatgccctggaaagagaatgtcctgccagactcaaaagagtatcacaatattactcagattttcagcaatgaaggccctccgaggatctaatgatgttcatattttcagtttatttccttcactgataaacattgttaatagataccattgcctctgtttgcactttaagtgatgttacttagaacaattcgtttctttagcatgcaccctagtttggtggaaggaattttccttcttttcaaatataggatattttctcatgaaacaaattggcatactctttcagtgaagtgaatagacaaattagatctctacaattgtaaaggagtcactgccccaattatcttaggaacaataataatcacttatataaaattaaaataagaaaattaagccaggtatggtggctcatagctacagtcccagcactttaagagttggagaccagcctgggcaacacagtgaaacccctgtctctacaaatttttaagtattagctaattttttaaagttggccgggcatgataatgcatgactgtaatctcaggctgcagtgaactatgattgtgccactgccctccagcctgagtgacagaatgagactcccaactcaaaaaaaaaaaaaaggaaagaaaattaagaatttgttgaaaattgttttactacaatgctaggctgcatgtcttgcacctgtactcccagcaactcaacaggctgaggcggaaggattgctttaggccagcagttggagaccagcctggggaacagggcatgacatcatctctaaaaaaatacaaggcaagctgagccaggaggattgcctgagcccagaagttccaagttggtcagctatgattgccccactgcactctagcctggataacagagcaagaccctgtgccttatttttaaatttatgttatttttttactacttatgcttatttatctatttatttatttttgagacagagtcttgctctgtagcccaggctagagtgcagtggtgccatctcagctcactgcaagctctgcctcccaggttgaagctatttccctgcctcagcctccagagtagctgggattataggcacacgccaccacgcccagctaatttttatatgtttagtagagacagggtttcatcatgtttgccaggctagtctcaaactcctgacctcaagtgatacacctgtctcggcctcccaaagtgctgggattacaggtgtgagccaactcgcccaggctccttatgcttgaaatgtgaggtttcattagggaaaaattttcttgttgaatttctaacatgaaaaaataatagatttagctgtagattaaattaatggtcctggtagtttggtacaataaaataaatgaagttgatagcagagaggaatctttgatgcttttgaacaatttaaataatgtaatattttttatataaagacatgaaaaagttcattacattattattatatttatttatttatttatttattttgagatgtagtctcactctgtcgcctaagctagagtgcagtggtgcaatctcggctcactgcaaccactgcttcccgggttcaagcaattctcctgtctcagcctcctgagtagctgggattacaggcacacaccaccacacttggctaatttttgtatttttagtagacacggggtttcaccatgttggtcaggctgtcttgaactcctgacctcatgatcctcctgctatggcttcccaaagcgctggggttacaggcataggccactgcacctggcccattacattattttttaaaaatcagtgtgactcttttgacaaattagaatggtttaataatcttggttaggctgggcatggtggctcatgcctgtagtccaagcactttgggagcccgaggtcaggagtttgagaccagcctggccaacatggtgaaaccctgtctctactaaaaatacaaaaattagccgggcatggtggggggctcctgtaatcccagctactcagaaggctgaggcaggagaattgcttgaactcaggaggcagaggtcgcagtgagccaagatcacgccattgcactccagcctgggggggcaacagagtgagactctgtctcaaaaaaatcataaataaataaaaataaagtataaaaaattaaaattacgtgttcaaatacattaaatatatggcaatgaaaaggaggcctagcatgactgactgcattttgctcctaacccttcctaccgtgtggtgacatcttccaggctaactgctttttcttatttctgcacataggccaagctatctatgggagggatttagcttacagtttaactttaaagcacagatgataataatcccttccccaaactaactcctgagaagatagagaggttgtatacacaagtaacagtgttatgctgaagatttataagagaagtgtgacctgacaaaggaccaacaattttcaccatccccttgggctctcactgcagcccatgtctgtcattgtcagacctcttcacctcaatcgcctccttcttcctcccttccctaatgtacaaggagccggaaaatagtattaatttaagatggttcttcaggatgttacttcaccatctgttcagtttggtggctctctggaataaagtcaccttccctgcccctacacctcaactctcgacttattggctgtcatgcagcaagtggtgagtgcagtaagccgagatcacaccactgcactccagtctgggtgaccctgtctcaaaaaaaaaaaaaaaaaaaaaacagagagagagagagaaatttggtttttgaaccagacaaattaaataggagacttaattccaatgagacctagaaatgtctaaatttctaaaatttctaaaagaactgagaaaattgcctccattgaggaagtaagctgaaggaggtagactgtcatgttttctgatttgagaaatattgaggaggctttgtctctttcacctccaactgctccttctcctcctgcccctgcacctgcatagtctttcttacctgagccttcctgtcctgccttgcctcttcttccatcaccatcacctaaggaaagtccccagggatctggtcccttccctgaaacttctgttctgacagcccctttcaaggtaaaacccaaacccacaggaagaggggagcctaccgttgtgtataccacttcaccaaaacgtgaattaagaatattataaaggacttccctgatctaaacttaaatacatttcactcttctgtttctaaagcaggctccaagatcctgtaggctttggcagaaaatttgacttaactgttgaaacctttgagcccaaatattctgatctttatcaattaactcacatgctggtgaagaagggaaggccactaactggttgcaaaaggtaaattggaaggattttcaaaaagggactgaagcagaacatgaaaggttcacattttcaccaaatatctccaagttgccattccccaggtccttcctaaaaatatagattggaggataattcagcattgtactaaaaagccagacaaatctgtctttgcttaactaaaatggtttgagagccaggtgtggtagttcatgcctgtaatcccagcactttgggaggctgaggcgggtgaatcacttgaggtcaggagattgagaccagcctgccaacatggtgaaaccctgtctccactaaaaatacaaaaattagccaggtggctactcaggaggctgaagcaaaagaattgcttgaacccaggaggtggaggttgcagtgagctgagatcctgctactgcaatacagcctgggagacagagcgagactctgtctcacaaagaaaaaaataaaaagaaaaaagaaaaatagaaaaaaaaatagcagggtagtagaaatataatgcacacaagaatgataatcatgaagacaatctgattctacaagagtaagggaacctattccattagagagccaactgaaaacatcaaatcccagttcacaccccagggtgtggggtcacgtgcctgtaatcccagctactcgggaggattagtaaggaggtttgcttgaattcatgaggtcaaggcaggagtaaaccctgatcatgccactgcactccagcctgggtgacagtgagaccttgtctcaaaaacaaacaaacaaacaaacaaacaaaaacccacaaaaccaaacaacaacaaattgccacctcactctgaaatcacagtggcaaacatcactttgctattgacaaattaaaagaaaaacactccctcttgctatcaacctggcctcttgctctaacatgtctgacccatggtttaaaatgcccaaaagctgatgtcctcaaattataatacacttacctattctgcaccagcatttatttttgtctggaggagatcaccatccatggtcctgtaaatgtctaacagcatggaatgatgaagggcagtgtcttttaggatatttggttatatctatatatatggctctgaagaaacccaacactgggcgagttccctcaaacttttcactaggcatgaccactgctgtattttagatagagattctgtggggcaaaacctgagaattatctgcctggctatctagaagatagctccttgcattttttgggggagaacacttttgcttcaagggagtgtttcctcccaggattagaaatctttctgtaacctcaggaaacattgctgatgaaaaccaggcatggtgtgctgtacaacttgtagtaataaggcagaagttaaaaggaaaagacaggttccctgtacttggctgactccaagacctgccatagatagagccctagcagatcctcggtaacacgatctgaaaagtcagagccgcgaggagtgagttccggagactctctcaacacagtaagccccaacaaagataagaggaaaaaacaacaaatgcctttactaccttctctttcccccttcccatttctaattattcaagttttgttaagttcttgatttcccttcagtgcagctgcaaggtcaccagctatacttgcattgcaagacctgtgacagtttgattagctgcctttgttctgcttctataagccctcttgcctgcccccgagtttcatgccatcaaattcccgccgcgccattcaaactagccgaccccctttcagaagtgtctataaagttaagccctgtctttgttcggggctcagcctttggattttcatctgctgggcctcagtgcagtcaataaatcctcctgttccacccattggtctctctgttctcctgattcccacaacagtagtaggggactgcgttcccactttcccctggtctttcatggtatgaataatggacagcatttttttttttcacctatagtcgcaggctcggtctcagtgattgtatgctgtggtcagctgtttttgtttttgtgagaccttgctttcttgtttactgtcctgggacagatgtctgtagtcacttgtttcctcgggaggcaaatttcagtctctgtgggggaggtctcccatgttagctgtggtggtacttggcaggcagagctcagggatctaggcttccgtgctttgtagattgctcaatggtccccaaggcctagtggcttttaacaccacttgaaaaccttagtgtttttccactgtccccagagtcacctcttacacagcctctttttttgtttgtttgactttttctctgagagacagtctcactgtatcttggttgaatcgatcctcccacctcagcctctggagtagcagaggcacgagtcaccacagccggcttatatctgttcttgtttttgttgttgtggtggctgtcttgtttttttaagagttgaagtttctccatgttgcccaggcgacgtgctcccggcgaaggaggccgcctgcctgggggcgggctggagccacgtcccagggctgggggcgctgtgggcactgtgggtgccgcacccaccgctgcccggcactggaggccaagagagcgttcccgacgggctccgcggatgccccgccgcgtcctgctgcccatcctgcccgggttgtcgcgggccgggggcacgacaagaggccggggtctgcccggacgcagcggcctgcagggcgcagctgtccctccaccagccggggtcccctcgctcagcccatgagacaaataaatgaatacataaataaataaataaataaaagatggagtcttgctctgtcgcccagggtggagtgcagtggtgcgatctcggctcacttcaacctctgcctcccaggttcaagtgattctcctgcctcagcctcctgagtaactgggattacaggtgcatgccaccacacccggctaatttttcgatttttagtagagacgggatttcatcacgttggccaggctggtctcgaacccctgacttcaagtgatccacccgccttgacctcccgaagtgctgggattacaggcatgagccactgcacccagccagaagtgggcattaatatgcaggcgccgtatagggcaacatctgtgtgcacctcttacaaatcttaatgctgtgtatatgaggggagtccttcgtgtccccctggggatgtttgaggttgcctgtatgtgttatgtgtgtgcatatttttaagctcagatatgcataggcggattgacacctctgtttgaatgtattcccatgagctcatgccattaattcaccatcacaagaaatatttactgagcgtgagccatgccattccacagacaccattatagcactaagatacaatgaggaacaaaaaatccaggctttctgagctcacactggggtgggggcatggtgggaagacacaggcatcaatgtaataaacagaaaccacgacagggctaagtgttctggaggagaggcgcatggtgtactgaggcccctgacgtagaccccaggtgcacctttgagctttgcttgcatggtttgggtttgtgggctcacctgcatgtgtccatgcatgccccatctgcgtgcccgtgcatggctgcatcaccccatgcacacgtgcactgcccctgggcttgcccacatgtgctgctccccagggcgccaggctatcagcctacaaggcattgtgggtctgggcccagcctgccaccccctacagaggcctgagcctgccttcccaggaggcccaggactctcacccagggcccttccctgcagctggagcaggctctgtggctgcaatctggtgagctggagacgcaagagcccagggggctggtactccagagcgtggagttgcggaggcagctgcaggaggagcaggcctcctagtggcgcaagctgcaggcctacctggagggccagcagcggcaggcccagcttgtgcagcggctgcagggcaaggtcagggccacccattcctgctctttccctcccacgtgttcactttgccctgcccccacccctggggctcaccatcagctcccaatccccagattctccagtacaagaagaggttctcggagctggagcagctgttggagagatccggagagctggagcagcagcagctgagggtgggtgccagggtggggcagaggcaggccctgccctccacctgcccagcctgatgctttaacctctctgccacccaggacgcagagcacagccaagacctggagagtgccctcatctggctggaggaggagcagcagggagggccagggctggcagcatggccccctgggcgagcgcctactgatcccctgtgccccattcaggagtgccagcctggcccaggtgaatgccatgctctgagaacagctggaccaggcaggtttggccaaccaggctctgagtgaggagatacgaaaggtgaccagtgactggactcgcagctgcaaggagctggagcagtgggaggcggcatggaggcgcgaggaggaggtgggcatgggggtgcagggaggccggcgatataagaggaagataatgcacaattatgctagtgagactctcttttccaataatgtttgcacttctcaatactacatttaaaaaggaaataggagcacttgaacggttaagtaagaagatgaacaaaattgaacagaggaaaaataactgtctgaagacatgttgaaaatacatttaaagacagtctgtctgagacaggagctgagctggccaatccatcttttaaatcattgaacatcattcaggtgtcaagtatttgacctggagcctggaaggggaggagagagtccaaaaaaaagtcaaaatataaagaaaaaaaattaaagaacttgtcccacaaatcaggcaaccaaggtctaaacttataccctctgcctgggtaaattgttgttgcttctttctgtgactcttaaaagatgtaccatatacctcatttaatgactttgctttattcatgaaaactctatccccatgggaaaagctgttaaatgaaaaaagatttcttttaagtagaaaaattatgaaaggattccttccaaccctccatacccaaaatatctcaaatgaattatgtatctatcaattatcaatatatatcaaaatataccaattaaaaatatcagttaaacaatacgtcaattgaactatgaaagcaagcttatttaagtagcaaagaataacgtgaaggttagtaagtatagcttatacttaaaatacaatgaattgaaagctcatggcacttcatagagtaggaagaagaaacttaatagaaagtggtagttgggcgagaaggactgcaagggagttatttggaaaatgcattttttatttctgcatcattttgttcacaaattattcctaatcttttgtgaatttgtggatttcttgaactcaaaccagacttaaaaatacagttatagcacagaaaaaaatctttaatggcaaaataaaagctaagcaagagagcctttcaaaacacatgaaaataacacacacatacaaaaaaaaaagaataaagagatgtacaagtgacacctcctcaaccttctcacttggtgtacatatgcacagtaaattattttgggctcagccaagcatgggagcaattcaaatagatccatatgatattctctgattagaaactcttgtggagtaagttggtgagtgtatctttgcctaaaacagtcatgtcaaaatatagcttcctatagcatatttatttagtatcattttggtgaaaaagtggttatacagaatagaaaagagttgtccaaaactaagtggttgacctttccagagccattacctgcagaattgttatgtaagtctgttccatactcataaaggaatactcagctgacccaactgattttctcgtgttttttccttcaagggctagtagaagtctatatgttgtggtggaaaacaacctcagccctatagtccaacatttgcctatcaaaacttgtcctatgatttataaaactagaacctcactggtaagtcacattcctagagtctcccccatccctaaccccagtcacggaaaataaatcaaatcattgtcactctttcttaacaaagagcatacatttaaaacttgagtaaaattacaggtaccgtctgggtccttcaagggggaacttgaagtctcaataccgcagttgtccaatcagaggatccaagatgaatatactcaaggactttatgcttggcatcctctggagacagtacataaccaccagcttggtttaactggagattcatttgggttaggagaaattatgtaggcaatgtacttagtcaatggaggcctcatccctgaagacttacaagaatctgaattcgtatgttacttttcctttaatggagtggaattccaaatgaaaataatcaaacagcatgtgcataaacattagatataatacccacatttacaaagcctttatagatatgcaagtgttattgcgtctgtccctagcttctgtacagaatttaatgggtagctgttactattttattgctgtataaaaatgaggaaactgataagttgtctaaaggtgcacaatcaaaacacatcaaagccattgtgaaatacaggtccccggatttcaaaaacagatcttctgcttataaattcagtctttttcatactgccataaactccagaatgggaaaacaaagttactatcagaaaagcttcttttagctgggcgtggtggctcatgcctgtaatcgcagcatattgggaggccaagacaggcggatcacttgaggtcgggagttcgagaccagcctggccaacatggtgatctctactaaaaatacaaaaattagctgggcatggtggcggacacctgtaattccagctacttgggaggctgaggcagtagaatcgcttgagctggggaggccgagatggcgtagtgatccgagatggcgccactgcactccagcctgggtgacagagtgagccgacatcgcgccactgcactccagcctgggtgacagagtgagactccatctcaaaagaaaaaagaaagcttattttttcccctaatcaccataatattcactattaagtgagggaaatagaaataatttatttagcaaatcctttctagttcaaataatttgtatacaggctgtgcaaacataataatgagattctttttagtcatcttgctttatatcactaattacactcttatttaatgatattttaaagaaaaacgtgtttattttcaagtagaaaactcatatctgtccaccaaggaaagctgtaacaaatgtaaaatacataaaaaagataactgctaaatttctaaagcattccagaaaaagacaaatagaagggtgtcagattaggaaagtatgtcttgtaaggtgtaacggacagactgatgagcttagagatgtggatctcaaagtggttctcagagcaacagcatcagggtcacctgggaacgtgttagaaatgcagattctcaggtaccatcccacatttaatgaatcagaagctcagagtagagaccagcaatttgttttaacaagtccttcagggattctgatacagctgatgtttgagaaacactagctttaggtaaacgtaagagggtcacgttagtatttttaaatcattggaagttggtttgttttgttttttcttaagtgggactcatttatacttcaatacacagaatggatatttagaggaagtcgtttttgacctaacacggatgagcatttccaattgaatagcgctttctgataatggggctgcccactacaagtgaataactgggtttctctaggctggagctgcagacaggtcactatgtgtatggaggattgtattaatatgatcgtggctctttatagctctgcattactaatattctgttttaaagtctctcctcaatatccaatgtctctgtgtgaatgatggtaaggagtgggtaacagtaacaatcatcctgttgttgacaacagatgataagagaaagcccaactttacactctgtataaccttacaccaatgccccattcctcgtctaattttttttacatgttaacacatgaccttggcattactaaataagaagccctctcacttagaacccgatgcagtatgataaaaattattttgagaacaatcaggagctctagttttcaattctgcttctcttctcaagtagttctgtgccttagtttcttctttgtaaatttaaatggttggaacagaggatctgttaagtgtgattcaagctgaaattgtatgtagcccacactgagtttctctgctatacccctaacccattcaacaatcacaccaccagttttcaggactcacagtaggatagccgtctatcatttgttaataggtgtgctctttcatccaaacaagaaactcatgatttctgcagttttttattctagccaggttctaggtgctggcctggaactataaaacgaacatttcacaaaaagttatgacaatatacaaaggaaagacaatttctttgaatatccataatctcaatatgcagtctggctgtggatggccaagagatagtttccttaactggaaaaagcttttaaatgaggcttggtggaagatatatctttgcatcattacaaagaagaaaaaagagaaatctcacaactgaagaaagtgaaatccactttacttaatgcggacctctgtctctggtgtgcaggtcctctgtgtccaaagataattagcactttataatgctaattattataattaggtctgagaaaaaaatcattagggggtaggcccgttcactgattttcaactgccccctctatttaaaaataaggtcatttttctatgaaatacctttaggagctcaaagcagaaagagggttatagaaaatcctgtgtaggtataagcctgagtttttaatattcttataattctgtgatgtgtctggaaactgaaccgggaggaaaacagtgaacctatttagtccaggagactagaaatcaggactcagaagagtaaacatttctgtaatagttagtcctcaaatagtcattcattgaccttccactgggtgtctggcaatgtgcaagctgcttctagatgctacctcatgtaacaaccatcacagttgcacagagcaagtactagtactccactttcatagataaagaagtaaaatcttagaaattagctgcccaatgtcatgtatgtaggaaaggaaagctggattctgattcatatttgctggctccaaagcacttgttgtaaatacttcactatcctgtgcttacatgtaaatgtaccatttctcttaggggtcttgaaatactgaaccaaagaatggtgtaggggaagggcagtttagaaatacctggaaatttggttgtttgaaggaagcccactctcagatggtaggagatcaagctaacagaatagctgagaatattttctgaggccccagaagtataaaaacggtctaggggggaaaatttgggacacagagtgaaaatagcctgcctctgaagaccagcttcatttcttcccctctgggtgttaatgaaagagcctttaactttgccaggcctcagttactaatttctaaaacaactgctgctactattactacggatcttactgctactatgaccaccaccaccaccacatcagttactgagaactgaactagatgccaagcaaaaatggtaaacacttcatatacattatctttttaaacacaaaatgtactattaatccagttttacatataagaaaactgaggctcaaagaggctaagtaatttgtatgtgaacatgctttacactatgtaaaacaccttattagtagatatcactattattaagaacctatcagccggagaggaagaattggccttttatctttctaagatgcacagttgtctttctgtttaatggttttttaaaaatccccctgtgacaagctccagaggacaaataatttgtttcttgtggtgtatggctctctaaatgaattaattgataggcatcccattgtcagtctcagggatgtggaaataaaacagacatgagatgttttttaccaaactaatttgtgctttaaacacataaataataaatatatatatattaaagtaaatgtgtatttaccgtctctcctgctccactttgaattcaagaacccgtgtctttgttgggtcactgcactgtcaattgagaagtttggttttgtttctttgagtgttagtaagtggcattaaatggtaaatattgccgggggaaagaaaggagaaaaacagctcttccaatccatccctgtttccattcaattaaaggagggtagaaagaatacttaagataattgtaataagtctaatagaatagcaggagccactcttttcctttcagtaggccattagctcagaactattttcagagtaatactaagatgatatttgccttttcactgtgttggcacttgtattgataaggcaaaaacagtggagtcttagcaaaaattaagaccatgaaaacaaactgcactaggaataattctcttcttcattactgtttacttgcagggggaaaaaccattttcgtttaagaaagtccttggtgaagtagtaaaaatattaattttattaaatctcaaccttgagtacaagtcttgtccttgactgtacttacaagttttgtcctccccaaagcatatggcgtcaaggctgggcctaacccagtctcatgaccttgtgaatccagtccacaaacacagagacacgcgtgaagacggctggccagcgcgaccttgtgcatactcggttggggattctaattcctttcaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcgctctcccgcacatgtcctcggtgcttgatgttacactcctggttggagatgacgttcagcaaggccacatttaggactgtgtcattacccgtacctgcagtgaggggaatggggagaaggagacggtcctggaggaagatccagggctgggcctcctggccaccagcagtcctgtgcactatgctcttacctttggtctcaccccagcctgcaatctcacacttggtccctggaggcaccacataccattcaggcggcaggcagatcagggccacacgctggttcagggtcacagatctttaacaagaatgggggcactcagggtctgaggccacaaggctcagccccacctcacatcctcccaggttgtccacatacctctccagcttgagcaggacaagctgggagcctgagggcccacacagcatcttggctactgggacccgctgtaggcctggctctccatgttgtgggttctggaacagggtgcccaaccatacctcatagcccgtgagaggcatatggctgggagagaagctctgctaggtcatttgtgactctcagtccgttgccccaaggctcacttgttagcttgcctggggaaaggggaaagtgggatgagactgggtccccaaacacaagggaggctcaccaggaggagaagcactgccgggcagtcagtatccactgctcctttactagagaccccgcgcagaaatgctggccctgcctagaggagtggggaattaggacagggaacagactcctgggacagatgctagacctgccatcttctggctaggacctctgggggcagggatagattcccagcccccagtggcataaccacagaggacacaacctcagctcctctctgtgggagacaggcagttgtgcctcaccgattccgcaagctgactgtccagggtgagttgcccggatggcccccagccacgcgcagcttggaacgacgctgatccagccgatccaccctcttgccacacttctcaaactgcacctggtctgtaggatggggtgggctggatgaaacccagactgtgtggatgtcgtgggctaaagggcctgacccataactggcccaactcgtaacctgggggggtccaggattgatggcggctggtcatcagctgaaagacaaagttcactggggttaagggagccagcctttggtggtgagggctgaggtaaggtcatggggcaagcgtcactagtgctcaccgcagcgtcgcagggcacagtagtcgaatggggtccttgggtccatcgtgtagcaccagggcccatggctatccccatctgggtctggcagaagttctcctccagttgtgcatgcggttcggaggtaaatgtgaaccgaggcgggagcgggagcaaaatcgtggcagggtagtctcaaccatttccaggctctggtcccagacatcaaagcatgccgccccagggttagggccctggcggggccgggagcaccagggactcactgcagcttgtgcggcgtctcagcggaccagcgctggcactggacacccttgcgggtcttgctgaccgtgccgcggtactgctcccccgcgccgtggtagcagtctgcggccggtgcgggcagccatcaggccgagacctcgccccggccctccggttccaggcttccagccccggctctgtagcccccaagcttgggcctcaccctggggccgcacgtcgtctgtacaacgccggatctggtagcaaaagcccacgcgcgtgccgggccgcagggtgaagcaccagggcgcctctgagccgtcgaggttccagcagaagttctcccgaaggtctctaagcaggcgctccactcagccctagcccgccagcctccagccctaagcccgtgactaccctcctcccgtctcacccgcagcagcacgtcccaacgcccgcccccccgcccacctcacttgcacgcgtatttttctggcgtaaatcggtgctgatgtgggatttgcgcgtcccaacgctggcaaggtacgccgcggtggtggtattggctgtgccccggtagccctcacccttcccgcggaagcagctgacacttgtggcctcttggcggggctgtgcctcggacccttagatggaccgagataggtcgggccccgagcgacagctgagatccctctggggctgggaccaaacccgcctttcccaggtgtacggtactccacgggatatgctctcaggtcacgcccagcccctctgacctccccggccaagccacgcccctccccaaggttcccaggtaccctcccaggcctggtccccgccgcctaccgcagcgggggaggtcacagaactctcgctcgatctgcggatccgtagtgtagcaccatggccgctcggagccgtcaggattccggcaatagttgtcgtccagaccttggtcgaggaacctgggggcggtaatggggcgtgaagaagaccctggtactctggcttatctggccccgcccagttgccctacacggagccctgcccctggagtcctggaccttccctagcccggcccccagggcgccgataccgcctacgcgtacttgcccggctcgaaggggtgctggtgcgggtgctgaagatcccagcgctggcactcgcgccctgactcggtgcggtctaccgcgccgcggtattcctcgccattgcaccagacacacgcggctggagacaaagagccagtgggttcgtggatgggcgtgggcttgcccctccactctcccagcttgacccggcgccgcttacccacccggcaggatttgatgctgcagctctggaagcgcacggcagggtctgttgtgtggcaccaaggacctccggggtcgccatcagggttacggcagaagttctcttccaggccattccggagcgtgggcatgtacctgagggcccagagcatcactatagtgtgtgctgggggaaggtcccaggccgggacggagggaaggtgtttgtctcacttgtgatcgttcgggaacttgtggctccaagcctggcaggacaggccacccacggtcgtggccatggtgccccggtacccaaccccattgttcatgatgcaggtccgtatgtagtctgggagcaagagacagaagatcaacttgggctgaggtcccctgtctcccaccctgcccctctccacccccactcgcctttctcctggaagaggtcacagcgcccagaatgccacagccttgagtggggcgagtgttgagtccatggcagcagttggcaaccatggctgctcacattgtagtggaacgccctggagagaagaaggcacagggtaacgccacggcccaggctcccctgcccccagtcttatctaggcccagtggccactcaccagcagtccattaagggcccacagcgaccagcacactcttcagcatctgccacatcctcctgccaaggcccgggcaccaccgcatgtagcaggtgctgtagctctgtgccccggagcacctggaagtcattcgatggcgagcgctgccctgcagagtgggcatgagtgggtgcaggtcaggtgggcatacatgtcagtaatgtgtattggcatgtccacactttgttcattcaggggatcaaagctacaaggcttctgggatggaccctgtatgcactttcaagggccagtctagcccccctgcacagatacttgtcaaaaaaatttcccctgggaagcaggcccagacttggtagttatcaccggtgcctctgtgtagtggcccaggcactgggctcagatctaacacatacgctctgtgagagcagtgggtgatggagcttgccccatctcatctctcaaatgagaatgctaaggctcagagccatcacattacccagccaggggccctggctaggcattcagactccaaatctgggctctcacctgcacaaaggcatacgctaggttagaggggtagatcaggctcaggaggggtcatttcctgctgtgtgcgtgcatctgtgtggtcctaacactgcttcagtgctagagcagacgtgctaatagaggcctaagtgggccgtgtctgtgtgttcctagggcttcccagctgtgctcaagaggccaaggtcactgccccatgcccactgagcctctggctccccgacttttttctcatcccagaataggagaatagggccaaccccctcctgaaggcagatggggatcagggttgggggcactcaccagggacccctaagtattgagtcagaagcagcaggagtgggagccactcctccaggatgacttcatcttaactaattatatgactatgttgactgcaacatatgtatgaagtttcatatactcaattcctttactgcttccttgagcctatgaaccccctcctgcatctcctagtcttcactgaacattatgtcaattctcagcctcagctctaaatgctcatggtttccaaaaacatatttacaacccaccataggtcctgagcaccaaagcctgatgtccagttgcccagtggacagacatctccactgggacatctcataagcactaaaaatctcaatgtactgaaacctgaatttatatttctctccccaaatgtgctccatttccatcttccctttctcaacatccatccagtggaaatgttgctcaaacccaagtccagagccacccttggcacgctcatcttcctgagccccccacttccatcggccacccaggtgcttgtcagtttgcccactttctccctctccacagcccttttcctagttcagaccttctgtctcccttgttgggatcatgtcaacctcttcctcactcgcctctggctctgggcttgtgccttcaaccgactcttcaaaccgtagcaagagggatgcctcgaatcacagatcagatccctctctccttaaagccctgcagcagcttcctgtggctctcaggatagaattcaaacacttccaggatctgggcatctcctgcccctccacagccctgcctcgccctgcattccagccccaccaaaccacagtcagtcccttccatggttttggatctcttgtctgggaactttgcacctgctgttctctctgcttaaactctcgctttcacccatgcgacctggttcactcctcattctcctgcatgtctcagcttggaagtcacctcttccagaaagccttccctgaccctcaggtccaggttagatcccccacctggattcccacagcaccgtgtttttcccctaccacaaccctagtcatgccctttagcgaacagccaacagttactaagcacctgctgtgttaggctgtttcttaggactttataagaaagatcacatttaatcctacgaagtaggtactgctattatcctattttttagatgaacaaactgaggcaagagcagtcacacacacatagagtcagtaagtggtaaagttgggatagaaaccaagacaatctgactcatggatgttacaccgtgtgttagaactagccttgaaaaaaagacacaagcttgtgccctgtgccaagaaagtttctgataatggtggcggtggtggtggtggtgggatttaatcagttggcagaagtctgtatttctaacaatctctgattcaaatgggcaggacccatgtccatttctctttattgcaattgtactatgtttcttaccttcactctgcaacaagcttggtgaagacagagaacatgtatctgaggcccttcatctcccctcagttcctagaccagcactagcccatagtcaaccctccatcaaagtagagggagaaagtaagtggcttttaccctgtgctttctgaactcctgggatgctaggaagagccagaaaaccttgtccaccgaacccacaaattcactctcttcatcccttcctcactccacttccttcccagtagttgttggagtttttgaattttccctctgtgagcccttgccctcccctgccatgttctcagcaaaggccctggcctccaggtccatgagaacaggattccctgtagtaagagctcttccctagcctcctccacttccaaaggggctggaatcttcaccccttgatcccttccctttttagagcacagaggaagcggagccctcctcctgccctgggctcccatgccccacatgttcctggagagcacccttgggccactgttgtaactacatggtgacttgcttgctctcatccttcatgaccccccctcctcccatgccccactttgttaatttcactctcctctcaaaactccccacagtgccagtgatggggtataaatgcagctgggcaacgaggctcccacagacagacccaaacctatcttccaagtgttaatttcttttctctcctcttcttcaaataggtctcttccttacacatttctgccattcctttctctctctgccttgcctctcccttttctcccggccacagccttatccaacctcccagcccagcttggactcagctttcctaggaggctcccagacaatccagtgggctctcatttttttgagtgtattcagcagttggctgatgctgcatctccagcacttgccctaggttgttttatctccctaatggcctgtaaaccccttgagggcaggatctggcctttgtactctaaaaaggtcttcctactagagaatgctccacacatgtgtgatgcttcggggagtcccaaccttcatcagagattcccactggtgccagctcatagctcatcatgacgtgtcccagatggtgactgggagtagcctatgccaagcaggagtttttccccgaagtcttcctgtttattgcaccgggctggctgcaagacattgaggatgctgccccaggggccagcagggtgactggggcaggcgccatgatggctgtgcctgggtgctggccagtgtggccccaagaagaggccgggagccagagctgcatgccctctgtcagcaccagcctcctaaaaacactctcgactttctccaagcatggattgcctgagctcccctcctgctccccaaagaggccggggaacaagtcagacaggggataagtcagacaggctcagctgtgggaggctggaggaaaaagaccaataaaactgactttatttgtaatgttcccatgtttgtgattttgttatttctactctgtttcctcagagcaatgaaacaaggaaacggaacaaaaaataacaaaacccagctctaagtatacgtgaactgtaaggcctccctctggcctcctctcttcctccttcctcaccaggtttgcctggctgacccttccagccagtgaattcctttcccaggttgagtgttttccattttaatttttgtggcatttccctggattaatggttaacgcattcattttctcccctccagcctccattatcaaagagtgctttgaataaccattaactctctggttaagcgaaagaaacacgttaatcatctacaagtcctggggcaggaaaattattcttggtaaccttctcccaatggcaagaaaaccactgtccctgagcagctcaacttcagccacacctgggtctacaagcttgcaaaacccctccggtaaccttgttacaaggacttggtaaactgaggtcataaactgctgaatggctaagcgctgtgcttttcaacccagccaccaccggttctctaggaccctataaagagacaaggctgggctgctgcttctccctttacttttaaaaattgttttgccagtaaagtctcatctattgtacattccttgttacggggaaactcaagtggctgtacaggctgttcttggagccacagttaaaagcgctttgactcaaacacacatgtggcgtcatcctgagctccgtttgcgtggggccggaacaccggactaggaaacctctccctgctttagcaactgagtgtggctagattgagggaccacagggggtggctctggatgcagcaatccaagtccccttttcagggagggtgacctctttccgaagttcagtggatggcccccttccagggttagggagacaggaggaggaggaagaagaaaaggaggaggaaagctctcaacagccccccacccccaacccatccaggagagaaggactgcagtccccgagaccagctggaggagtggcgtgtgcatggtgtgccctcagggtagagcgcgccatcttggagagatgcctctttcattcacaaagcggatctgttgcagagcccagagccccggggagagcagggcggcgtccaagtgcttgctgggtttggcttgcactccctctcccttaaagaagacagaggcggaagggagaggctgttcttcggaggcgagcctcaggcactgctagacttagtaggaaagatattgctggggtcttggcaagccgtaggtgcagcgctccccatcgtcattccggtgcggctggttactgtcaccctgcctcctccccgccggcctgagagcctctctgttccagatccaaacatttccacattaggcagcctgcatgtgcatttccctggcagtggagggaaaggcacccctgtgacctgggatgaccgacgacggggacttgccctcctcccccacaggtgcacttgctcttttctgggccagccttgtgatctggtgtccgggcacttggcagcatttagcaaatgttcctcagtgctctgtttggtagttaatgctgttgacacggacacctttgggagcacgtgggagaagctgctgcctccgtttcccccgggttacagcgcctggcgcagtctgttgtcccctcagaagtggtgggcgacattatctcctttttcatccctagccctctcccttgaagctgtcctgatctctcttttggacccaggaacgtgagcagaggttactactcactatatatacacactgcatctagactcatgcatgccttcttggtgtcaaggacacctcacatttcaaagacttcatgaaaaagaacgtgaggtatctcacacggtgacatgataaagctttggacaacgtgggttaagctaaaaacaggtcattacaattaattgtatctctgtcttttgacccttcagtggctcctgaaatccatcacacatgtggcttgcaagtattttggtcggacaacgctgccgtagattgtcccactctgaaatggttccctctgggcttacgggactgctatagaagggtcctaaggtcctgtgcctccctgcttttcaagtggctgcaaacttctgtgcctaccgcttcctccactggatgtttccttcctgccctcctccctgaggacctcctagtccctcttcaggatgcagagctggagcctccactccaggaaagccactcatgttgttgccaacacaaccccctgcacacatgcagtattaggcattggtctgcctggctgtccctgggctgtgctgtccttgagggcagtttttgtgtctaattcccagagagtgcaagaacacaagcatgctcatccagacgttagtaagctgccctaaggggtggagcagtcagattccggttttatttatttttcccctgcaaggagcaatcaattattaaccgaagtcacgatactttggttgctgttatcagcacatgaaaatatcagtcaaggctgggtttcagacccgcctggcactattcaaaggaaattttttagtaattcttattttattaagagcactagtatattcagatcaagtaaaacttcacatataacaggttcactcttctatatgaaatgtttgtgggaaatctatcatgcatcaggtgctctcaaaaggtggtgaggtgtaaatgtcagcctcaaaggctgcagtgtccaacatggcacacagcttgtgtggctcttagcacctgaagcatgcctcgtccacagtgagatgtgccgaaaatgtaatatacatccagattttgaagacttggtaaaatatctcaccagcaattttttatattgattacatgaggaagtgataatgttttgggttggttaagttaaacgtattattaaaattcatctcacctgtttctttttaaaagtggcttctagagaattttaaataacatgtagttcacattatatttctatgagacagtgctgctctaaggcgattatgctttgtttgttttgagacactcacaggtgtatgtgagcatttcaaccgggtttataacagcttaggaaactgggaactttgacttggaactttcccgccaagtgacaaaacatccgtccagtgatagaagttttaattctacttcctccagctagatcttgcctggaggacccacgttgacttactctctccagaaacggccccactggctctctgggggaactcctgggttctgcagggacttgctaggtagtaattacaggtgtgtagagaccctcctgcttcatacgctcagtcatcattatttacttttaccaggcaccaggggcgtgatgagagcttagctgaaaggagagaagactcagcaagcacatcaccttgaagctgacctgtcagccagatttcgcagcacctgcctgttccagcctgaggggctgcgattcattccttgggaaagagagctgcaaattccctctctaggccacagtccaaatccttgctcttctctctcaggttctggaagacagaatggaggcatctacagagcaaggacatgttttctacctgaattagcttttctgacaccttgaaaccatctctaagaaattgattttttaacatacacatatacaggtaaacatttaaatctgtgccataatgtatttgcacttcgagtccccctgaagtcctaagtcacatgcttctcttcctaggggttctgtctgaagcagagacccctggattggagcagtgggaagaatcctgatgaatcaggtgttcctgcctgtttacattaactgggcaccctgcctgcccaccccacatgctgaatactgctggggagaagagaagaaacatttattaaaggcaaggaaaaattagagccttttcattgaggtcagaagatttttgaggttggatcggctggccaggtgcatgaccaattttcttggctccttagaagcagcaaagtatttgaaaaataatggagcccttcgtcctacaagtaaaagcccatttatattgggaattttttaaaaagtgctggcgatggaaaatttccgatgagatgcatttcttcctgcctgaatgtcttgaatgcctgctggatttgtctccctgctaagacactcacacttgcaaatctgtgcttttcaaggtggggagatgaaaataaaaagtctgtgacatgtatttctgggaggcctgaaaacaggaagcaaattggaaccacagcatgtggggcacggatgctggattctgggggatatttgcttatttggaaaggctgcaaacattccatcctacccactgctaggagctctgcactttgctaacgtcccatggaaaccaaggttctctttaggactcgacaggactgggttatttttctcagcttaaattgtttttatatggttatcctcagtactcttttctgttttgggatattttcatactttttattttttaaaaaccccagaatatcttgattttgaaaaggtacattcacccaaataaagtgcccagcgcatagacaaggctgcctcaatatttcacgtgtcaacagccaatgcccccggtacgtgcagaaaagcctgagaacaaggaaggaagaaaagggtctggtccttgctctgcgggtatttaagcatttctcagccccctcctctgacttctcaactatgttcacctatatggcctcaaatggagagaactggggttataaaagaggatattagctatgcctgctatagaatgaggaaggcatttcaggatgtgcttggggaggagatggaatgaatggcaaaggggatgtttgtccgtgagggtggtctgtgatctgtgggtgggggatgtctgtgcagctcccttcatggcctctcatggcccacacagtaggcagtgtttgccacacacagaccctggacaaagtcacagagtggtgttggtaccatttcataggaggggtcctaggggacattctaggaagttcttcatcagcttaggaaggtgcagcctctgcagtcattaaacacagtctaccagccagagaagcccaaaagctgctgctcctgctgttctgcgtggtgtgggaaactacggcattggcacaactttgggagctctctttgatctcttgtttgtctgcatttcccatactcttccagtcaccaagtgtcatcattcttccccaggttgtctctgtctcccttccttttctgtccccatgactcttacctgtatccaaaactatggcgtttaaggtgaaagagccagtctgtaggagctgcttcgaggaaagtcttgcaagactgccttcttgaacttggtgctcaaactcccctctggcttcacaacctgcatagttgcctgggtcagaaacaggttcctcaggcaacttggtgttgcattaaccaagtgacactgattgtcacttggaagacactcagtgactgactattagagatcatctgcctctcattttggggatgtgaaggttgagactcagagaggtcaggcaacatgtctgaggtcattgagccaactagcagcagccccagagttgtcacccagatttcccgactccccattcattccagaaaacctacccatggggaatgttctgccaggctgttctacatcaccagtagagagaagttgccttgagtattcggtttggttttgaagttaacctattcagacacacttgagcatgcagtgagtcactgactggattcattcccagacctatggactcagcacatcagctcaccaagcctcctgcatactctgcttctacgctggacaactgtgcattttgagaagctggaggaaattgtttggcatactgttctaggccagcagtcatgcgatactgagctaggcctggctcctataggctggtgaaagccaagtgttaactgttcaggatttttttgagttggttaactattgatagcttcaaagtcgccatggcaggggtatttataccatagaaattggtacatgttacaaattagggtttcatttttcaccatccagagatctgatttactaactcactactgattctgaggtaggaccccagcttaggaaggcactttcaggcaagactgttctgcggtaattagaaaatggagagtggccctgtcagatgcaaaggagaatatcaaatttggaaaaaagtactgcctattgcacaagaggtaagagtcactgagacatcttgcaccagacccaagtgagggatggaaggggccctgatggtcatcttgggacagcttcttagggtcacccaggagcccaggagccaggtatgccactccgtggtgggacagaaacccctgtaaagagcaagcagacactcagtcacccaggaccctccccaacactcccattccctgcaatctatcagcgcatcctatcaatcccgtctggagtagatatctgatcatgccttctctcccttgtgactgccatcacccaagtccaggttcctgctacatccttcctaaaaggccttcccctgcaagcttgcctacctcacatcgactttccccacatagctgcaaaagtggacgtctgagaagaagggggaggaagaggagaagaaggaagagatgaagaaggcgaagatgaagaaaaagaagaagaggaggaagaagaagaaggaggaagagggggaaaagaggaggagatgatgttatgtcatcccttcacccttcccctgcacacacacacacacacacacacacacacacacacacacagacacacacacacacacacacacaccacgaaaacccttcaagagcttcccattgtacttagaataaaatccacgcttgagtaaagctctgcatgatttggcccctgcaaacctctccagcctcctcttgcttgggagcctctgtgctcacaactctcctgtcaccctggtcttcttccaggtccttgaatgccggctaagctctttgctgccccaggaccttcgcacctggtcttctactggcaggaatactgtttcctgagtcttcccctgactggctccttcatttcctttaggtctcagcttgagtgtaacctcacagggccatttcctgctcacctggtgaaaagtcaggcctcgtctgttctctgttttagctcctaagtttctttatgacaattatttcagcccacagttcttttatttacttgtctgcttacattttgttttaatcttttctttacttccccccacttcaacagatgctccatggagaaatgggttaaccactgcattgccagagcctggcatataggggtgctcaaataaagacttgatgagtgggctgggtgtggtggctcacacctgtaatctcagcactttgggaggcaaaggcgggcagatcacctgaggtcaggagttcgagaccagcctggacaacatggtgaaaccctgtctctactaaaaatacaaaagttagctgggtgtggtggtgagtgcctgtaatcccagctactctgggaggctgaggcaggagaatcgcttgaacctgggagacagggattgcagtgagctgagaccgcaccactgcactccagcctgggagacagagcgagactccatctcaaaaaaaaaaaaagttgatgagtggttcattctactgccaccacctatgggaagacaggtcaggaatgttgaaatgaaagaagtgcttggcttcctctgagccccagctggacacaggcatctgtgatgcatccagattcaggctgctcatggactctgaggactcaacgctcccggagggctagcagggagctttgcacacatacaaccagttctcaccaagcaactggggattaatagtgcaaggggttaaatgggttcaaactgttcctcttaagctccccaagatggtgaaccgcacttcaaagctgcttgaaaattcttacttggtgagcatgctgttctgtgtcccttttgggcagaggattgggaaggcagccaccaaggccgcctgccgagtgaacagggggagggggcactccaggtgacgtgtgtgcagagacccgctcatgcctgacccacagttagtgcacgctcacagtggttccagtcttgtcccagcgacccgactggcctgctttgttattggaactagagctgatgattcactttaaatagatccttaacctcacaatttgtttttcttgaaacggtcctgagaggtgctttccaagaaacaaggaaaaaactgactgcacagtggtgactttgagtctgtctgcagaaagcagtgtgagtggatggttcattcccatggcaaagcctttccctgtcacccggtgtcagggacagtgaaaaaaacgggccgtagcttgggaaacaggggtgctctgcagttgccgtagcaggtcttcagggagagcttacgggaacccacggtgtaggggcgggggagggggactgggtgtgttcatttcccggggatgctgtaacaaattaccacaaactgggggccttaaaacaacagaaatgtattgtctcacatttctggaggctggaagtctgaaatcaatgtgtcgcaggaccacacttcttccttgccgctttctggcttctggcgcttgccagcagtccttggcagttctcggccggcggttgcatctctccagtctctgcctttgctgtcgtgtggccatcttccctctgtctctgtctctgtctccgtattcaaatctttttctctttgtgagaacaccagtcattggatttagggcttgccctaatccagtaggatcttattttaacttgattacatctgcaattatatcctattttctaatagggtcatattcacaggcatcagagttaggacatcagcatatcttttggggctggggactcaattcaacccaccacaggagaggtccccttgctactaggcgggtagtcatatcacacgcacatgtcgtaaacatgctgagcagacgagaacccaaaatctctgatttgggtaagatgtgattccaaaatgtagagtgcagaatttactaaaacgttttgaggcttagagtaagagactgctgcagtttaggaagacttcctcattaaaagattccaaaagacatattccatgagtcaccagggtagactgaataatgagcgctcaaagatgtccgtgctgtaatcccgggagcctgtgactatgttaccttgcatgacaaaagggactttacagatgtgtttaaattcaggatttgagatgagatgatcctggattctctgaatggatcttctaagaatcacaagggtccttacaggagggaggcaggagggtcagagttagagaaggagacgtgatggctgaagcagagatcagagcgcgaggggttggaggatggagggaggatctagaagaggaaagcaggcagcttctagaaactggaacaggcaaggaaatagattttcccttcagagcctctggaaggagctgaccctgctggacgcttcaatcctagcccggtgagactgatttttttcttcatgacaagtcagttgatgttgttttaagctcctaaatttgataattggttacagcagcaataggaagcattgcagtcacatagcccagtttggcatcttgtattattttaacaaactctccatcaatccacctgtgtatcattttagtctgctaacaccaagaacaatatgttgcatgtggaagaccttaataactacttgttggatgcatactctgagagcttattatacactcggtagtatgctaaaccctttggatacatccctgtcctcctatctatcagtgtggaggagaattggacattgaacaaataattttacaaataaaacagacattgatttatgtgacaagtgctgtcacagaaaaaccacagggagacatgacagggtagagtcggggaaacctaacttcaacgtggggtcaggcagagccttccaggacactcccagctgaagccaggactggacataccctcgcttggttccagttttaaagacaagacactttgcccaaggaggtgacccgagttgagcactcggagcgtccaccatcttttctgaatggtgcgaggttgtctgttgttcatggagctcgtgtggggtaggccaatccctggtctgaacttgaggcggtgacacattttcatcttggttctgccgtaggtttagcgggtgacctttgacatatcgtctgcccttcctgcatgtcgtttgtgctctggctgacaaacaacgatctcaccagccatcagcgctccacaggaatgaaaagagtgagtgaccaggacagggagggaggaaagaagaagttgccttgttgccacggccttcctcagatgtgcctccgtgccttgggtcacccctggggctactggcaccttctgagacagagccggggctgagggctagattgtcgttcactgggcacctctgcaccggggaaggggacgggagctgaggagggggcactgagcaaggcagaatccttatccccaagcagttgctgacaggtggagagacaaatgcaaacactcagaatgcaaacacacagtgtccaaagcagaagcagcaggaggggcgtgggctctgccccaggaattcaggtgcacagaaggagctgggcctgcagggatactttggggtttggtaaatgaaggcggggtcgtgcactctgcggtggacaacaagagagaagcctccccacacatcagggttacacgtggcttggggtatggcttgccaccttctcccgtttctccccacatgagcaagggcggtgtccattatctctcaagcaattcctacctccctggcactggtagatgctggacacatggtacctcctccagcctcacaacaacactgtcacatcgtcacctccatttctcagatgaaactcaaagaggtgacacttgtccagtgtcaggtggctgtgaagatcccagcacagtctccttgcatccaaggccctagctcttaccacattgttgatcctgggttgatggtgaaggtgtaagctggggttcctccccagcccctacctgtcgtgtgcacacctggccttctctgggggtgcatttcccagctgaggagactgtctgcgtgtgtggctccgaaggaagcctagctggtgagttcagaacaggccctgtgtgtgatgtggtgacctgaggtcataggatacagactgcgtcccaggagcacctgccattttaggggtggctcaggaaagcctctgagctccctggaggaagttgtcccctctccactgctgcaaaggagagttggtcatggggccaggcagacactctctggacatgctcgtggaagagctctttgggagaaaagacactcgagcatgccaacaaggggacttaggggccagaatgttctgccacttgccactcgccaacctgaaatctgcacctcctaatcacctcctctcagccctgcctcatcaagtggggtcttgcaggaactgctggcagctcggccaccatcggggaaaacaccccagtcaaacacaggctctcctgtgccttggcatagagggaagagccagccctgcccccgcccctgcccactatggtctcaggattcactccttgctgaagcctttacaggggagccaaatgccctctcacccaaggcccttccaaggccctcccacatcctttgggtgaatctgtttcaggagcacccatttgagggaaaacttcgtccccaggagaaatggcaacggagaggtgaaggggtggaggtacgctttggagcagggccaaggcacatgggggtgggctccagcctcgagcctgtccttctccatgatcctgaacatgactcttctggaacctggccggaagttgcccctcaggagacagcgggggaaggaagttgtggtccagaaactccagaatgcagggtgcccttcccattcaatcacggaggctggtccaggccaagagcatcctcggcctttgtttaagctcccgtgagttcttggttgacctggagaggctgagagaggcccacaggacctctttccttctgacccttcattgcctttggatccagctcacctcagtgcaagcctgtggcctgcaggggaggccctgaggtagaggcactcagccctgataccgtgagggacccttgaaagtttgtgctcttgtttatggtctcaaagacaagaggccaaattcctcagctgacatttttactgtcaggacgtgccaatgttgttcactttttgttttgctttgcttatgattgtctggcaccttgagatgatgctgagtatgccaggctataggatggagatgtgggtgggagcaggcaacagactggccctgatcttccagagctgatcacattctctgacgtcagctctctctgttcatgtcctttgaagggcaatggactccgtgaggggagacccgaagtctgtgaatgcccagcttctgagataccgtcaatactgttgactgcatgaatggatgaattgcaagtgagttgttgaacacagtggcaaggaggctccttactagcttggaaccccctcctccggcagggaaagtgattaccaacctggaggtcagccaggccaagagggctttgagatctacaacaccatctccatctactgggtttgggttacgtgttttaagtggctcaaccttcctctgaaatcatagcaatagcaatgaatgatgtcccatcaggcactgccctggtttttttgcacacactatctttcatccctataaggacgatgtgggatggccattgtcatgttcctttcacagaggtgaaaattaacactcagagagagtaggcatcttgctcaaggctagaatggggtaaagccattcatttaatttatttattcaacaaatattcattgccaacctgctataggccaagcccctggcactattccaggtatcgggaaaatagcagtgagcaaaatggacgagaattcctgctctccgggagcttcacttctaatgggggaagcagagcaacacacaagataaaatacacagcatgccagaggttgttaagtgccaaggaggaaaagtggagaaggtggaggggaagggaagggctggtgggcagagggatatgcctactgctgaggaagctcccaccatgaaggtgacatttgcaaacaaacctgaaggaggtggaagactggccaagcagagacctccgggaagaggggctaggcccagacccaagcatgagggtggccagagtgttctgggaacacgaagaccagcgctgctgcaggtgggaggggatgtggggaagataagatgagacagagtaagggtgtgttggggggtgacagattatggagggccccagaggccatcctgaggatacgggagccattctctgagcagagaagtgacataatccaatttcagtttctgcagggtccttctgggctctaggctgagagtggactgagggatgagggtggagtcaggggcatggattaggaggctatggctagtccaggcaagggggatggcagtctaaatcagggcagcagcagagtcaggttttggaaatgttttgaaaatagagccagtaggatttgccaacattggcaaagattggatgtgaggtgccagaccaagtgttgtcctcagcaactgggaaaaaagagttaacgttctgcattaggctgttccagcattgccataaagaaataccagagactgggaagtctataaagaacagaggtttaattggctcacggttctgcaggctgtacaggaagcatggtgctggcatctgctttccttctggggaggcctcaggaagcttccaatcatggtggaaggcagagggagagtgggcatgtcacatggccagagcaggagcaagacagcaaggggggaggtgccacacacttttaaacaaccagatctcatgagaactctctctctatctgcaggatggcaccaagagagatggtgctaaaccattcatgagaaatctgcccccatgatacaatcgcctcccaccaggccccacctccaacattggggattacagtgaacatgaggtctgagtggggacacagatacaaaccatatcatgttccctgagataggatggctgggggttgggggtgaacagtatttgggagggaaaatcagggactctgttttggacacaatccattggagttgcaggtagacgttccagtggagaagacaagtggctggctggctctctgagcctggagttgagggggtgatgtgggctggagattggactttggcatcatcagtgttggtgaggcagctacaatcatgactctggatgagctcattgatgggggcagcaagtgtggacagagaagcaggaggtctgaagactgaggtctgaggtgtttggggagaagaggaggaacctgcaaaggagatagggagcaagcaaggaggcaggaggagagccgggcaggtgggctgcagccaagcaaggagagggggaggaggaaggggggaaggggaaaggcggggagtgggaagagggtaggagggggaggaggagagggggaagaggagagcagggggagtaggggtaggaggagaaggggaggaaggggaggaggagggggggaagggggtgagggagaggaaggggaggaaaggaggggtaaggggggaggaggagaggggaagaggggagaaggagtgaaatatacctgtcgtgggatttgacctatattagagaatcactgtgcagtgcaccaagtggcactggagaagtcatccccgaaataaattggattgtgtgacaagagatgggttcagcagatgcaacagacagggaggagggaaactggaccagccttggctgtggattggctgcgcgatcttggacaaatcacccatcatgttttccttccgtgttacgtggaaatgtctctgatatctactgcccttacctcacagagtaaagacccaaaggagatgtcatgaaagcattttgaaatgctgctgaacactcagcacagtggctggcacagagtgggtagaactcaatggttggaaaatgtacttggctgttattgtgcctttttcatgaaaatatgaaaagctaaataaacctgaaacatgttggggactgagtgaggggagatgagcacgttctgagagtcctaggaccatgcactctcagagtgcctttgctattgtttcgcctcccgtcctacagaggaagggcttaggtttgctgtgaatttcccccttgcctaccagcattgcgccaattaaggtttctacttcaccgcacgtttcagccaaggatgtcaagggaatccactgctgctccagtgagacaaataacatatccagcatcaacactgccatcatcattagcatcattgtggccattaggatggttggcaaggcaataggttggcactactgatgggcagcaccattagtcttcttagtgatttttcaaaatggacagtctggagctaaaagcgtgagccctggaggagctcatttcatcagacctgctgcaggcaaacactcttctcttcatacctttcccgcctgtacgtgtggggtgatgcctgtcttgggaggaaatatagatgcagtgcctagatattccaaagcccaggttcggaatctgtgttccctttgttttttgatatttcccctcctttcctcctgccctttagatcttgtgcatttgtgggtttttccctttctgctcagctctgatcacttatttgcttttgtttttggagagctgcgtcctctctttactcacccacctgcttcattagagattgctactcacctgcagtatccatgctcaccttcttccacgataattgaaagagtgtccggcacacggctgtctacttaaaaactgctttctctagtatcccttgcagcctggtgtggtcatgggactgatttctgcaagaagagtttgagcttcagtgtggtgtgacctctggacctttgaaaagaggggtttattccttccattctcccacctttctcttccttcctccttgttggagtgtggctatcatggtgatggtgaaccatcttggaccacatggatgagggccacacactcaggatgctggagcaacaaggtggaaggtacctgggtctcgactgcccacccttgtgaaaggtaaatgcagttccatcttatctgaaccctagtattttgaggttctgttagaattgctgcacctgtattctaactaataccttctttaggctctttgacccacttgccagattgcaggttgcaggaagacagaacatggttttgctcaccattaggtcatcagggctggcacagattgctcaacacataataaatacttgttggaagtgttaatgagttatggttttactctggtatctggacttctgctttccaaaggatgagtggcccttgacgcattgttcccttgggcaactgcagcctctgtcatgggccaagtatggaatgtccctgggaaataaaatctcagaggaagagagctcctgcccagccgaaattctccctggaattgtgagcctccaattaggctagaagatacagtcttcccatctgttgtagaaacagaaagttatttagagtataaaacaatctcccggcttcatgtgtgaagcctatttgagagtcagagggttccagcagagggaggaggaacatcagctacacctggagctctggggatgaaagaacccatgagggcctcatagattatagggctctgactcctccagggaaagatgatccagtgttctggcctatcttggcctgtggttctttgtgatccatggagtgagagtgtccacaatcgcctgctgtgtggtatttccctgacttgagcctttgctcataaccagcatagcccacaaacaccagccgtatccctcaattcctgacttctgctttcctgtctttacagaagaaccccagctgtgctaatggtcctgtaacctctcagctcagggccatgagaccttctctctgcatgaatctcgcctcctctgcaccccacacttccacaccacttcctcatataacgtgttatctgactacacaaccctggaaatgatgttcctcctgatgtgttcccaagcattcttgctattctgcttcctctagaagccagggaactttagctgaccaggtctgtgtcttgggcacctgccttggtgagcgacctctgagaatttctcactaaacatttgttgaatgaactaggagatatataagggaatgcctcttctgcctaccatgagcatggccttaagtgttatctttgttgcttggccaagtcatggccttgagtcccaagtgaggtgcccagcccttattcctgatcaataaatacttttagactcctgattattctcttgcttgcttgcttgcttgctaatctctaatagattagatctattccctaatctaattctctgatcttcctcctgaaacttggctccatattgagttccttgccctatatccgtacttgcacggccgctatttgccacccagagtccctgtgctggcaaattcaacacccggagcattatcattttggtgcaattcctgagcacagcttgctgactcttcagtacttattgtttctatctggaatacaagagggagtatattatgaggatgatggtaaacccagatcatggtgctcagagcagatctgaaactctggcagcgtaacacctctctccagcatggacagataagggtgattattatttaattggacttttcattttgagagaaattgtaggttcacatgcaaatgtaagaaatgatgtggagacctatgtaccttttatacagtttctcccaaaggtaataccttcaaaactattgtatgatttcacaaacaggacactgacattgatagagtccagattcagaacatgtccgtcatcaccaaggtccctcatgttgcccttttgtggccgcacctgcgtcctcttactctccccatctctgccccatctttaactcctgacaactactaaactgttctttgtataactactaaactgttctttgtataactactaaactgttctttgtataactaaagttataattttgtcatgtcaagaatttcatatgaatggaattacacagcatgcaaccttgacttttcttactcagcacaaccgtctggaggttcacccaggttgtggcatgtgtcaatagttttctcttttgttgctgagtagtattccataatagagatgtactgcagtttgtttaaccactcaccttccacctgaagggcagctggttttttccactttggggggattacaaacaaagctgctgcagacattcacatgtgggtttttgtgggaacctaagttttttgtgtttttttttttttttttcctgggatgaatgctcaggagtgcatgccaggttgcacagaccttgcatgtttagttttataagaaactgtcagactgttttctagagtgattgcaccattttacattctcaccaacaatgtatgagggatccagtttctccacatccttgccagcatttgtggttgtcactcttttagccattcaatagtcatgtaatgatatctcattgtggttgtaatttgtattttcctaatggctaatgattttaaattacctcttcatatgcttatttgccacctgtatattttcctcttcagttaaatatctcttcatgtcttttctcatttcttcaaatttaaaaattcttatttatttattttttattttttttactgtggagttttgagagttctttctatattctacatactagtcctttgtcagataggcagtttgcaagtattttctcccagtctgtagcttgacttttcatcctcttaacagggtctttcatagagcaaatgtttaactttgatgaagtctaatttaaccatttttcctcttatggctcatgcttttggcatcaagtctaagaattccttgcctggccctagctttcaaatattttctctttttttctctataagttttatcgttttatgttttacatgtaaatccatgatcaatttggagttaatttctgcatgaagcgtgagactagattgaggtttatttatttattttttgcttatgaatatcgattgcttccataccatttgttgaaaagggtatctttcctccattgaattgcctttgtacccttatctaaagtcagttggaaattttgcgtgggcctatttctattaacttccactggtctgtgtatctatcccttcactaatagcatgtagccttgatcactgtagctatacagtaaatcttgacattaggtagactaatctatcccatttcatttttctttttcaaaattgttttagctattctagtttctctgccattttatatacatttaggataatcttgtctagatctatgcaataatattgctgggattttgtttgcagttatattgacccatatatcaagatggggagaattgacatctttactgttgagtcttctgattcatgaatttgtaatgcttcttcatgtattttagctcttatttggtttcttttgtaggaattttaagcacacaagtactgcacatattttgttagatttacacctacgtatttcatttctcttgagtgactgcaaatggcattgcatttgtaattttggtgtccacttgttcattgcagtatacagaaatagaattgagttcatgtgtttatctcttattctgtaacattgctgaactcattagttctagggttttttttttggtttgttttatagattctttgggattgtctatgttcacaatcatagggatggttttatttcttcctttccaaactatctgcttttattttattttcttattttattgcactggcagaacttccagtaggaagttgaataggagtggtagagtggtcattcttgcctctccttgatcttatgtggaaagcattcagcctttcatcatcaagtataatgttagctatagggttttatagatgctttttagtaagttgaggaagtccccctctattcctatttttctgagaggttttctaatgaatgggtgttgaattttgtcaaatggggcaagagggtggtaattcttcattattccttactgtaattagtctgtcaatgttaatgagcatgctattattaagcacctattggatgttcagtgttgtgctaggccctgtgagacatataggaacctaaaaatttgagccttgccctcaagcactaaggaaacacactttctaaaccacaatttagcatataccataagtgctgcagaaggccccaggcagcggaggccagtgttgccctggctagaaggtgtcacttaggttggcctttgggctggagtagaacctagatacacaagagaggggagtgaattagagaaaattcaacggcctaaaattctattttctaacaaggacaatggtaagttgataattagtaggatagagatagcttttgattaatgaagttggattatctctattctgtggattatccctgacaaatgcttaatcctgaacttcctccctttttgagcatttgggctctcttttctgccatccgtcaacatgttcaggggaatgcaaactaatattactattagctaaagaaaaacataattaaggagggcaatctgctgtccctaaattgtatcatcttttccaaactaaatatgagtgatattggtactatcttttgtttggagagatccacaccacttctctccctcttaaggctcaagaagaattgactgtgaccatgatatacacaatacatttattaagctgtctctctaacaaggtagctaaacacttgggaagtaagagtaatgccttagagaatttggaacccatgacatctgattcattggtattgtccatatttgtacatgtttactctaatataaagtaataatataatagtgctgtcatttgcaaaattaaaaatcctggcacattactcatgggtcatgctttgggttgtcattctaacgggtttggtggatttgtatagatctggtcctctatctcactttgtcctgctggtgaccagtggctcctcttggaggcagacggccagggttaagggtggaatctgaggccgtgagggagagtgaaattaactgctcccttcacaagggaattgaacccctgaccttcacctcattagcacagcactccaatgcagcaattcctaacctcaattttatatcaccccagggtgtctccacttatctcaagcgggagctgcagaattcctccaacaaaattaattttaattcaccttaatttaaacattaaatacggactatgaggcagcaacttgcaggagtggggaagaatggctgttgttaataaatcccaccaccacaatgcactgttatccaaacaccccaaaacaccctctcgaacccactgagccaaacagtgtggggaggaagaagtctataagtaagcagcaggcatggaaggcttttaaattgcgggggaagcaacacccaaccctaccaaacatctgcatttcatagagactgtttcatgtggtcagctggggtgcactctgacattcactgggccagatggacatatttcagctcccgtccagccagcccatccctttttcctcctagggactgtgatgctttgcatagtcccaggagtttgctgcaggaacattttgtgatttactaagaaaataaattggtctttgttgctggggctttctcctgggtcaatacaaaagatttatcacctccatgccggcccacggagaggttggctcaaaggattctctggccactggcttattctggagacaagcagagtcccagcagaacctttgcagggcaggccagcagcctgagtgtaaggcaggggaagtaaccgtaggaatcagttattgatgaacatccttaaaactctgtttgtttgtttgtttgtttgttttgagatggagtctcactctgtcgcccaggctggagtgcagtgacgcgatctcggctcactgcaagctcctccttccaggttcacaccattctgccacctcagcctcccgagtagctgggactacaggcgcccgccaccatggccagctaattcttttttgtgtttttagtagagactgggtttcaccgtgttagccaggatggtcttgatctcctgacctcatgatccaccggccttggcctcccaaagtgctgggattacaggcgtgggccaccgcgcccggccgaacatccttaaaactcttcatggtcttttactgataacaacatccacatgcattttttaaaggagaataagcatagttccttaccctggcagtgcactttatataatttgtcaaagagtttcacatgcattgtatctcaattgttttctacctacccagaattaccaacttcattttattgaagagcaaatagacttggaaaagttaaatgccttgcccaaggtcgcatagctagtaaatcatggttgtagcaccagatcccatgtcttctcatatactgcactcttttctctatactaatcttatcttggtttattatcaacatccatttgcttttggcagggaagggtccagaatcttcattttacagaacaacgaattgaggtaagtaagcgttttgggtcctgcctctttttctgctggcaccatgtgcctttcttgctgaagggcaaggagttcttttgcaggcacactcatttctgctctcagaggccaggctctcaaccatcatcatcagtgccatcctgctcattgggccccaccctgccctctgtgtccagtgggggcttacatctgtgatttctgggcagtgagggggtcatacgtgaacagttccttcgcatcctcttaaaattgctctttcagctccataagtttcaactagtcaaaacactctccttcacacttcttcaaagatgagcatttgttctacatatttttttgtagtcatattctgcgagtgcacactttccctcttgggtccttagacacacccttttccaggcatgattcacttcctcaagctccgttctggacacatacatctggtgccacctggaagagggcttatcaggtcctcccacctggaatacagcttaaccagagttgatttctaaggcatgcaaccaagaaaccagactgatataaatgggatattattgattttatctgcctaaccgagtctataaatttctgaaagccatggaaggaactctattttgttgcattcctcataacatctagaacggtgctttgcatatactgagtgctcaaggcatatttgcagatggtgacgaggatgatttgatgtcgttttaaaggccggacatccaagaggaggtctgttctctacatgtgcatgcacgtacacttacacacactctctgacttgtaagatgccctttgcaagagtccatttgggaaatgcagtgggcccactggaagaaattcaaggccatgggccagctacaccacggaagccctacacccagccaaacgtgctcactggcaagtcaaacccaaaaactgtcatcaaattctgcttcctggcagcccggatccaacaatactctgaaagacaaaagaagcagaaactcaagtgaagatcaccaacgtgtctttttgggcaactagcagattgagcagagggtcagcacagacaccagcagagaagaacattctcctggcaggactctgcctccaaattcggcaccacttcacaggatctcagcctcacaccttatgggatttatttttttaaaaaagatccaacatttgttcctaattattcttagtaaaactgcctttcttgatgtggcacccattacctcattcattcagtcactcattcattcattcaatgaaacccctgtcatccacgctctgggctctttctacagccccacgagatgatcaagaactctggaaaacaggtaagccattatcatcagtgtatatgaaattatcatcagtgtatacgaaatatgaagaaacccaattagatggagatatctcctaccacacattgaaatcagaactcagacaagactcagatgttctaactccaaattctgagcagtggcccctggataaaggattatggagaaatactgaccagaaaaaatactcttaaatggcatattgtggtgttttaaggcaaggttattggtagtgcttgtaactctcaaaatactgttttggaagtttgtagtgattttgcagaacggctttgagttacctctgggtgttatcaatcattggatagttttcagaagaaatccaccttaatttgagttaaataatatgtcatttagccagatttcctcctgcccccaatccccataggagtgagaagccatggcttggggcattatctcagcatcatgggaattgcagagagggtaccacagctttagagtttgaggtgttgagcctgaacaaaaggaaagggtaagaaacttggggtggatagaacgtggaactactatgaagagcttattgcatagaaaaagagaaatttgagtttaaaaaaaaaatggaagaaagtaaagggagcccaaatgggaacagttaccagaggagattccctggaatttgaaggaaccaggttgaaggatggtttcccaatttgaataattataagaatcacctggtactctttttaaaactataagttcctagagccccagtcttagacattgcatttagtgtgtctgggttgaggcccagaaatctgtatttttaacagaaacccaggtgatttttataatcaggaaagatttgggcaatgtctgcatttgaagatgctgtctctcaaaatgaagaaatacctggacaaagccaagtccaagacaggggctctaagtcaaaaaggcaagagcaaaaacaacatgagcctttacaaaatgtgaattggcaaaaaagcagctgtagctcatatttaataacctcccatggcttccaaagaagcagctgggtctgcagagtcctgtttgtgcacaggatgaatggagtctgtgtgccactcgggatgcccccacaatacccacattatcactgaggtgctccagcgaggcattcattatgcactcccctgccacccaaagcctcaggtcaggtttgccttggacactctcccttctcccttctctgaggctgaggggctgcaggggcgggtgcctgaactccctccctctctcagggatgcctcagctctatgggacttcctctggttcacatgattgcattttcctgccttggggcaccctaaaggcctgcctctgggaagcagggtctagaggcatgagcttgtctggacaacagaagctcaatctcagcatcctaaaggcctacctctgggaaggggggggtcacagaggcatgaacttgtctggacaacagaagctcaatctccatctccaagcagttcgatcccccaacactcttggtattaggaggggagcctctgcaagtgtgaggaccgggggcctctaaacagggtttttttctttttctttttttcttgagatggagtcttgctctgttgtccaagctggagtgcagtggtaccatctccactcactgcaacctctgcctcctgggttcaagagatttctggctaatttttgtatttttagtagagacggggtttcaccatgttggccaggctggtctcaaactcctgacctcaagtgatctgcccacctcggtctcccaaagtgctagtattaaaggcgtgagccaccacaccaagccctaaacacagcctgaggctggtatcccaggaggccttgaaaaatctcaggtttgctgctgacaggtgtgccaggaagagacctggctgctgtctgcaagtggccaaaccctgataatcccggaaataaacaataaaataaactcctcaatggtgattataaagtactattgtttatcagccaggacctgtgctaagcttttcacctacattatttcatttatatttcagagcagtcctttgaagcagtcatgtttatatcagttttatggatgaggtcagagacttctgctggttaagtaccttgccactatcacacagctagctagtaaataaactttaaaaaattgaagtattatgtacataaagacaggcatagtgtacaactaagtgggttatcataaaagtgaacatacctgtgtaaccatccacccaaatcaagagctagactattaccagcctcagaaaaatcccagaccctctccaataacctcctcttccccaatggtgaccatttttgtcaccgagtattagatggctagtttgtgaattttataaaaacagaattctacattatatgttctttttgtctgacttttttctccactcagtatgacatctgtaatgctgatctaatgtcattcatgtacaagtagtttggtcatttttaatgctataaagatgttcatagtatgaatgtatcacaatttatttatacatttttcattttgctggttatttgagtagattttaattttgccccatgacaaataatgctacttggaatgttcttggatagttgacccttgaacaatgagggtcggagcagtaaaaaattcatgtataacttttggctctcccaaacttaactagtaatagcttactattgaccagaacccttactgatgacataaataattgattaacacatattttgaatgtatatactgtattcttacagtaaagtgagctagaaaatagaaaatacttttaagaaaattataagaatgagaaaatatatttactattcattaagtaaaagtgaatcatcataaaggtcttcatcctcaccgtcttcacattgagtaggctgacgaggaggaggaagaggaggggttggtcttgtctcagggatggcagaggtggaggaaaatctgtgtataagtggacccacgcagttcaaacccatgttgctcaagggtcacctgtacatgtgtcttggtgtacatatttcggcataggatataccaagaaatgtaattgatgggtcataaggtgtgtggattttcagctttagtagatactgtttacatagttttgcaaagtggctgtaccagttcactttcagctatgagagtcctgggggatccacatcctcaccaacacttgatactgttggtctctttttacttttgccatcctgatgaatgtgtttcagtttgcatttccctgatgactaatgaaattgagcagcttttcaaatgctattggccatttggatatctactggcttattcaggtctcttgcctgtttttctactgggttttctgtctttccaggtgatttgtaggagttctttatattttccggttatgaatcatttgtcatttatatggattgtaaacgtcttctctatggcttttcttttcattcttaatagtatcttttggtgaaaagaagactcaaattttaatgtagtccaatttttcaatgttttcttttttgattctgtttttgtttctgttatatataagtacaactgactttgtatattgatatttcaatccaagaaccttgctgaatttacttattaattctgttagtttttctataaattattttgtattttctgcatatgcagtgatatagtctgtcaataatggcagttttttttctttctatttcttaaaattttatttgttttcttgctttactgcaaaggctaggacctccaaaacaataatgaatagaagtggtgatagataggaagcatctttcttttattctcagtattaggggaaaagtatcaatatttgaacatttatatgatatttgctggagggtttttttgtagatactctatcatgttaaggcatttcccttttagtcgtactttcctaaatacttcttttttccttttactatcgccaggggttgaattttatcaaatgccttttctgaatctattgagctgatcaacgattttcttctttattctgttactgtggtaaattacatagactgatttccgaacactgaaataatcttgcatttctggaaaaaaatatcatcttgtttgtgatgtattgtcctgtttatatattgctgaattcagtttgataacattttgtttaggattagcatccatgttcaggagaaagaaatcaccattttctttccttgtcaggtattaaggttataaagctctcaaaaatgagtcaagaagtcatttttattttctagaagagcttttgtaaagactgatgttatttcatctttaaaggttttgaagaattcactgatgaagccatctgggcctggaggtttgtttttgtttttgttttggtggaaaggtttttcattatggattttatttctttaataggtacaaggctattatatcagatattctttttttatttgggtcagttttaataagttgtgttttccaaagaatttgtctatttcacctagatttaaacatttatcatcataaattggttctgaacagctttttgtcttatttaggagccacagattctattgttagggcttcctttccattcctgataatatttgggactcttcttaaaaaaaattaatcttatgggcttatcggttgtattaatctcttttgttgtttgtttgtttgtttgagatggagtttcgctcttgttgcccaggctggagtgcaatggcgtgatcttggttcactgcaacctcagcctcccaggttcaagcgattctcctgcctcagcctcccaggtagctgggattacaggcgcctgccaccatgcctggctacttttttgtttttttagcagatttctccatgtcggtcaggctggtctcaaactcctgacctcaggtgatccgccccaccttggcctcccaaagtgctgggattacaggcatgagccacagcacctgtccctgtatttgtcttttttaaagacttgtttttatttttattttttcactttgttggttttctttgttgtattattgttttctactttattaattcctgctatttattatttccattcttatgctatcttaggatttaatatgctgtttttttattaaaatcttgagatggaaacttagttcattgtttcttcatcttttcttcttttcttgtaaagcattcaaggttttaaatttctcttaagcattctttggctgcatcccttacattttgatatgttttagttttattacctttttattgaaatatttcctaatttccacggtaattcttattttgactcatgggttgtttagatatgtattagttcattttacatcaccttaatccgaccaagaactgagctctttaaagatggttcaggctttctgcaggctgagttcttcctggatcacccctttgtggggagtctcaacagaagaccagtggtatttaacccagctcttcctccttgctgggctctgaattcctttctgtgcctcagccccatgagagtcctggcaactctgctcaacttctcagtttccgagccactgctggggaatccatgcacgccaaggagaaaagtggctggcacctctccgctcacgccttgtttctgggatcttagtgccttagtttctcattgcgttagtagtttttttttttttaaattcttattcatttatttaggagacagaggtcttgctatgttgctcaggctggcctcaaactcctgggctcaagtgaccctcccacctcagcctcctgagtagcagggactacaggctactattagctggtggtttttgatgccttcaaatagatttgaaaaagatgttttgtccacattatccagtgttcttggcacgaagggcgtctgataagccaatctatccttaccaccaggggacatcccctggaaccaggatttaggcacaggtctgtgcacacccagactccagagcccacaccgctgcgtggcagggggagttgccatgttggagtacaggccgccaaatgcggagtagaaaaggaatgtgaagccctcttgctctccagctctcttcttcatcatcttcattattctggatctagtcaagcattgccatttatctaatctcagttctaaaatgtgttgaacacaaattttctagtttcttagtaaaattaatcttttaaatcacttactttctaacggttgttcacagggcatctgggacctctttttcaagttcaccttctcctggtctgaaaccaaaatgaaaacaaatagaatccaagtgtgctgtagctcctgacatccctccgtgggctccgccagcccctgcatggaagcctccacatgggttcaccaggctgttcttcgggctctcccaaagtggctgcttttccgtcaatatgaatggcatgactggccacatctcccttttttcttcgggtgccaggaagcctggactgttgagctaactttacggtccaaccatagcaactatgtcagtgtgcagataactgaaggtgcctttccctccctggcttggcttctccctcttacttctcttcccaagctctcaatttgctttatttttgtatattttaccacgatattgtctctctgtgtgtctttatataaaacttgagttattccagttctgccaatctgtgtaatcacttggcatttttatttgtgttcataattttcagccatggagacatttgaaagacaacaaaatcgatcctggagaaacagagatgtgggcactattgcaatttatagaatttattgtaaaattggactttgatgaatctttgccatacatattctgttgcttaagattttttgtaacaatttatgtgtctattgctttatgtgaaagacgcttttcaaaattaaaatcagtaaacagtgttctgtgattaaccaggaacaaaagtagatggacaactgctcaatgaacatgaaacgatgaagatcaatttttcttctaggtcatggacaaattaaagtagttaagtgttaaaaacagagaccatgatgtcattcctcatgactacaatagaccaatatttaactctaagcgtatttcctttaaaaaaaaaaaaagttaactacaaaaatgtagttaaaggtgctaatctactacttttttggtactgtaatatttactgtattatttatttttctattttatgggcataaccatccacagaagggtcagtaagagagaaatatcactgctttcctcttctatccattatttttgttgtttcgtttcatggctactactaaaaataatgttgtcacagagaagcaaggtgataaaaggattctctctgggggtcaatccatgaagaaagctggagaaatatctgctgaacagagttcatggcttcatgttctatctgagcaagtctcatcctgcagtcagctctcttgaggctgagccaggtctttgcacacctttcctctggctgatgcttttaaattccctctgtcttcgtctctgctattgagttcggtctcctccgtgagtcccccacggggcctggtgaggacaggctctgtgggagcagctttctgttttgagcctgtgatgtctggccaaggagcgcctgtcagctgcttgggctccatctcagcccagagacgtcgtgctgtgtggtcttaaagcaggtcacttcacctctcggtatctctctctgtaaaacccagataataatacttcccaaataaagaaagggttttctttaagccctttgagctcctcagatggagcgcaccacagaaatgccaaatgcggcattgtgatccgcgctgcctccatgtgattaggtaatgtgagattgtggttcattatgctttgtctggaatgaatgcgagccctgccacaaagcactgggaactctcagttacacagaaaccccatggtaagcttggattggcttacacttaaataaagcacaccagaaaagagcagtagttttgacgaacccagctctgaattaacactcatttgatttcttctgctgagtgcgggcgataagtaagagatgacccagttacaggtgcggggggcacaaccaacactgaggtgactgagtcgggggaagggcagcccctctgcaaaatgcttcaggctcccaaggaggcaggcccagagtgggcaggtctggacttactgctgtacagacaagggggaaattcaatagctaccatttattgagtttctgctaggtgccaggaactctgcaatgtatgccattcttctaaaccctccagacaacggtattaaaccatattaatattctgaaaaccaaaacaaacacccactacacttgacacatttttttttgtaccataatgaaagcctatgtgtttgggcccacagtttcagccaggattttgacctggggcctcctcactgatcctgaggctttaagaccacacagcatgggtctgcgaattgcaaatgggaggcttacttttcccattcttatccaagcctccagaagtggctctggagctggatccagcctcctttcttacgaagccttggatacatcccacttagcttgacaaacttttaccggaattctctgatcccatttcacagctgttgcaaaggtagggtcttggttgtgtcttccttcaagctgcttatgaaccaggggtggagactaggaagtaaggaaccctggaatcagagaagtcaggagcaagcatcttgttggcttgaggttctccaggcaccataaaccaagtagtgcgcatactaagaaaacaagctggacaacaagaggagagcaggagggtccttaggattggctgcttgtaccatggcccccagtggctcagtagagacaaggggaatcccaggtaagtagactccttcgctccccagagaggaatctattgtgtcaattgctgggaaacacgctcagttgaactgaccctctatagccgtatgtgcatgtggaatccattgttagggaaaccatggtgagaagggaagtgagatgctctggatgggtgctgagctgagtgctgatggaacagaccttccagaaaaggttgcatattatccaaggaaatatcattgcctggagagtcctaggctgacttgctctcttgggagctgatgtttagggaatgggagaagcagctggtttaaagcatcaaacaatgaaatgaacttcagaatctgccaaatcctaaacatttcttgctaagcaccattttttctgtattgtgaacccatctgtgcttcaaaagcaattttgtttaaatggcttcttccccttactcctaatccttgggaagctgtaatacacaggtggtaaaggggactccccaagagatgctcactaggactgctgtgagccagatactgggctaacactgcatagcaccgagggtgtgggagatcagaagtcaggagcctgcattctcaggggagggactggatccctgcaaggaaacaaagtgtggtgtgtgtggcttcatgatccactggcctaggtctaatagcggatctttttgcaaatttatttatttttcttttcttttcttttcttttcttttttcttttcttttcttttcttttcttttcttttcttttcttttcttttctttcttccttccttccttctttccttccttcccttcttttttctttctttctttccttgcttttttttttttttgatggagttttggtcttgtcacccaggctggagtgcagtggtgtgatcttggctcactgcaacctctgcctcccaggttcaagcgattctcctgtctcagtctcctgagtagtggggactacaggcaggcaacaccaagcctggctaattttgtatatttggtagagacagggtttcaccatgttggccaggctagtctcaaactcctgacttcaggtgatcctgaccttggcttcccaaagtgctaggattccaggcgtgagccaccgcacctggcttgcaaatttctatttctaattgagccagtatttcttcccaaaggttcactggaaaatcactgacatgaagaagattgattaataggaaaaaaggcatacacatttatttaacgtgtatacacaggagccttcagaatgaagacccaaagatagaggggaaattgtccacttttacacttaggttcaagacagtatggatagtcacatagaaatatgactggacaaaaagggtctgatggaatgctagactagactgagtggaaagcgcagcaaggcctgtctgcctagattcttccaggcatccatgcagcattccttccttctgggtatgggacaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagcaaactttcagcaaacaattcattgtgatggcaatgagctatctgagaagtaaactgacacaatgatttcatttataatagcacctgtaaggataatatgcctgggaataaatttgttcaagaaggtgcagtacttgtacacagacaactacagaacattgttcgaggagactaaggaagacctaaatcaatggaaagacatcttgtgtccacgggttggaagttgtaacatggttaagataaaaatacaactcaaagcaatccacagactcaatacaatcctatcaaaaagtggctttttttacaggaatgcctgagaagaacttcatgttcctaaaaaacagcaagtgtccccccaaaacaaaagcaatcttgaaatgcaagaaggaacgttctctattccaaaggtctttaactgctctcagtaatacgtggtaatcttcaatatacaggctttcacacctttttttttttcttcttttgtttctagacacgatctcactctttcactcaggctggagtacagtggcaagatcacacagctcactgcagcatggaattctcaggccgatgacatcctagggcctcatccactgagtacctgggactacaggctcacaccaccacagccggataatttttctgattttcagtagagatgaggtctcactatgttgcctaagctagtttcaagcttctgagctcaagcgaccctcctgccacggccttcctaagcgctaggatttgaagctgagcctggctggctttcacatctttgctatgtagtttatatttcttggtgttattgtaaatgtttatgaaaggaatcttttaaaaattttgtattaaaattatatatttaaggaattacatatattatatatatttaaggaatacaacctgaggactacatatacatatacacatacacatacacatacatacacatacacatacacatacacatacacatatacatatacatatacatatacatatacatatacatatacatatacatatacgtatactatacataatgaactaatgcctactaggtgaggggctgccttgtgagcaaacccaaagtccttggctcacaaagccttgtctagaaagatggagggatcagcaaagtgggcacacagcaggttctgtctttagtgcgggcacctgcccactcgggtctctggcaatcctgaccaggcttcatgatgggtgaggtgagctaggaatgggaaagtggatgacctcagatccagagactgcagttgtcacctggggacctggcatgtgcgtggaggagtctcccactgatttggccctggatcaatgcccaaacatgcacaaggacaggactgttggcctcaatgttttaggagccaccagtcttctaaagagggtttgtggtggggaagaatgttcaacaaaacagaagagttatgggtactctagcttggcaacagagaatacttccttgtgctactaaatgacaatatttgacaattatggatgacataattgagcaacagctttcactgtttaacaagcagggtctctggaacactaggttagtgctgtcggaagttgactgaaaagtcggtggtttgagcccatccagtcgcattaatgtttctagctgatgtgaccttccatctgaagagtctcttccttggaccaaatatatcttcaagcttctcctcttcttgtctcttgtctattttccaaggtgcctctttgttgcttgaggcaaaaaaagttcattattaatccacacccagcaaacatctacccttacttatcccggtttttagagttttgagtttgtttgttttctcagcttctcatatttggaatactgggaattcctaaagtggagaacaacagaacctgaatcacacctatggtgaagccacaggccctgggtgaaaaacctaatctgctcgcgtttaaagataaacccattaattttctgtgcttccatttctatctgtctaatgggctaaatcagaacacttaatttgtccaatgtttaaacgagcagtgcaggaaaagcgtggagccaatgcctgtcacgtagcaattggtcaacacgcatgagctcctatcagcgtcacggcctccagcatttccatcaggctttgatctttgaaacgtccttcctgatatgaatgggtcattcttcaaacattctctaaccgatggccatgacattgttccaatgtgtattattacaaatacaactgcagagaccagactgacacatgtatctgtcgtgcatcacttgtctatttctccgtagatacctggagatggaattgtcagaccaaagtatttatacatttctgattttgctaatttctatccaaattactatgaaaagaagctgtaacaagtcatacttttaatattttatgagaattctttttttctccatcttctggccaaaactgggaagtacttgcctaccatttcctctgaacttacttttgccaacatttctgtagtcacacagtgggatcacattgcatgcatgacatcaaactcaaatcctaattgaaaagaggggttcacaggactctataaaaatttatattcaaaatacaaaaatgcaaacatatatgtgtatacaaatacatatatatacacatacatatatgggaaaggaatttttttatttggataccttatcaaagttatatagactggaaaatttgtttagtaaaacagcagtccccttgtgtactcccagagtttcatcacatagaagcaagtatttagttatttatctccttatgtctaaatagatattattcctttttgattttcaagcgtaggcactatctctccttcacatacttgctcatcaccaccacccccaaacatgcctctcactaccttaccctctaacatgtttgtgtcctagtttgagggccaactactacattattataacttgtatatgttattcagagttcagtcacactggatatacatagcaggaaatgaaaggccagtatcttcagggactctctctcaagtggataagcttcagagatttttgtaatctttggtcaccctctccatctttttcctattccgggtaagtactggatctgatgggcccagctcaggtcaggcactctctccttgagaaggggagagcaggacatcttcatgtgtagtaccaagaagacactgtccaaagagggacaggtagttctgagacagaaaagtcaatctggggtatgggtaggcaaaacgaggacacaaaaaaaaacccatgtctgttctgtgaggggagcatgcagtagagggtggattcagagtgggaggggagagttttgagagatatgggccatggatagccctctgtgggctggagccacgcaaggctgttggggtctctcaggggcagggagctgaggagaatctgccctccccaacctgggagactggtgaggggactgtcctggtcaccagacagaaatggggtctgggccagggcagttctggtgggaaagaaagaacaggacatcttctccttaggtaaggctctgagttcaggtcttggtagggagggaggttaccttgggcattggccactgaagatggttggccagatgagcacactgaaatctatgttctataaacttgcagttctagtaaaagaatgactgcagtaaagggtctttaggaagaggaggtggaagacctgatttgggttgggggctccaagaagaatgtctgccttgctgtgcagaagcctgctacacaacctccctggtccccttgctcagtctcccggccagacccccagagtacctgccctgtgcaccctggaagtacacagtgagttcagccaaggcatctccagccgggactcatccctgggcatttctgtggccttgggtgccctggccttctccaggccctgtcttgcaggcaatcgtcctgcaggggaatgggagaaggaggctacttgacagttgactctgagtggctccacaagttcctgacttagctcctagtcacttgcaaacctatatacccccatctcatcccccaaatggtgaaaaagaaactttgccaggactcatgccagacaaatagaacagaaccgttccatagagccaaggtcttaggacatcaataagagatggaaaccacctgctagaaggtgccacagtgggaagcttgttggaagggagcagtcactgaactgtcagggtgaatcctggctcctggccctcacacgccctttctccccttccttccttctctcctccctcctgtctgctctttcccctctctcccctgcatccctcaggtaccttccatgggccctcacccctccttttcagaggctccaaagtgagccctcaaaatacttggtaaccttgggcatttccaaaactggagagatttggccacaccatttttaggagctaggaacgtcctccagagctcttgcctaaatttttctgctgatgagaagagaacaaaagagtttccatctgatctggtcctaaggcaactgctccttggagcagagtctgggcaggaagaagggggttgcccagggccccagacttgcccctcccagctgctgtgctcctctccccttcactgcgggaggctggccagggatcgggaacctctgttctccacagttgctgcgatcccaggcccaaatctaaatattggctgatttaggaggctaagggaggcaattccctggagagaggtgtcaggatctgggacaagagcagcatctggttgccatccacggagaccccaaggacaggaatccagtggtagcctgttggaggggatcccatgacaataaaatgaaacgtgtgcattagaactggagccaagaccaggagctgaaaaaccgcgccgtcctaagggatgaaggaattagggaatcccggaagtaaagtttttcatataggtcatttcttccaaagagacacagggcaatggcccaatgacatgtataaaagaaaactcagggtctaggattgaggggaggcagccttttcagtggaggagacctgtcacctggaggcccagggtcaccctgagaggggaggggtcttgctgggtcgctgggtctaggactccaattgcacacagccagtggcctggacggtgggtgaccatgactggggcaatttcccccattccgcttagggagcaataggaatatcattggcattatacagaaaggtcccactgagacttgaacgctgatcaccgtactcagagtccaaagcgctcaccattacatcatggaacctcacaatagctcgtaactggagggcactgagttcacagagcagccgtagttcccacgcacctctgttcatgtatttcctctgatccctcaagcaacaccgaggaaggtggacctgagatggaggagtcgtcctctttctttctctgccctctcctttgatcaacttttaccatttcctttgcatcttagaaaatgaggcaaaatccagtttgggcttagggccagagaagagcccttgaggcctccctcatggaaaacatactctctcagtttaccagagtttcctgtaccaaggggaaatttctgcaaacagtaatgttatattctttttgccttccctcttttccctttgcccagggaggccagatgattgtcagaacaggacttgggccttcctgggtgcctcgcccccttcctccatgtaataaataatagctgacaccaagcaagtgggattgggaggcagggaagctttcattttctttttgatatacttttatgcatttgcttggttggttatggcaagattttctcaccagaaatggagatttgttggattgaaaataaaaagtaatcagccatgttttacattcaacatttattgaacccctgctgataaagcacttgccagcttcagtgggtctgctagagatgagagtacacaatccctgacttacagataccttgtcccaactaaggcctaggttatctgaaggggagattatcaatggcaaatgcaggctcctcctgtggaaagaaattctgcttcctggagctggtggtctcttctcccaccagttcaaagaagcttctctcgcactgtggatctgccctccctgccccacaaggttagggtatgtgccattggggctcagggcatatgtgggaaattcagacattctgtaacacctgctgtctcttcccacgcaggtgaacccttgctgaagcaggacagcaagcaggtccaggtggacctccacgacctgggctatgagacttgtggtcaaagcaagaatgaggctgaacaggaggaatccaccagtcccggtaagagcacagggtgtggggctcaccttccctccctggagtcagctgtcacatttgggtgctgttggccaattccacacctgacaagtagtggggaagaggaggacaggaggttaataggagaactcttacccaaaatgaggctgagtataagtttgaatttctacaatgagtttgtggcatactgctaataataataataatcatatgaagttctatccaactgattattatagaaatactaaggcctacttagagaccacatgaggttttggaaacatgcaaaccataagttaaaaataattttggtttgcattataaaaggactacaactatagggccacccaccacattcaaaacgagaagagaagaaaaacacagtctctctcattcttgaggaagtgtactgtggcagttaagagaaaagatcctggggtcagacttgttgcttcaaatcccaatttgtaaactttcctatgctccagtttcttcaaatgttaaaatagtaataaaggaactacctaccccatcaggtactaatgtcaattaaatgagtaaattcttataaaatgctttagaacagtgtctggcatcgggtaaaatgctgtggattagttctcattctgactaccactgccccaatacactgatgttaacatgctgatatatttattcaaactcttattttcctttgcctatttttcacacagttataacccaataaacttttaaattatagtaaactttagagagcattaaacttgcagcatgcagaaatagcttgtcctacattcttgtggctatcctaactagataaggccatgttaataatgtcttgagaaacatcagtgtgtgtggaatgaacacaggatgttggaggatttgaattcaggctctgccacgtgctagtttgagtgatctagaacaagctggtttaccacctctctttaagttttggtttccccagtcagtaaaatagagagtggtgaaacctaacttgtgggtataaggaggataagaaatactgtatttgaatgcctagtacagtgtcagggttgaataaagtacgacttcacctttttccctagtaattattatcctcatgaccaaacctgcctcctctcaaaggcagtggccacaacagcacatccaacttttattcaggaagacatctttgtcttttttcagagcatgaggagcacagcagccgcaaggaaatggtcctggtggaggggctgtgctctgagcaggggcgccggggctgaacgctggctagttcctctgagaggaagcccttggagaatgaactagggaagcaggaagagttctgggtatatggaaagtcagaaaacatctgggtcctatgaaaggacatcaaagatctgaaggcccagctgcagaatgccaacaaggtcattcaaaacttcaagagccaggtccagtccctctcagttacaagtgattattcatctagtctggaaagaccctggaagctgagagctcctgacaccctggaggggtcttcacctcatagtgtcactgatgaggatgaggtgtggctgtctgatggcactggggctttctactctccaggacttcaggccaaaaaggacctgaagagtctcatccagagagtatcccagctggaggcccagctcccaaaaaattgactagaagggaagctggctgaggagctgagatcagcctcatggcctgggtaaggatggcactgtctgggcactttctggattgaaaatgtgtaagtttgtgcttggtgtagggtagctcaggcagttggaagaaacaacatgtctgggtattcacaaggacactgatttaaatggtagatataggtctgtggaaaagacaggtaggcaagcaggagggcataggatgatgtcccagtatctgggagataccagatctcagggatttcctcttagggatatatcagtaaagtaatagtacatatggtatagtatagtatagtatagtatagtatagtatagtatagtatagcatagtatagtggtaatactggaatcagactgcctagctctgatgcttactacccatgcaaccttcttaacctttctgagcctttgtcattacctattaaatgaggatgataacagaacccatctcaaagggtggatattaggtttaaatgaattaatacaagtgctggccaggtgtggtggctcatgcctgtaatcccaacattttgggaggctgaggtgggcagaacacccgaggtcaggagttcgagaccaggctacccaacatggtgaaaccctgtctctactaaaaatataaaaattaggtgggcatggtggtgcacccctgtaatcccagctactcaggaggctgaggcaggagaatcgcttgaacctgggaagtggaggatgcagtgagccgagatggtaccactgcaccccagcctgggtgacagagcaagactctgtctcaaaaaaaaaaaaaaattagtacaagtgcttagaatggtgcccagcatacattaagctctcaatgctatttgccatagttatcagtgttattgacactttgtgttgaaaacacagacattcatcttggtatgcgtcctggttatctactgctaagtaagaaccactctaaaacttagtgacttcaaacagtactttattatgcttcatggttctgtggtttgactgggctcagctgggtggctctcacttagggtctcttgttttgggtctcatcagttgatggcatgagagtttatgtgatggccatgattgcaaaatacagtcagccacagtatcacaacacagaagaaattcagacatcaggtggtggttaaaacagaagacatgaaaggtcctatctagacttaggatgagatgagtctaattattcattgagtatctgctgtgaatctctgtgatgctggtgctgtaagggatgtgaaacgcagaactatcttcattctcacagaccttacgatttatctagggacatataattaacatatatagaacagttgaagaacagtggcatggtaaattttttgttttgttttgttttgatacagagtctcactctgtcacccaggctggagtgcagtggtgccatctcggctcactgcaacctctccctcccaggttcaagcaattctcctccctcagcctcccaagtagctgggattacaggcatgtgccaccatgcccagctagtttttttgtgtgtttttagtagaggagggggtttcaccatattggccaggctggtctcgaacttctgaccttgtgatctgcctgcctcagcctcccaaagtgctgggattacaggcgtcagtcaccacgcccggcccatactaaatttttagtgcaataatttatcagggtagaatttactcttaaatacctcctatggcttacgtgccagaattcagtttgggggagttccttagagatgttctcatagaaatctctacagaagccccataacttatcatccaccctttcctcttctgtcctgcattaggaaatatgattccctgattcaggatcagccccgggaactgtcttacctacggcaaaaaatacgagaagggagaggtgtttgttatcttctcacccagcatgcaaaagatacagtaaaatcttttgaggatctcttaaggagcaatgacattgactactacctgggacagagcttccgggagcaactggcccggggaagccagctgacagagaggctcaccagcacactcagcaccagtaggttggccacagggctttggatactctcagtcaccccacagttccagcccctggtggccaccacatctccactgcaactttttaacgtagggtcctgtttctatttcatttcctggggctaatacaggatcaagactgctcaatggggagcatggagaggaacacacagggctggagatgccatggttacaactctagaaacttcaccactcatggaatgtgacctgtggggcaggggcggcatctctctggtgctaagagggagtaggggacatgacatggaagggccttgttataggaggaagagccgtgagctaacaattgcaagacgtcgaggcgctgaggccaaagggtccgtgaggaaacaggcgcagctcgcgcccctcggcctacgggagggagggcaaggagagtcctacggttcctgggaggacgagaagagccaagagccccgacggccggcgccggggaaaaggccccgaggcggggtccgcatccctggaagggcggcgtccaccctcctgagaggcacggggcgcccagggctcggacgctcaaagcccgccggctcctgcagcttctgggagccgaagagtgtcagccgggaggatcccgcacacggcgcttagttctggaactgcatacccaggggaggatgcgggagcccgaagcccgggtatgtgtccccgaagcccgggtgtgggtccccatggttttcgtgttgggggtgggcgcggaacgctaagcctgggcctattgggagccatagtcttcttgatggctggtgcttattgggcttttttcagtcgaatttcgaaatgcagttgaatttcttactttggaaacgataatagaaatggctgacctaagattttcatgatgatattttgccttttttggtgtatatgcagtttctgtggtgtagtggttattatgttcgcttcacatatgaaaggtctctggttcgagactgcgtgggaacatcgtgttttgttttgtttttttgtccctaaatttagtgagtttaatcgaggttgggaaacaaacagaaaagtagttgaacctgtggctacactttagacctcctcaatctagacagatcgttgaccaggctacagtttccactggtctgccagcaagaggcctgcttaatattagctttggttccagaaattccttcaggttctcttcattctcttctatcgcctgtattttcacaggctgacactgaaagtggatgacatcttagtgcatttcctaagggtcccgcttggcttcgctttactctggtaagttgcagatctggctgatttgcaagacaacaaaaacaaaatattttttaaaaaggttctaaatctgcatctggaagtcatagagtcaatattcctaaatcacatgaattatgtgtatacatttgcatgcataccccttccccaaataatcctcagaaaaccggttaagttttagcatctgtgactctgagatgcatatgaggcctttgtaaatttagaagttaagagtagaaagtacaggtttgtattttagaaggagatttgggaataaatatagctctggtggatatagatcatatgttaaggtttgttggccagagctggtttgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatatggagaaaactctggatttgtctcttcagttgaatgtttccagagaaaattgaggaaagaaatctctctactatttgaacttcatcaaaagactaatatgctaatatttgaccgtcaatatttccttaaactagtctactccttacatagctaatacatcaaagcatattaacttaggaaatgggattctcccaaacaatgaaacattgacggcaagcgttcttcatcttttcatatcacatttccttcaaatgctttatacatcttcaagcagacaaataatagtattataatgattacgagactgatcgttactcttttgccaaaaaaaccagcgacaaaagactaacttagtggaccaacctttatttcttcattttctctaccttggttctgtccttttatttcctctttcttctaattctgcttctgctactgatttcctccctggatttgaactttacttacctaaactaccagttaggttaccttcttagaacctctaaggcagcagtttgaggttgacgatggaagatttaggattagaaaaaagaaacgtgaatgaatttctgatgttttattataggggtttgtaatgcaggtagaaagaaggacctttttcagagttaagagtttgatccgacaaatgagctattttgatatttataacgttgtctagtaaaagtttcctgtaaaaacacatttggtttggatgtctttgttagcttttagtcgacacttgaaaaaaccgcttggaacggtttctaagtctttgtggatactcttttctgttatcctccaggcggtagttacgcagaggcattggtggttcagtggtagaattctcgcctcccacgcgggagacccgggttcaattcccggccaatgcaaaagggtctttttcaccccgctgttgctctttatctgtcttttacgctgaaaatcatactgcataacctaatagtgcatttaggggcttggccaccacaaggtaaagtgacgacaacactcacgaaagtagcggcaggagacattcaggagactaactcaggaccccatgcagttgttggactcaaacagcttagcaagctgacaagcatgaagtgtttccggtgagtcactgcagttttcatactggtacctgtgactttcatctattcactggaaggatccctgcaaacccgaagaaccatcaggttcctgattcgcgtgctggaccttgggcttaccgttgagccactatggagaggatcaagaaatgacgctcttggaaggagagaagctgcgggcaggacagtcacctcagaggtccaagaggcgtcagcggcccaaagaaaggggtggtgtgtgggcaagagtctgcgtggagatgaggggagcggcggagactggtccttgcgcagaggtggccagtagaccctcagggctgtaccccagacaccgtgaaccgaatttgctaacatcgtcagcgaccgcggcctccgcgtgttttgtgggcccatcggtgttccccgagaaattccgtgtgtctggcaatgtgtgtcaacaggtgttggcctgaaatttggccgggcacggtggctcacgcctgtaatcccagcgctttgtgaggccgaggcggatggatcgcttgaggtcaagagttcaagaccagcctggctaacatggagaaatcccgtctctactaaaaatacaaaaattagccaaatgtggtggcatgcacctgctattccggctacttgggaggctgaggcaggagaatcgcttgaactcaggaggcggaggttgcagtgagccaagatcgcgctactgcagtccagcctgggcgacagagcgagactccgtcaaaaaaaaaaagaaaaaaaaaaaggagcgaaagaaggcagagatgtcaatgggacaaagagacctcccaggaggcttgttgtagaggcagtggccggatcctgagagatgagattttttatttaattatgtagcagaatggggagagaaagggagaagcgcatgaaagacagaaaagcacgaaaatctgcggacgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgctgcctctcaagggccctttgtctgtagcttccactgatgaaataatgcggttatagtcttttctggtagagaaaacggctgtatcagtggaattttttaaaaacacaaaacgagaacgagtttttaatgagctgacaataaaatctaaactagttgtcatggtctgcaccggcttgcctccattccccatctgctaatttttatgagaacagtaaattattactattatcattatttttgagacgtagtcttgttctgtcacccaggctggagtgtcatggctcaatctcggctcactgcaacctctgtctcccaggttcaagcaatgagaacagtaaagaaactacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatgttttgtgtctggccttttttctgcagttacattcattatactcatgagatatatccatgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgttttttcaccagcgatgacagttgaagtggcaccaaattcttgtcagcatttggtgtacgaactttgttaaatgtagctatgctctcagaccaatctggccaacatggcgaaaccctgtctctactcaaaatacaaaaattagccgggcatggtggcatgcacctgtagtcccagctactccggagggggatgttgcagtgagtcaagatcacagcattgcactccagcttgggtgacagaatgagaccctgtctcagaaaaaaaaaaaaaaaaagtagccatacactggtgagtagttagtgctatctcagtgtggaattaatttgtatttgcctaatgagcaatcctatgaagcatactttcttgtggcttccagcatataagaaactctcctttgcaaaggcctattcaaatattttgccctattttatttggcttagctctatattactgatttacaaaagttctcttgtatattcaagaattgagtctttttttttgactttttttattatactttaagttttagggtacatgtgcacaacgtgcaggtttgttacatatgtatacatgtgccatgttgatgtgctgcacccattaactcgtcacttacattaggtatatctcctgatgctatccctcccccctccccccaccccacaacaggccctggtgtgtgatgttccccttcctgtgtccaagtgttctcattgttcaattcccacctatgagtgagaacatgcagttcttggttttttgtccttgcgatagtttgctgagaacgatggtttccagcttcatccatgtccctacaaaggacatgaactcatcaatttttatggctgcatagtattccatggtgtatatgtgccacattttcttcatctagtctatcattgttggacatttgggttggttccaagtctatgctattgtgaatagtgccgcaataaacatacgtgtgcatgtgtctttatagcagcatgatttataatcctttggcatttataatcatttataataatcatttatttataatcatataaatcaaataaatatataatttatttataatcatttggcttttagcagcatgatttatatacccagtaatgggatggctgggtcaaatggtatttctagttctagatccctgaggaatcaccatactgacttccacaacggttgaactagtttacagtcccaccaacagtgtaaaagtgttcctatttctccacatcctctccagcacctgttgcttcctgactttttgatgatcgccattctaactggtgtgagatggtatctcattgtggttttgatttgcatttccctgatggccgctgatgatgaggattttttcatgtgtcttttggctgcataaatgtcttctgagaagtgtctgttcatatccttcgcccacttgttgatggggttctttgttgttttcttgcaaatttgtttgtgttctttgtagattctgatgaatctacagatgagtagattgcaaaaattttctcccattctgtaggttgcctgttcactgtgatgatagtttcttttgctgcacagaagctcttaagtttaattagatcccatttgtcaattttggcttttgttgccattgcttttgctcttttagacatgaagtccttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcctgatagtgattcttcctacccatgagcgtggaatgttcttccatttgtttgtatcctcttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattttgtatgctgaggagtcatttttaaaataaatatattgcaaatgaattttcccagtcagtgaaaagtctgactgaaagctgtcaactgaaaaatcacacaatttataaatttagaagggagattttattttttataaatggttacagcctgcaaggtggccattcccacagactgggaggcataccctcctgctgaaaccgaaaagtaggtttccagggaggggaggggggaacagggatttatgttgatctggtgggccacatatgcatattcaacagggaataggaggagctctgaatattcatgaagggatcgtgctgcatgcatgctgagtaaacaagcctgttacatgcaacccatgttcactttggggtggagatgacatttaaatacattataattagtccctatgcttcaaaaggggaagcagggacacaaaggcagtcaagtgcacagcctctgtaaaacgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggtgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagcttccaagtactggccaggaactcagtatttaagacttctctggggtctccttggcaaagaagccatctgtccagctagttgggtggcttcagattttaattttagttctgaaagcatttaatttgatgaaattttgccatattttttctttatttttaaagcccgtcatgttctataaaaatctttctactcaggatgtgaatggattctcttaattttatctctctatgagttccagagtttcagttttaatttttaaattgatgacatctaaaattctactcctaaccaaaacatttttgggggtgactaaggacaactccaaaaatcttccataaatggaagtaagacttactccttaaagaactttctgggatcctgagctgcggggcacagtggctttagtgcacctctgctcttaagactattcagaaattgtctttgtgaacccatcaggctgtttcaaaatcagcaatttagggcttgcttgcaacacgcagttaagcagcagctgttttttggatctcatgagtgcctgcatgcatacttccctgggaattttctaaatttgaattctcatggtatttcaagtggcatagttgtctctttcttttgcctacagccacatacataccaccaaatcctgcactccaagcttctccttcctcaccctgaactcccaacctccagttagacaatccacatcttcccacacctgcctcaggctccatcaggccactgtgcctcccgcagcaaccaggccagggggaatctggattcctattacacttctgaggaaggtgatcagggggcgtggaggatgtgggtgggaaggggtgagattgagggcaggagtacactgtggtcttctgtcttctacctcattggcccaggtgctgctcttcctccggttgtctgctttcagccctgtgtagggaatcaggtctgcgccctcatcttcctgactctcattttctgaggaacctgaatggatgagccgtcgctcttgtcccacacattgtgtccaaaggtgccctcctctctacttgctccggtgcctgctctctgagctctgacactcaggctgggatgccgcccagtacagaagctctgcagccctgcagggctctgactgttccacaccagcaggataaaggccacagggcatgctgtggtcgaaaagcattcagaggtgtgggctgaaggcctctctttccacagtccctttgaacaccccatggaagtcagcacccctttgaggaacgaggtggcccaaggcctggcttcacatgcaggccgttgggtcccagtgggtcctctctgtgcctggtatagccaacggcttcatgcatcttacccggtttcctctcctccaccacccaagctcctccttgacccccttgctcagctgttctcaggacagcaagatccccagcccttggaaaagcccatctccagtgcttggggagggagttgggttcaggtcgtctaaccacagaaggacagagaacttgaggcaggaggaaatcccttcccttgctgggtctcttggcacagcccatccaggggtctgggtcagggtccaggtatactctaccctcctataggacctggatttttaggcccccgaggttggtcaacgtggagtctttcccactgttcacctgggaactgaaggaatatcccatggggccctctcttactcattagagacacccagaaaatactccattcagcagaaactgcgtgcagtgtaccagaccactataattataactgcagggtgtggaggtcagacacgttttgtggctattttctctctgtctgtgacttgcttgccttttcactttcttagtggtatcttttgatgagaaggtgtggctaatgttgatgaagtctcatttatcatgtctttcttatatatgtattttttgtgtcctgcttgttggtagggtgatctttgcctaccaacaagtcacaaactatccttgaaatgctttatatctttaacttttacgttttggtgtgtaatgtacctgaaattacttttgtgtgtagtgtgagggagaataacattgttggtctccccacattcatataaaagtccattaattgaaatgatttattttcttttattgaactgcttttattgaaaacccatttattgaccgtatagctgtggatcagtttcaagtctcttaactcagtctgtttatctatttgtcactcctgatgcctcgtctgtaatagcttatagtaaaccttaaagtcagatagtacaagtccttgttcttttttacacattgcaataatttttgaaataggtaataactcataaaaccatcacacacatcaggatatgctgtcacttcatccctttctgacatggtttggccgtgccctcacccaaatctcaacttgaattgtatctcccagaattcccatgtgttgtgggagggacctaggaggaggtaattgaatcatgggggcgggtctttcctgtgctattctcctgatagtgaataagtctcactatctgctgggtttctcaggggtttctgctttggcttcttcctcattttctcttgctgctgccttgtaagaagtgccttttgcctcccgccatgattctgaggcctccccagtcatatggaaatgtaagtccaattaaacctctttttcgtcccggactatgttatgtatttgtcagcagcgtgaaaacggactaatacactctcatttctgagtgggacacatgctgtcactcacatatgctggttgctgacttgtgacggaagattctctattgtaccctctggggacaatacatctccagttgcctgcggggaggatgaacatgcaaaaaatccacaacactcagcacagagtctggatttagtcccattagtctgaatgggactaatgcccttataaaagggacctcggggagctctctcgccctctttctgccccctgaggatacaatgaggaggtggcagtctacaaccagaacaaaaggccctcaccataaacctaccatgtcggcaccttgatctcggacttccaacctccggaactgtgagaaatcaatttctgttgtgaatcagccacccagtttatgtatggtacagtgttagagaagcccgaactaagacacagatggaatcccatggagagtctctaatttgctaagctggtcatcaggcgggatgttgccagttagaaacaggaagagctgacattttgtgtatatgaaagaagatagtggacaggcccattgtgtcggctttgtctgccttggcaaactggagacggaaactcgattcaccatcgccagccacgggaggactgggaggacctccagaggaggttaggttgacttcatggtaactttagatcctgaaacctcccaggatatttcttgtcttccctttgatcgctcttccgcctacccaacaggacaggactcgacgcctttctttcctggcagcaagaggtccgttgcggacaagaccaaagtgagcagctggtttcccctacgtgtccttccgggcctgggcgtctctggagctcaggctgacccgagacctgactcccggccagtgggaccagcaggagcctggaagagcgcgcccaccggggtggaggttggtcgccgggggtcgagaaccgcagtcaaaccctcttcttccccgggcaccgcgcacctgcccccggggatgccgaaggaagtggcccataaagcttctctgcaaccgaaagaggcctgaagctccaggagggccgagaggagcctcgttgagcgaacccagccctctgcctggctggccctggtcaacaggctcggaagaggctgatttggaggacagaacggaagaaaagacctaaaggtttcgaatctcatgatgtagagatgttaaaagcctccaatcctaaggtctgactgtgcgggggagcgagggggtctcaagctggatggacccctgagccttcatctggagagtcctctgcacaagctcagacagcaggacaacgcgcatcagtggttctcaagagggggcaacttcgcccttacacgcctctcacctccacgctgggacactaggtcacgaatgggggaagcggggagggagaatgctaaccccctggcatgtatctagtcagcagaggcgacggctgctgctaaacaccttacaatccacgggagggcccctcccctaccccgaagtagccattccgcagaggtggagagactctcgtgtagctcaatgcccacgcacttagccgatgggaaattacgaattgatgaccagttggctcttggatctgaggaaaaaactccagagtcagagggaactctcgaagttttgcccggagcaaacggaagggtggctttgccatcgcctaagatgggaaaatggcaggtgtcacaggttgcaggggaaggtcggagaccagctgagggccccggagccttcctggaaagagtttcccatccagcccgtctcggtttccgcatccgtctgattccttatgatgttgagggtgctggcgtctgggtcctttatgatgcagagggtgcccccgtctcaccctgggcgcctccgcgctcccgcctcctcctggcaacctggtgcgcggctccggacctggcgacccacgaccggctggtcacttgctgccacctcgcaaaggcgcatctctagttcagtggtgagctgcggccgggtcgctgcaactcgctccaggcctccggactcgtggcctcggtgtccctcgcggagccctcggtgtgtcgcttgcaggctctttttttgaagaaagcagggagggaatggccttgtgagagactccaggagcaaagagcgaccctcacaaggcccaagtcctcccagagctcagggaagctgtcgcttctgacagaagaagggagacaaagctccctcctgtgtgtccctggtggtctagtggctaggattcggcgctttcaccgccgcggcccgggttcgattcccggccagggaattgttttacactggccgccctcccgcaggaatcttccttcactacgctgtcagccggcctgctccaagggccagaagcagaacagtctccgcagcggggttaaagccgggcgaaggagggcaagtgctggtggaccacctctcacgacacaccgttcctgtttatctcagtgtccgtcatccgcgggagcagctttagagagcgactgagcgtctcgctccggtgtacacagcccggcaaagatgccagcccccgtggagctgcacccaataagcccaccttctttcccgtcgccaccccggagacgcccatcgggctgagctgcgaataactaagagagaggccaagccaagtcgtggcgtttgtggcagccccggacacgggcaccagccagtcagcggagcctcctcacctccgttgccagcgaaggcgctcgttaggccttgggaagaggcgaccggaggcgatgcccgcgaatttgttaggggggtaagcggcgggtgaggtcctcgagggcggtcccgtttgctgattgagcggtagacggaggcgatgttcgctgacccaacaaggacagcaggtggagtaggcacagatggaaaactgctgccggtgccctaagcagaaggcaggtggaaaaatcagcactaggacgtcgaagcgatggtaccacagtcaaatcccacgacgtctacactctaccaagcacttgcgcacgctcccccttttccattcagtactcccaagaggggttcggaagaaccccgagtccattgtaagctcaggggagagcgggagccagggaggtgaagtgcgcagactcggcagcggcggcgggcagaaccgcgggggggtgagagggcgcggtggctgcggggcgggagccgctgctgagaggcggcctgggttgtcttgtggggtgactgtcggtggaatctttggtggagagtggtttggaagaatggcgaggggcggcagtggggagggtggtgaccctgagcgaccggccagggcgaggaggctgtgctgtccctgcaggccatgtgctcatttccacttacctggcaggggagagaccgtggtcacgaagggggttctcccagagtgaagcttcttcatctcactctagagttgctgatccctgtgatttcctccatgtgggaaacggtgtttgtgctagaagaggctgcgctctttacctgacataacggggttcaagactgacaacgcctcacgcccacccgaaaacgtttacatggcttccttgtctctttttttttctgtcctaaagtcgcctcatcttcacatcccctcttttttttcttccacactcgagagtgtctctctctctcagtaaaagctccaccaaatatttgaaatatctcaaccagaaagactgcaataaatacattatttcattcgtggaaggtacagaccagctagattgagagttgcttgatattttctgctaaacggtgaggcatagagcacttggaaggtttctctttgggccactgtttgtgtactcttgggtttccttcttttccccagacagtatggcgctgtggggccaggggtaaaccctgctttccggctttctggctgcagataaaggcctcagctggtgcaggaatcaaaagcaaaccaaaagacacgtgggttcgccccagtgggtccaagatagagtctgactgtaccaggattccgattagaacagaggttgctgcaggcacaacgcagactactaaccactagagaatcccaaggcgccccacacctactgcccgtcgttttgcttccccacccctctattatttatttgtatatttttttgagagacagaatttcgctttgtcgcccaggctggagggcagcggcacgatctcggctcactgctacctccgcctcttaggttcaagcgattctcctgcctcagcctcctaagtagctgagactacaaacgtgcaccaccacgcccagctaatttttgtatttgtggtagagacgagctttcaccatgttggcccggctggtctcgaactcctgacttcaagtgagtgatccacccacctcggcctcccaaagtgctgggattacaggcgtgagccaccgcccctggtcccccgattttttttattaatgtaaaaacattatgcgatttttacttctttattcttgggcagctacaggttcttgtgattttctctcacatcttctccccatttccccctctccattctgatacatgtcccatcttctctgcatccagccggtgccctctgcacgggcatcctgggctgtcccattgtctagtcctggtctcccctgcttctccctcctccttgtcacgttttcccttttgactcccctgcctctttcccgctcccgccccaccgaccccatctactgaagccgagttgagtgaagggagagcaagcggaacagatgattgcctgaaggcggcgcaaaagaacagaaagagctaccgtgagagccgtcggggagttcagcttcccttgggccctacttggctcaggctggggtcgcagatccaggcatttccagaggcactggcttctgaagcaggcgagggtgaacgcagggtgaaggccattcggccgcccttctggcttcagagtcacgcaatgcacgcgtttctaacgtgcagcaagacgattagtcgactcagcctctccggttttctgaagctttgtagtctgcacagttgtcccgcagaaagcgaatggcaactcctagggtttagtgattgcttaatctatatagagatgaaagcaagcgattgaggttgtctctgtggtgcaatcggttagcgcgttcggctgttaaccataaggttggtggttagagaccacccagggacgtgattttaaatgttggttgtgaccaggcgcagtgcctcacgtctattaatcccaacgctttgataggctgaagtaggggaagcctccacggagctcagaagttcaagaccagtgagaatcccacctcatttaaaaaaaaaaaaatgcagttgtatctatctcctcagacccttcaatgtatttaaaagtgaaagactgttcccttgtgtcttgtgcatcccatgaggacagacagcagaaggtccccctccaagcctcctagaaaatgagatctctgcagaacaaactagcttgtatgtacgggaaacggaaagtatttgaaggaacaaacttcaaaaattctgccttgctttccacaaaaattaacccatcacagtctgccttcaagtggcatcatacctcttcccatgactcctccccctgcctttatgctattgtcatgcattttactttacacctgttataaaccttacaatccatctctattacttttgtttcaagagtcagatgtgtttttgtttgtttgtttatttttgtttttttgttgctggtggtggtgtttttaagacgagtctcactctatcggacaggctggagtgcagtggcacagtcttggctcactgcaacctctgctttccgggttcaagcgattctcctgactcagactcctgagtagcagagactacaggcttgggccaccatatcggactaatttctgaatttttagtagagaggaaggttcaccatattggccaggatggtctcaaactcctgacctcaagtgatccaccttccttgaatcccaaagtgctgggattccaggcgtgagccatcgtgcccggctaaacagtcagatgttaaaattatatatttgcctatgtacatgtcatttctagtgtcttttttttttcatccagattttcatctggtgtcagtttccttctgcctggaggactcctttaacttgtctattaggtgtcttaaacttgcactgtcattcactgatgctctgttcatttaaaaaaaaacttgttggccgggtgcggtggctcacgcctgtaatgccagcactttgcgaggccgaggtggtagatcaggaggtcaggagatcgagaccatcctggctaacacggtgaaaccccgtctctactaaaaatacaaaaaaattagctggctgtggtggcgggcgcctgtagtcccagctactcaggaggctgaggcgggagaatggtgtgaacccaggaggcggagcttggaacctgtcaaaaggcattcttagccttaaaagaaaagccagggacatcccttgcctcaggactctcgaacttagaaaaacctttcaccctctatgtggatgaataacaagggacagcttcaaatgttctaattcaaaggctgaggaattgctttggaccagtggcttatttctctaaacagctagaccaggtggcagctaggtgactaggaagcttgagatctgtggctaccatcactttattgttagaagaaaccagtaagtttaccttgggacaaaaattacatgccataccaccccacccccaccccctgccaccccatgaagtacagtacagagggtcctagaggcaaaagtacaccaatggctaacagggagccagttacttaaatatcagacccttctgcttgacaccccagatgttaccctgaaagtatcctgattttgaaaccctgctactctgttgctgcacctcacatctcaagaaacagatcccaaactcattgactcctgtgtggaaaccacggaagagctctactctagaaggcccaaccttgaagacaagctgttgtctaacccaaatgttgagtggtttagagatggaaatagctatattcatgagggagtaagaaaggaagcttagccaacaagaagtcattgaggccaagggtttaccttctcagacttctgttcaaaaagcagaattagctgctctaattagggccttccaaccatgaaaagacttaagctggacacggtggctcacgcctgtaatcccagcactttgggaggccaaggtgggtggatcacctgaggttgggagttcgagaccggcctagccaacatggcgaaaccccgtctctactaaaaatacaaaaattagccgggtgtggtggggtgcgcctgtaatcccagctacttgggaggctggggcatgagaatccctgagtttgcagtgagctgagattgcagtgagctgagatcatgccactgcactccagcctgggcgacacagcaagactccgtttcaaaaaaagaagaagaaaaccaaaacctcaagagtcaatgtgttgactgactctaaatatgggttcctggtgctccatgctcatgcagccatagggaaggaaaggggactatcaagagccaagggatcccccacacaactttactcagatcttggaacttttagatgctgtccaactcccaaagaaataacaattactcactgcaggggacaccagaagggagacacttttattattagaggaaattccctggtggaaagagcagctaaggccacagctaaggaaaccctggtatttcaggctgctgcgctactaccaggtactgcatccgtgtcagtgacaccatactatacccctaaggaaattaaagggactgagtaaaaggcttccagggagacccctctggatggttgctagaaaagaacaaactctattcctgaggctgacaaatgggaaataattaaacattttcatgattcctcacatttgggacaggattttccatttaaattagtttcctaaatattcttgcggaagggactgttccaaactataaaaagggttaccactcaggaagccaccccataccccgatccctgcttaaacctgtacaacaccaaggaacataccatggtgaagactggcagacagacttaacccagatgccaccttacaggggagtacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctatcttcactcctcatggagatctcagtcttcaaataacatagaaagccaatcgcgacattagcaaaactctttcagtttgggggcttgcctgccctgcgtcactatcattgtttccttgggtttcccaggaatgtacatgtgtcagactgccgccctgcttatagatctgtttccctgcaaggaaacaggaatatgttgcctgtggcttccagagttggagatacatgtagttgcacccctgagggctaacatttaattttggaatcaagtgatgcattcagactggttgttatcattctgtggtatatatttagtgaacacattctgattgagtttcctgcttttagctggagcaagaaagtttaataattgtgatttgtatgaaaaaaatcataggcaagggaatgggtgtaaaataaactttattgtcagaggtttctaaaggctcatccttcaaggaaaacggacatatgctgaagagctgataaaccgtctacagcagtgttattctaagctaatcttgattccaagttcttgccattttcctccagctgctgttgactccagttatatataggatgggggaaaggggattatctatgaatgtaggcatcactctctcttgggcagttatcacattggcagactgaagggatgtgatttctacagtcaaactatccatttggagtacaaatctggagtggctgtaaaattcggttctcagagatgaacttgcagattcagactttcaattgttctgttgttttagtttttctcatcaactggggaactgtttgtgactaagctttgttaaaagtagagaagagtttttcatagttccaacattagttgttacccgaaacaaacaaaaacacacacacatacaattaaacaataatctttggtgaggtcttgctgatacctgaggctggagtgagagctgactggtgatacaggccaggtgcaaactgagtgcaactaagtggataatctccagtagtgaactacagtctagaagaagatagtaataatagattaaaaaaaagtctcctgaagtgaaccagctggcgtgtggtgtaggacacaggaccccacccaccttatgattctaagagccttgctcaaagccactgcagttgagttcgctaggtctctaccacctcctcagcatcaattgactctccataatactcctctggagagaaataagggtctttcaacctcccaggaagggatttgcttagcctcaaatatgcacattcaggaatagcttgtcgtaagaaagagaggatagtttgcagagaaataaccctcctaagtccacatcctattccttttaaataagagagtggtgacaagggaagagccctagaatgtcaaagccaacagggtgctcagataccacccaagtacagttccatctttggccataaggagacaatggtgtcaagaggttaaggccgtatgatctgtaggtgaaaaatctgggatgggaatcaagtcctcaaaccttttccactacatcacagagtttaggagcagttagagggaaggcttcaatctggagaacactaacaggctctagagattattgggtcatggtggctgggacagaaataaggattcacagaaagatgtttatagtaaatgttcttttgggattttgcttgataaaaaggctgagcaaaagtaaaaatttatttcttttcttttcttttttttttttttttttgtttagacagtttcactcttgtttcccaggctggagtgcaatggtgcaacctcagctcaccacaacctccaccccctggggttcaagcaattctcctgcctcagcctcccaagtaggtgtgattacaggcatgcaccaccacgcccagctaattttttttttttttttttttttttttagtagagacagggttcctccatgttggtcaggctggtctcaaactcccaacctcaagtgatcctcccaaagtgctgggattacaggctccagccaccacacccggccaaaagtaaaaattttctaattgcaattctgaaccacttaggggttgtgaaatcaatatagtggactgcttattactacaggctttatttaaattctaggtagggtggattacacatagtaaaagattttttaaaaactgatcacaggacaggcgcggtggctcatgcctgtaatcccagcactttgggaggctgaggcaggtggatcacgcggtcaggagattgagaccatcctggctaacacggtgaaaccccgtctctactaaaaataaaaaaaaaaaaaattagctgggcatggtggtgggtgcctgtagtcccagctactcaggacgctaaggcaggagaatggtgtaaacccgggagggcggagcttgcagtaagccaaggtcacgccaatgcactccaacctgggcaacagagcaagactccatctcaaaaaaagaaaaaaaaaaactgatcacaaagaattgtatatttctcactgcgtcttgtggtcagaaaagtttgagaaactactctacataggcaaattacaggtccaatctctccatctacctctttatctcttctctatttccacgctatgcagacaagaccacggagagaggaaggcaaattccatcaatgggtgctgttaagccttttctatgaggtagctgcacatttggggcacttcaatactggttacttgagattctagtagacagattgtccttttcatctctagccacatggtaaaattacttgggagctttttaagactactagtggcttccacccacctggaagcatttaaatcagaatctctatgtgtagagtccaggcacttgtgttagttaaaacctcaccaggctttataatatgacagagtggtttaaagctacggagtagacccaccctatttcctacctttctctttgtttctctttcaccataggcttctttcccatgagaaagtaaagattttagtctctgttttcagagtctcaagtaaatcactctctttctcaactggacttccaaggcaaagatttctttctatttatctatctgcatttttacaaagttggcctctggattcccttttcccaaacctaattcaccacaaaggtgcccctcaagtcaaggagctgggctttcatacacctgcacctgtcaatcatggtaaatattttgcaggcagggttgctgggtgctgtgggattgacgtaaactcccaggtattgccagctctgagcctcaggcaagcttgtgactaaatgactccagtagtctgaggatagtccttactcagaagggtctttggaagcaaaagcaaacataggcatgagagggtaaaaaaaaaaaaaaaaaaaaaaaaaaaaatctcatgtcatcttggcttatacctaacagaacttgtgcaagaatggatattaaggtgggtattgtacagagcagaacttaataaataccaagtctggagtttaagggataggctgaagagattttgcaggcttgtaaacatttttgccaacttgaacacacttttgtttgggtttggtttttctcctcattggtaagagctacgcacaatagggtagctaagatattataatttgaatcgatacatttgtattttgccaaggatcaagatgaactatgatgatttccattttttagtactttattttcatcagtttgaaaattaggacttttgctccttttttggcttgtggcacctttttggttttcacactttctcaaagaccagtaacttagaatctaaattatgattgcttattctttcagtactctaggggaaagttgatttaatcttgacaaaatgtattcagttaaaataattgttctcttaaatctttctttctttctttctttcttttttctttttttggagatggagtcttgctctgtcacccaggctagtgtgcagtggcacaatcttggctcactgcaacctccgcctcctgggttcaaatgactctcctgcctcggcctcccgagtagctgggcctataggcgcatgccatcacgcccggctaatttttgtatttttagtagagatggggtttcaccatgttgttctcttaaatcttttcaccttttaagtttgtccttcctttctccaatttgcaataggggagtgtggctcgcagctaaatagtagacttctcagagctacttattcctggagcctggcagtctgcaggcctggagggggagcatctagaaagcagccctctctaagttgagaataactatgagaattgtgggttataaggctttgagcagctctggcctccccgtcctcttttgtttctactgtgggatgtgacaagagaaggaactcatctgagagagacttcatattgtggcctttcaccgattacttctggaaatttgattcaggcaagccagggagagtgtctggtattcttctctgagaagaagaattcattatacagctggacaatggaatctatgatctgcctgtagaggttagaggtgcatcctgttccgggaaataattacaatttaggcaagttatacatgtttgcttaagagaatgctttctgcacatttcatgttcttcctttctatcttagcctagggagaaaaccgtggggactcagggctggaactttagtgtgatggggcagaagcttaattttcacatgattctcaacaaatggcagcatatcccatgtattatcatgtccaatggctgcaatatgaaggaggcttttccgaaatagttgctgctttggtaaaaaattaactagatggattcaaagtcaaatttgaagaaagctgagcaggcagaagaaacaatcagtgaacctgaagataaggcaatggaaatcatccagtttgaggaacagaaataaaaaaagattgaagaaaagtgaacagagcctaagtgaccatcaagtggaccaccatgtacattgtggaagttcttttttgttgttgttgttttggggggtgggaggggggaaggagtttcatttttgctgcccagactggaatgcaatggcgctatctcagctcaccgcaacctctgcctcctggtttcaagcaattctcccacctcagcctcccaagaggctgagattgcaggcatgcaccaccatgcctggctaattttgtatttttagtagagacggcatttctccatgttggtcacgctggtctcaaactcctgacctcaggtgatcctcccgcctcggcctcccaaaatgctgggattacaggcatgagctactgctcccagccttgcattgtggaatttctaaagaagagggagagaagggcaatagagaatatttgaagaaatcatggctgaaaacttcccaaatttgatgaaagacatgaatacaaacacagtagcctaacaaactccaagtaagataaacctaaagagacctacaccaaaacgcattataatcaaactttcaaaagtcaaagagaatctttaaattggtaagagaaaagcaactggtcacatgcaagaaatctttaataagattatcaacagatttctcatcagaaactttggaagctggaaggacaggaaatcaaaagctgccaacaaccaggaggggtggctcatatctataatcccaacactttgggtggctgaggcaggcagatcacttgaggtcaggagctcaagaccagcctggccaacatgacaaaaccctgtctctattaaaaatacaaaaattagccaggcgtggtggtgggtgactgtaatcccagcgacttgagagaccaaggtgggagaatcacttgaacctgggaggcggaggttgcagtaagccaagatctcgccactgcactccagcctgggtgatagggtgagactctgtattaataaacaaacaaacaaacaaaagctgcccgtgaaagggaaaaggatcaataaatgggtattccaaaaagtcaaaagtcacacaaatatcaagccaaaataaactggtttcctgactggaaatcgaccccaggctatggcagcaaaacacagaactttaagcactgaactgcaaggtagagcagactttattgtgcatcctggaagggatccagagcaggcagtttgagcttatgaagaattttaactttgtttcgggtcaaattttgctctttaatttagttaagagaattttttttccctacacaacacacataatattgtcaagagaatttttaagggtagccatgacactattatgtgtgtttgttttaatttgatcttcctatgaactgttaaaataagagatctctaaaatcttttttttttttaattcaggtgtctaatttaagggatccatcttcaggccattggcaagtagaatttccaatggtgtaattattgcaatagcaattcaaccaaatagcccctttgtggaaagcccaggatgtcattttccaggttaacctcctgggaagggcaaagaagaagcaatcccaaagattcccctgcaagaaaaaagttcaatgcaaggagtagaccacagatgggtaaggatgatgttggcctccagtaacccagatatttatgggggcttccagtcacagacctctgaatctataataccaggtaggccctcttgggattgagctttcctaggactaaccaggcaacaagaattgagatgacaaaagcctcaaagggatgggacttcttaagacaaaccccaagagcttgacatggtcagaacaaaaagtgtgctggggttcccagccattttcagacaggccacctagtatgacctgatagttactgcctctttccagatagtggaaaccaagagaaagcgctcccacttgctcacaagtcaagctctcaaggacataaaataagatgagaaggaacctcaaccggtacccccttttatgacagaataacacatagagacaaagacaaaggaacagacaatttctgggaacaaagggattaaacaataggaattggtaccacaaagtaccaaaaagcacaccagagtcactacacccaagactagtcacacaaatccttttctccaattaatcaagattttggagagggaaaagaaagaaacagtgatttttactgtccacttgatgagattccacacagagaaggaggccaggagcctggctggtaaaaaaattcttacccttatgacagctgatcagatcctgggttcttcactgcagcttccagaagagcagagctttcctatcctgcttacagctccaaaactgtaggggccaatggaaaccctccctcttaaccctctgaagtttcactcaaaaatcaagtcgcaaaaggcagattaattggaaaaaaggcataaaatgtactaacatgtgcatggggagagtcacagagtgattaccctcccctacccacaatgggatgcagaagcttatataccatcttgaggtaacagaatgaatgagggctcaaagcatggccaaaaccaggtgcaatcagagtcagaggtatatccaattattgtggacaagataagtgatggtagggagagaagaggaggcttggctagcaaaggtggtcttaatatgtaaatgaaaccctacagttagcagctctcagagagaataaaccctaaaaatttctttcagacctttacatgtgtcagactctcagttaatctttcctagatctgggcaaggaaagacttggctgtatcaatgcagattccctacagatgcaaatctccccaacaaaagacaactttgcagggctacttctgcagctggctttctgaacagacatctcaaaatatgtcaaagaaatgtagtttggggtcaaatatttttaattccttcacatctacagcctgatgcatcggccgtttcaatgcaacattgttggtggcaactccattcttccctatactcaagccaaaaaaccaggttctccttgaggctagtctttttctcacagcacacatccaatttgtcagaaaacttatgtttcctgtttggttaattacagattttgatctgcccaatctttctctttcttggtctctgaattttggcaaaggagtctcctgatacaggcaggatagattctactgacgattctcaaaaccgtcagacacttaagagccttaatctcggggtaggggtttgggccgccctcgaaccttttctttgggcctccccatcaaaatcagtctggccaggcctgtcttcaaggcccaggggcagggccaggtcctcccgatgcttcttgaagcttctcctgccgggtcagcagccaccctccccttccctctgacctgcagagaagcttcagggggcatttattcaatttgctaggagctcacggatgcaggtgcgcggtgactctgtggttcccaccgcacccaccgccctccttggtcctctcactgtctgaagcgggcagtaatgttcagggtgagcttgggctccgaagacacccagtcaaggagggaccagtagggaagggcactggccccttaggtccttcccagctagggatccgaaaaagttcttgaagaaatagaaagggagagttggaagtagatcaaagggaaagaaagaaaatcctagatttcctatctgaaggcaccatgaagagaaagtccgcctcctctgggccgcgtcctcacgtcgctggtgaaccaagttctgttctccattggagaccaaatcagttgactttggcttgactcctagtgaaggagccccgctttgtcctcccctgtttagctcttgatcctgaagcacttgattgtctctcccgggcttttgatggatttcagggatgcaactgagaaatttgtttttaatgcacttaattgaagtaagaatattttaaagtattttggcaaagaaaaacgtttccttttgcaatgaagacattcagatgtaaggaaaatcactaggctctcacaaacacaaattccatgtcagcaagtagatttgaccctcaggttgggcacactttaagtgtactgttggaacttaagatgaatctaggacattcatgattaatatttttagttttttagtacaatttaatattttaaatttaaatacacattctgaaaattgtataaccagcacaagaaaccggctttacgccatatttacaaacataggaaagaaagatgatattttaaatgacaatgcttcataaatggcaacatttttaaagtacctagagaaaaaaagttaatctagaattctatgcaaaaataaaatttcataactgtgagtgaaataaggacattgaaaaaatacaaaagctaaaagaattcaccaacccatgctgcaagaaatcttaagagtcctccaggcagaagcaaaaggataccagataaaaatgcgggcctacacaaagaaacgaatattggaaatggcatttagaaaacatgtactacacgttttcttataatttaaatctttcaaaaaatatttgacgtaataaataaaagtaataatgaatcacaaagcttatagtgcataaagtaaaactacataacactaggataaaggccagaaagggaggcataatgacactagaaagcagactatgataaattaaagatgtatcccggaaaccctaaagcagcctcttaaataagaaaagggttatagctaataaagcaacaaaggaaagaaaacggaatgaaataaaagctatgtaaacactatgctggaacaactactctccaggcctccaccctatagaaatacaccagtggccaatgagagtgtacaagaatgatgactgcagcattacttgtaatcataaaatgataaaaccaacgtaagtttaaagatatatgaaaagggttttatttatttaacagacagacaatggaacaagcaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattctgctacaataaacaaacaaaaacaattctcacttccagaagatcccgcctgtgcctctgcatgcgcctttcaggaggtctggatgtctggtccaccgctcccgggcttctttcccagcttttgcttttccctttacctgctctcgccctacggccccagggccggaccacggcccagctgagccccgcggctccaccgcgcagaaggtgcgccggaggccctgccagtttcccgccctgcagggtactgagaaatcaacgatttgtaaaaagaacttccccatggaaaaaaatctgttgatttccgctctcagggctcttcaaaggactaaaagctaaaggcgacaatgaattcattcgacaagtcctagtcgtgagccctggtgagtgccagaccctgctccccccgaggggacccacgagcgaccctcaccaccatccctgccctggtggagcccccgtgcggaacacaggatccgaagatggcagcggaagctcctccgcggccccgagagcgactgggcagggtgggcacaggctcttcaatgggtgaaggcggcgcaaagaacgggaagaaccatcccaggagcccacagggcgttcagcttcccttggggccccaggcggctcgggctgggtcgccgacccgggagttcctggaagcttctgaagcaggcgaggggcagggcgggcgaaggcaattccgctgttctggctccagaatctcctaacgcgcaggcgtccaacgtgaccggcgcgactcaccgctctaatctctctggttttccaaggccttgctcggtggtcctgccgggcgggctctgggagtagagggaagggagttagttcagtgagtgggcccttcccatatcaccagtagaagcggaagcgcttgtctctgtggcgcaatcggttagcgcgttcggctgttaaccgaaagattggtggttcgagcccacccagggacgcttattggaacttttgaagcattcatgcattgtcaatcactaggtaaatggggaagattttatcttcccgaagtcccaagccactcatttatgactgatccatgtcaagggccgcccacctccccgaccagattcttaaccggctatctcctgaaatgccgggtttacacctgtgtaacttaggaatcctgaaacagagacctaggaacccacttctggtgtgataaaattctaattcagtcccttatacgcttaaacaagtaattcacgtgcctccattttttcatattttagtaataggagtccagtattacctccaggatgtgcctgggtttcctgattgctctatcaataatgtgaccagtggaatctttcatcatgatagtgatcctctccatcatttttgaaaacagtatttttcctcagtctgtgcatgatttatttaacccttttcaaaatgtttttgttagccaggcatggtggcacacacctgtaatcccagctactcaggaggctgaggcaggagaatcgtttgaacttgggaggtggaggctgcagtgagctgagattgcaccactacactccagcctgggtatcagagtgagactcccatctcaaaaaaaaaaaaatgtttttgagatgatgttggtttcatggttttaggattacaaagaatgctgcagtcaccattcttgtacagatatctttggtcattgtggaaatgtctacactgcagacatttctatagtgtagagagctggatgcgccattgctacattatagtgcttatataatgcttctaatttgagtccattctgcaaatgtgtctttcacgggagcagtaccaaataatattccaatatgaatatttataaaatgaaaatgtgcagatgtgcagttgagctgcatgcctctccatggggcccatgttcataaaatggtggcgttagcaatcatctgagagtggagtttgtggccctctgacgtcaaaatctgaggcaatggacatgaaaaccctcactgtacatcctccgtagtctggccagaatcattcctgggtcggtggtctcttatcaggagggaatgctgcttgctttttttgtcaaaaccacaaaagggagggaaagcatcaggctgttggttgataacagtagtgaagcaagtctctccaaaggcttggtttgttaacccttaggaaaaaaatcctaattcttgccagatggtgccatgcatttccaggctcttggtgtcccaaacaaagaactgtacatgacacacacaaagcagcaaagcaaagcaaaagtttattaagcatagtaacactctcagagtggggagagtggactgacctctgggatgtaagataagtattagtttggtgtactttgggtcgttttatgtgtgtttttttttcttctcttcacaaggatgcctaatcgttagccagtgtttgccttttgattgataggtgggttgcttagttactttggcccttgtgtgcttgcacattggctccatcccataattttaagtacatgcatgatgtgcagtccatatgcatgagttttaatgagctgattatcatacggagtcatgttaaggatactttttttctctcatgcacatgcctatctctgaggagctgcccctttactggtttggatctcgctggccatggggtccttgcttgcttttcttttttttttttttttttttttttgagacagagtctcgctctgttgcacagtctggagtgcagtgatgcaatctcggctcactgcaacctccgcctcccgggttcaagcgatgcacctgtctcagcctcccaagtagctgggagtacaggagtgcaccaccacgcccagctaattttttgtatttttagtagagatggggtttcaccatgttggccaggctggtctgaaactcctgacctcaggtgatctgcctgccttggcctcccaaagtgctgggattacaggcatgagccaccgtgcccggccttgcttgcttttttaaatcttactttttgttttggctgctcaacttctgccttttatcttgcttcttgctctcccaccccatcaccttgcttctgtttctgcttttactcgttctgccttttatccaacttccaattccctctgctgttctcctgcctcataatggcagttagtgagcgggggttttgaggtggcatgtccaacctcctagcctgccacatccagaaactgctttcaaggtttctctgtggtcctgtcagccaagagggagtccgcagttgactgtagggactagggcttattttcatttctcaatcctgacaaggtaaggctggattaacgcagattctctgcaggtgtaaatttcccctacagaagacagttttgcagagttccttctgtttgctggttctctgacagccatcttaaaatatgccaaagaaatacattctggggtaaaatattttgattctcttcatctatctacagcttcaccatgctggcagcctccaatccaagcatacctgaaaccttcttttttttttttttttttttttggtttgagacagagtctcgctctgtcacccaggctggagtgcagtggcattatctcggctcactgcaagcttcgcctcccaggttcacgccattctcctgcctcagcctctggagtagctggtactacaggtgcctgccaccgcaccagactaattgtttgtatattttttagtagagatggggtttcaccatgttagttagggtggtcttgatctcctgacctcgtgaccacccacctgggcctcccaaagtgagccaccacgcccggcccctgaaacctttctttttaaaaagctttcccacctttatgactgccttcaagtctctgccaaaacacaagtaacagtgactgactccctgctataccaagctcacagtaaatagcctttgctgtttttcatttggttggtctttgtttatttgcagaagcttcaatgtagagttgacaaggactccaatctttgaccaaaccttagtagtttcctctgagcccttttctctgttacttcttggcctgccaagtccagctttaggaaagaatcctgttgagtctagtttagcaagagtcctcgcaaccacctttgatagctaatcaagttcctcttagtaattttccatccactgactttcttatcttgccaattggctataatcctcaactcctcctgctgtatttgaggttgagcccagttctctgggctcaacctcaaatacacgtgtccagtgcagcccctcagaaactacctttgcaaaattatgacaatcagagaaagctgacatggctgactccatcttggttctagcctcacaggcttgctgtctttgctcattcctgtgcaatttctcccaagctatctttgggaaaaattgagtttatagtttaaatcagggctccccaatccccagggccataagacaggtactggtccatggcctgttaggaacccagctgaacagcaggaggtgagctgcaggctttcgagcattaccgcctgagctctgcctcttgtcagatcagcatgagcattagctgctcatcggagctcggaccctattgggaactgctcatgtgagtgatccagattgcgcactccttatgagactgtaactgatgccactgatgcctgatgacctgaggtggaacagtttcatctggaaaccatccaccacccccttccatggaaaaattgtcttccatgaaaccagtccctggtgacaaaaaggttggggacagccaaaaatctggtttaaatgataaccttccccaaaactaaattacccctgtaaaatgaatgaaaggccaccaagttagaaggatgaaagcggcctgatttctagtaagatgtatgcctccttaaataattaccagccattattccagaagtcacaagattggcagcttccccagttactgctgtgaagaacatcactattgtagaacctaagattggcctcttgagatgtcttttcaggctttggcatttctgactgctggatggcaccatttggcccgaaaatcaaccagtcccttagcccccacccagaagctgactccatgcaggagggccattttccatgcccctgtgatttcatccccaacgatcagcaccacgcaagccctagccccctccccaccaaactatctttgaaaaaccccttacctccaagccttcagtgagattgctttgagtaataactcttgtctcccacatgtcgtggctggcctgtgtcagtgaaactctttcctgcagtgccatggtctccatgaattgattttgtgtgtacattgggcaggaagaacccatcaggtagttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatatcttgccatgccttccagtggcctaactggccaccatgccacagaatctttatggtctccaaggagaactctctacttgatgttttgtgatttgagcaatggaatagaatctgatactggtgggctgggggaggtacccggacactggtgggatctcgaccccagccgtggtgtccaggctcttgacaccatcgcgagaacaaagtcaaagatgagtcagcagatagtgaaagaagagatttattgcaaagcaaaaagtacacactcaagaaaggggagttcaggcatacccaagagagaacaatggattctggggtttcatcttgatgggtttctttaaccaaggagtggaatgttcatgaaaattcctgggtaaaggtggagatttctcggaactgtggtgccatccatttttacatcaaatattggtctcagaactgtcatggcactggcgggtgtgtgatttagtatgttaatgagcatataatgagggcctaggtaaaacctccgtcaaatccagcaccacattgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacattgttaaacatctcaaataagatgtagcccaggtatttgtgtcaaatttggattattttgatttcgtctttgcagaatataaaaaactaacatgaggtaagcactaaggtgtggagatggctgtgcaagagatgacaaagtccagcaccacgcttgagagtgtccaatcatctcttctggggcagcatagttttctacaatactgattttggaaaaaaaatcaaaaaaaaaaaacctacaagattcatgaaactggacaactgtctttataacattaccagtgataaaaccagtaaggaaggctggtttgcagtcatctgagcagcctctttactttcataaacatggtttctctcggcttccaattgcaagtggaatgctgcatcacagggataaagatgtgaagagaaccggtttcttctgtaatccgaaacattctagtctgcgaattaaaagccattatttgaagaaggatgccccggctccatctggccaccgaaaggttgctccttaacacaggctaaggaccagcttttttgggagagaacagacgcaggggcgggagggaaaaagggagaggcagacgtcacttcctcttggcggctctggcagcagattggtcagttgagtggcagaaaagcagacggggactgggcaaggcactgtcggtgacatcacggacagggcgacttctatgtagatgaggcagcgcagaggctgctgcttcgccacttgctgcttcgccacgaaggagttcccctgccctgggagcgggttcaggaccgcggatcggaagagagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttctaaaagtagactgtacgctaagggtcatatctttttttgttttggtttgtgtcttggttggcgtcttaaatgttaatcctacagtggagggctggcgaataggaagtaacatgtcgcctgcacgccataggagaaaaagcgagcatcagccgtatcggctttgtaacacaaattagctatcgtgaagtccgctcagctcttccctttctaccctggctgctttttgcagggattggtccgtggtctccagtctcttgggttctcaccctgtgtgaaaatcttcctgtttttccctaccccccaagtcacctcttacacagcctctgcttccaagcgcagcccccacaggagtttgtaggatttctgtgctagcggggagtgtgttctcacctcatagagccaggtagaaactacgcagatgggtgctgttctccaggaagaaagcagggcctttggggctctcagtgtccccgttgggttgtagacataacacgcttactttgcgtaggggaacggctctgccggcccccaggtgccctcgcgcatattcatggaggcccgtaggtcagaaccgcagtctcacctgtcttggcggaaatgccctgcgatcctcccggagatagaaggcgggaagttttatgaggagccaggtacagtttccctactatctccggcagttcatatatctagtgtttcttcagactttatttaagcgacagcttcttgtttgatgtctcgctcccacatcctacatccattgccaggcaactttctagatagcacccagacccatccttcccacccccaagcagccgtttcctatttctggtgccagtgtcctccccagtccctctttcttcaggccctcgcttatcaccttcatggacagaaaatacttagctctctctcaacctgcggtttatacctgacacgcgtcagtaccctgacaaattccttaataccctttctcaaatggcactgaaaatgcatttctttttaactcccagaagtatctaattggttttgtccctgaactacatgaatactagtattccactacagaggaaaaccccaggcctagcgatggcggttctgggcattgtgccagcctctcccagggtatgttttctgacatcacctacttttgatcaactgaggtcaggagttcgagaccaccctgaccaacatggcgaaactccgtctctactaaaaataaaaataaaaataaattgccgggcatggtggtgtgggtctgtaatcccaactactcgggaggctgaggcaggagaatcgcttgaacccggcaggcggaggttacagtgagccgagatcgtgccattgcaccccagcctgggcaatagagtgagactctgtctcaaaaaaaaaaaaaaaaaaattagtccatctgagacattgttgttggagacagtagaatcctgcatccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctttctcattatttgcatcattattttttgccatcagtgtgggtttttggttttgaggctatgaagtgaatttctggggacaatctctgttgggtcgtgttgacaaggatccagtccctgtttggtgatacatgacagctaatctggtctgtgagtcttctttattgtctatttattgtcctgagaataatggtatttcctgaaatttgagactgcagcaatgataagttgttcagatcttgtctttccaatgtttggtaaaaattttataggcccaattgttgtcaatatctgcaagagtggcatctctattacaagagtgatcttactactcaatgtcccccctcccacccaacttcatttcctaggggctcttggctttaacgaatttactgtatctaaaagacatcttagtacaggaagaaaactaaatctgtagcatgtaaggagcagttttctttgattggtatattcaggtttctaaccagctgaaaaattcaaatacatgtcctttaaggattaagtttaaactacactacagaaagaagagaaaagatttatatgatcacatataagcaatggaatcagcaatatgagcacttttcacaactatataaatcaaatttagtaatctccagaacattaaggaagttcagcccttaatgaaaatgaatgaaaagaaattattcacccactgttacatgccctggaaagagaatgccctgcaggactcaaaagggtaccacaatattactcagattttcagcaatgaaggccctccaaggatctaatgatactcatattttcagtttatttccttcactgataaacattgttaatagataccattgcctctgttttcactttaagtgatgttacttagcacaattcatttctttagaatgccccctagtttagtgaaaggaattttcctgctttataaatataggatattttctcatgaaacaagttggcgtactctttcagtgaagggactagaccgattaggtctctaaaatgttaaaggagtcactgcctccattatcttaggaacaataataatcacttatataaaattaaaataagaaaattaagccaggaatggtggctcatatctacaatcccagcacttaaagagttggagaccagcctgggcaacatagtgaaactcctgtctctacaaatttttaagtattagctaattttttaaagttggcagggcatgataatgcatgactgtaatctcagctactagggagactgaggcaggctccagtgaactatgattgtgccactgccctccagcctgggtgacagagtgagactcccaactcaaaaaaaaaaaaagaaaagaaaatatagaatttgttgaaaattgttttactacaatgctaggctgcatgtcttgcacctgtactcccagcaactcaacaggctgaggcggaaggattgctttaggccagcggttggagaccagcctggggaacagggcaagacctcatctctaaaaaaacacaaggcaagctgagccaggaggattgcctgagcccagaagttccaagttggtcagctatgattgccctgctgcactctagcctggataacacagcaagaccctgtgtcttattttttattttatttttactacttatgcttatttatttatttatttttgagacagagtcttgctctgtagcccaggctagagtgcagtggtgccatctcagctcactgcaagctctgccttccaggttgaagctatttccctgcctcagcctccagagtagctgggattacaggcacacgccaccacatccagctaatttttatgtttttagtagagacagggtttcatcatgtttcccaggctagtctcaaactcctgacctcaagtgatgcacctgtctcggactccgaaagtgctgggattacaggtgtgagccacctcgcccaggctccttatgcttgaaatgtgaggtttcattagggaaaaattttcttgttgaatttctaacatgaaaaaataatagatttagctgtagattaaattaatggtcttgatagtttggtacaataaaataaatgaaatgaagttgatagcagagaggaatttttgatgcttttggacaatttaaataatgtaatatttaatatataaagacatgaaaaagttcattacattattatatttatttatttatttatttatttatttattttgagacatagtctcactctgttgcctaagctagagtgcagtggtacaatctcggctcactgcaacctctgcctcccgggttcaagcaattctcctgcctcagcctcgtgagtagctggaattacagacgtgcgccaccccacccagctaatttttgtatttttagtagacacagggtttcaccatgttggtcaggctggtctcgaactcctgacctcatgattcacctgctacggcttcccaaagtgctggggttacaggcgtgagccgctgcatctggtctattatgttattttttaaaagtcagtgtgactcttttgacaaattagaatggtttaataatcttggttaggctgggcatggtggctcacacctgtaatcccagcactttgggagcctgaggtcaggagttcgagaccagcctggcaaacaaggtgaaaccctgtctctactaaaaatacaaaaattagccgggtatggtggggggctcctgtaatcccagctactcagaaggctgagtcaggagaattgcttgaacccgggaggcagaggtttcactgagccaagatcgcgacattgcactccagcctgggggggcaacaaagtgagattcggtctcaaaaaataaataaataaataaaaataaagtataaaaaattaaaattatgtgttcaagtaaattaaatatatggcaatgaaaaggaggcccagcatgactgactgcattttgctcctaacccttcctaccctgtggtgatgtctttcaggctaactgctttttcttctttctgcacataggccaagctatctatgggagggatttagcttacagtttaactttaaagcacagatgataataatcctttccccaaactaactcctgagaagataggcaggttgttgaagatttataagagcagtgtgacctgacaaaggacaaagaattttcaccatccccttgggctctcactgcagcccatatgtctgtcattgtcagacctcttcacctcaaccgcctccttcttcctcccttccctaacgtacaaggaacctgaaaatcatattaatttaagatggttctttaggatgttagttcaccatctgttcagtttggtggctctctggaataaagtcaccttccctgcccctacaccttatccctggacttattggccgtcatgcagcaagcggtgagtgcagtaagccgagatcacaccactgcactccagtctgggtgacatagtgagaccttgtctcaaaaaaataaaaataaaaacagagaaatttggttttagaaccagacaaattaaatgggagattacttccagtgagacctagaaatttctaaatttctaaaatttctaaaaaaactgagaaaattgcctccattgaggaagtaagctgaaggaggtaaactgtcatgttttctgaattgagaaatattgaggaggctttgtctctttcacctccagctgctccttctcctcctgcccctgcacctgcatagtctttcttacctgagccttcctgtcctgccttgcttcttcttccatcaccaccacctggggaaagtccccagggctctggccacttccccaaaacttctgttctgacagcccctttaaaggtaaaacccaaacccacaggaagaggggagcctaccattgtgtataccacttcaccaaaacgtgaattaagaatattataaaggacttccctgatctaaacttaaatacatttcactcttctgtttctaaagcaggctccgagattctataggctctggcagaaaatttgacttaactgttgaaacctttgagcccaaatattctgacctttatcaatcaattcacatgctggtgaagaaggcaaggccactaactggttgcaaaggcaaattggaaggattttcaaaaagggactgaagcagaacatgaaaggttcacattttcaccaaatatctccatgttgccactccccaggtccttcctaaaaatatagattggaggataattcagcattgtactaaaaagccagacaaatctgtctttgcttaattaaaatggtttgagagccaggtgtggtagctcatgtctttaatcccagcactataggaggccaaggcgggcggatcactcgaggtcaggagttcgagaccagcctgccaacatggtgaaaccctgtctctactaaaaatacaaaaatcagccaggtggctactcaggaggctgaaggaaaagaatcgcttgaacccaggaggcagaggttgcagtgagctaagatcctgccagtgcaatacagcctgggtgacagagaaagactgtctcaaaaataaaaattaaaaaaaaaaagaaaaaatcagcagcgtagtagaagtataatgcacacaagaatgataatcatgaagacaatctgattctagaagagtaagggaacctattccattagagagccaactgaaaacatcaaatcccagttcacaccccagggtgtgggggcacgtgcctgtagtcccagctactcgggaggattagtaaggaggtttgcttgaatatgtgaggtcaaagcagaagtaaaccctgatcatgccactgcactccagcctgggtgacagtgagaccttgtctcaaaaacaaacaaacaaaaaacccacaaaaccaaacaacaacaaattgtcacctcactctgaaatgacagtggcaaacatcactttgctattggaaaattaaaagaaaaacactccctcttgctatcaacctgccctcttgctctaacatgtctgacccatggtttaaaatgcccaaaagctgatgtactcaaattataatacacttacctgttctgcaccagcatttatttttgtctggaggagatcaccatccatggtcctgtaaatgtctaacggcatggaatgatgaagggcagtgtcttttaggatatttggttatatctatatatatggctctgaagaaacccaacattgggcgagttccctcaaacttttcactaggcatgaccactgctctattttagatagagattctgtggggcaaaacctgagaattatctgcctggctatcaagaagatagctccttgcatttttttggggagaacacttgcttcaagggagtgtttcctcccaggattacaaatctttttgtaacctcaggaaacattgctgatgaaaaccaggcatggtggctctggcctgtaatcccagtgactcaggggctgagacaggagaatcacttaagccaaagagtttgaggctgcagtgagctatgatggcgccactgcactccagcctgagccacagagccagacactgtctctgaaagaaaaagaaaaagaaagaaaaacattgctgatgaaactgcggcctcttttgcagctctataaaaaggtatttagtcactggctaaggttgtactagataatcacatcactttaggtgatacatttagctgagcagggagatgtgtggtggcaaataccttttgttgcatatacatatacatttcccatgtagtagaaccttctctagaaaaaatcagaaaagaagccacttggctgcaagaaatcactaaagaagaaatggggtttgatgttttccctgatgttttcagttggctgaaacatcaaatcccagttccctggttcccttactgttccaggatacagattctctttgtgatgatcattcttgtatgcattatatttctactactcaaattattaatgttatgtatttctcattgttttacttcttttgagaaactaaattcatggtactctgaaaactagagatgattcaacaagtgacagcaactatagaattggccgagatatctctctctctctctctctctctttttttttttttttttccatgttgtgatgccacaccagttcagcttttggacgctgttaaaaagagaggtctccttccctcccctgacccccgtgtgggacaggactatctgggaatgagccattctggcaaggagggacacagcttttgatcgacaatgctttcaagaaatactttttttttttttaaacggagtctcgctctgtcgcccaggctggagtgcagtgggcgatctcagctcactgcaagctccgcctcccgggttcacgccattctcctgcctcagcctctgcgagtagctgagactacaggcgcccgccaccacgccaggctaattttttttttttatttttagtagagacggggtttcaccgtggtctcgatctcctgacctcgtgatcggcccgcctcagcctcccaaagtgctgggcttacaagcgtcagccaccgcgcccggccaagaaagacttttcatctaaagggagaatggggaaagaagagaacttttttattttcaaattctcaggcccagcgaggcattacattgagacagcaaccacattctgcttcctttttgtacactactgtatttgaaaaacaaaaaaacaaacctacaagactcataaaactggacaactttctttataacactactactcgtaaaaccagtaaggatggctggtttgcagttatctgagcagcttctctagtttcatagacatgatttctctctgttattaaagggctcccaattttaagtggaatgctacttcacaaagataaccaggtttgaaagggtccggtttgctttgtaatccgaaacgttccagtctgctattaaaagccattatttgaagacgggtgcacaggcttccagctgcccgccagaagggtcctccgcaggacacaggttaagtaatcacttcttcgggggagactagatgcagggtctcggcgcacctccccaaaagacaagggcgagacagaaaggagggacaggcggacgtcacttcccccgccggctgcggcaccgggttggtgggctgagtggaggagggtggggcggaagaacagaaggggactgggaaaggcactgttggtgacatcaccgatagggcgtttctatgtagatgaggcagcgcaggggctgctgcttcgccatgaaggatttcccgtgctgtaggagcaagtccgggaccgctggctggacgtgagcgtcctagctgtgcgttagggctaggagggctcagggtgattggggattggctggggtggtgctcggggcaagtgaccgtgcgtgtaaagggtgaggcgtatggagctgtggcggggcggaagttcacatgtgtggtatgtagagcacatgttatggttatcaaagtggtttactgtaaggctgagggctatgcattctatggctatgttgttgtctcttatttttccaaacgtggaaacctctgttttgtaacttgtagtaataaggtagaaattaaaaagaaaaagtattttcctgtacttgcttggctgcaaggtcaggaacagatagtttctgaaaaaccacatcgctgagaaatgagttctggagactctcttaacagtctgttatccctaggaaggataagagcaagaaacagcaaatgcttttattaccttctcttttccctttaccatttctcactattcaagttttgttaagttcttgatttcccttcagtgcagctgcaaggtcaccagctattcttgcctcgtgagacctgtcacagtttgactagctgcctttgttctgcttctgtaagccctcttgcctgccccgcgagtttggtgccatcatagtcccaccatgccattcaaactagccaaccccctttttgaagtgtgtataaaagtcaaaccctgtctttgttcggggctcagcctttggattttaatcctctgggcctgagggcactcaataaaatcctcctgttccacccattggtctctctgttctcctgattcccacaacagtagtaggggactgtgtctgcactttcccctggtctttcacggtatgaataatagccttttttttttcgcctatagtcgcaggctcggtctcagtgattttatggtgtggtcagctgtttttgtttttgtgagaccttgtttactgtcctgggacagatgtctgtagtcacttgtttccttgggaggcaaatttcagtctctgtggcagaggtctctcatgttagctgtggtggtacttggcaggcggagctcagggatctaggcttccctgctttgtagactgctcaatggtccccaaggcctactggcttttaccaccacttgaaaaccttagtgtttttccactgtccccagagtcacctcttacacagacttattttgtttgtctttttccccgagacagagtctcactctatctggtagcatcttggtttaagcgatcctcccacctcagcctctggagtagcagaggcacgagtcaccacagccagctaatttctgttcttggttttgttgtggtggtggttgttttgttttttaagagttgaagtttcaccatgttgcccaggttggtctccaactcctggactcaaataatccgccctgccttggccttctaaagtcctgggattacaggtgtgatccatcacacctggccagcccctgcttttcactatagcattcatgggagtttgcaggatttctgtgctggggggaacgtgtactcagctcatacagccaagtagaaattgtacttggaactggtgccgttgggttgtagacataacatgcttgctgtttgtatgggaagggctttgccagtgctctgtgcccctgtgcagggcatccaggcctgcaggtcagaacggcagtctcacctatgagtttgtgtaatacgcagcaattctccctggaatataagatgggtggtcttgtgaggttcctacaagtaagaagacaaatttcccttcagtttgtattgacaaaattcaaaattaataataacagcccaacctcttgaatgataaatgtcctttacattgacagaccagaactgccctgcttgcctcagctcctctgtgcaggtgcagctcacaattccccccacacaggtcatttcctccctgctttctccaaaagagggagacagcagttctgcaggaccacagggctcaaggccttccagggccaaaaatctcagaagaagttgcccgttctgcctgtacctcacgactgacctagaaatggcctttgctaggagcaaagtagggggaaatggtcgccagagctggggcctgggtactgggccaggttaccccacaggaggggaagtactcagggttagagggggccaagcaccaagacctcagcatcctcaacctccaaaaggactcagagagatgcagaaaccgagacagggttcctctttcaaggaaagagacttttgaggaagaccccagggctctgaaccaaaatccagatttttccccatctgcagcttaattccaccttagttggtgcaacttcatccttcccctatgctcaggacaaaaaacagttcttctataggctggtcattctctggccccatacatcctattggtcagaaaattatgttttttctttggttaactgcagactttggtctgcacagtctttttctttcttggtctgaaaaccacccagtagtcccatatgtagcttttttggataaacctagaaattgaccctgctggtcttaaagcttgaaacttaatatttgtttcgtctgagttccttcctcaggaaacaaccttcaggcctctcaaaaaagccatcaaagaactgaaattcatccagacaatgagatgctgggacccctcattcatcatgattgcttccttgctcctccctagttcctgttttcttacacattgttacatttcttccctgccatataaacctctggttttgttggtcagggagatggatttgagactgagttctcatctcccccactgcagcaccctattaaagcgccttccttggcaataatcatctcggtgattggctttctctgtggcaaccagcaggaatcccagatctctgaattttggcaaaggagtctcctgataaaggtgggatggattctactgaccaacatcaaaacgatcagacatttgaaagccttaatctcagggtcggggtttgggccgcccttgggccttttccttgggcctaaccattaaaatcagcctagccaggtctgtcttccaggcacaggggtagggccagatactcctgatgctttttgacgcttctcccactgggtgggcaacaaccctccccttccctgtgacctgcagagaagcttcagggggcgtttattcaatttgctaggagcctacaaagcacaggtacacggtgactctgtggttcccactgcacctgccactctccttggtcccctcactgtctctggcaggcagtaatgttctgggtgagcttgggtgctgaagacacccaggcagggagggtagggaaaggcaccagccccttaggtcctgcgcattagggatccaaaaaacatctgaagaaacagaaagggagcgttggaagtagatcaaagggaaagaaagaaatcctaggagatttcctatctgaaggcaccatgaagagaaagtccgcctcctctgggccgcgtcctcctgttgcaggtgaaccgagttccggtctccattggaaaccaaagcaggtaactttgccctgactcctagttaggaagccatgctttgtcctcccctgtttagcacttgatcctgtagcacttgattgtctctccctggctttctatggattccagagatgcaactgagaagtttgtttttaatgcacttttccttaaagtaagagtatttcaggccgggcacggtggcttacacctgtaatcccaacactttgggaggcagaggtgggcattttacttgaggtcaggagttcgagaccagcctggccaacatggcgaaactctgtctctacgaaaaatacaaaaattagccaggtatgttggcaccggcctgtagtcccagctactcgagaggctgaggcaagagaaacctgtgaacatgggaaggggaagttgcagtgaactgatatcaaaaaaaaaaaaagtatcttttggcaaaggaaatgatttctgacaggttttgcacttaagacactcaggtgtgaggaaaacatgaaaaccactatgctagggaaagcaaatgctgttgagaatgtctcataaacacaaattacatgtcagcaggtaggtttgaccctcaggttgggcacattttactttaagttcactgtcggtggaacttaagatgaatctaagacattcacgatgtatgtatgtatgtgtgtgggtgtgtatacatatacatatatgtatacatatatatacacacacacatatatatatatacacacatatatatatgtctctcatatatatatgagagacagagtcttgcaatcttgcccatattggtctccaactctgggcctcaagcgatcctcctatctccccatcccaaagtgctgggactataggcatgcaccacctcgtccagcccattttaatgtttttaatttaaatacacattcccaaaattatataacaagtacaggaagcccactttcagccagttttacaaaaacaaagtggcaacatcctaaagtactgaaagaaataaagttttcctagaattctatgtcaaagtgaaaaatctttcaagaatatgactgaaataaggacatttaaaaacatataaaaaatgaaagaattcagcaacccacactacaagaaatgcaaaaggagtcctccaggcctaaagataaggataccagacagaaatctggatctacacaaagaaatggagactactgcaaatcggtatgtacatagttaaatatatatgttcttattatttaaatcttttttaataatttatttattttaaattatttatgatttaagtctttttttaataattaaaaaaagcaataataatggattctgggatttataacatgtctgaaatcaagttacatgacaacactagcataatggccagaagaggaggtataatgccactagatggcactgataaaggtgtattcaggaaaccctgaagccctcactgaaaaggcaaaagcagggaaagaagtcggggagcggtagaccagaagaaagaaagagttatagctaataagccaacaaaggaaagaaaatggaatgatataaaaaccatgtaatcattatgctggaacaactgctcttcatgcactccagcctgggcgacagtgaaaccctgtctcaaaaaaaaagcccacccctagggctgggcatggtggctcacgcctgtagtcctaccacttggggaggccaaggcaggttgatcacctgaggtcaggagttcaagaccagcctggccaacatggtgaaaccccgtctctactaaaaatacaaaacaattagccaggcatggtggtgggtgcctgtaatcccaggtactcaggaggctgacgtaggagaattgctagaaccctaggaggggaggttgcagtgagccgaggtcatgccactgcactccagcctgggcaacagagcgagactcatctcaaaaaaaaaaatcgtacacttaaaaggtcacggaggcaagcaaaaatcacctggtggctgcaaagcagaccatcgagaggcaaaactctttatctggggaatttagaggcaattagacttccttattatttaaagcaagaatctagttccaggcttctttcccaaaaatttataactaactagaatttctggggttttttttttgttgttgtttgtttgtttgtttgagacggagtctcactctgttgcccaggctggagtgcagtggcgcaatctcggctcactgctacctccgtctcccgggttcaagcaattctctgcctcagcctcccgagtagctggaattacaggtgcccgccaccacacccggctaatttttgtatttttagtagaaacggcgtttcaccatcttggccaggctggtcctgaactcctgacctcgtgatccacccgactcgccctcccaaagtgctgggattacaggcgtgagccaccgtgcccggccagtaactagaatttctatacatctctggaatacgtgcttatcaaaacttgtgcaacccttgctgacattaaggcaccaaaatgtctacaaatgtagtattctgtgagccaccgcacccggcctacaaaatgtttttttaaaaaattattgtgttgggagtgaattattgggctggtggctcatgcctgtaatcccagcacttcaggaggccgagatgggtggatcacttgaagtcaggagttccagaccagcctggccaacatggtgaaaccccatctctactaaaaatacaaaaattagctaggcgtggtggcgggcacctgtaatcccagctacttgggaggctgaggcaagagaattgcttgaacccaggaggcagaggttgcagtgagccgagatcgtgccattgtactccagcctgggtgacaagagccaaaaaaaaaaaaaaaaaagaaagaaatcattattatttctacaatatgggcttatccctgtattactcttctgaacttttcacttaatatatcgtaaccatctctccagtcattgaatgttcttctataacatttggaatgatatcatagtatcccattatatgaataacccatggtttattatacaagtcccctactgctgaacgtttaggtctttctaactttttgctattaaagtctggcatgatagactctgcaagttagccttcagatgcccagcaaatccagttaaccagagcactgtcctctaagcctcctggtgaatgtggttttgctgatggtgggcagagtccaccccagccgagccgctggatttggcaggcacttggccttagcaacctgagggtggtaactccaatcagttacttgtttccctgttacctgagttgcagatttagagccctctgcagtgagcaggtgagcacctggcatgattcttttctggtgagtggtcctgggggtcactgggccagtcaccacctggtgacaggacagggtgaccggtgggtggcagcactggggattcaaatgaccgcagcccggtcaggctgagctgagcagagccaaggactcagcacagcaaggaacctaggctcttcacagagaagggagctggaggaccccccaaggagatgagtatgtgccaccctgcggcagggtcctgtgggctttgggagtgagagggtcaaggggagaggagctgtgtttgccaccccctgttaaaaacctcaagtgaagcagcatggtagagaggaaagagcatgggattggaagccattgaacttcctgctgtgtgtccttgggcaagtgactacatgtctctgatcctcaatctccccttctataaaatggagatgatcctagaacctgcttcacgggagtgttcagaggggactgtagacagagcgggaacatagaagaggaagtaggcggcagtgtggttcacagccagcgcaggctgcctgcagggtgcaggtactgtcaccaagggagacccaaggtgccctggagggagtggcaaggacacaggcctgagcccagccctggtgatatgaacactggagtgggcttcacagggacaggcagcatcagaactggactagtgaggtcatgagcccaccagggcctgggtagggacatagcaagtctggggactccagacagggtcacacagacctgggccatgctgggcatccagggactggctgtgcatactggcagatgtcagtcagccctcctgcagttgggccagggacacctcagggaaactgtgaccttccttccaatcttggtaacatcacccttccaccccaaatcccagggaatggcccgaatctctcctgacaaacagctctcagccctggtccaggccacagtcttgcttgcaccgggccgggtttcagagcccgaagggcacactggcagcctttagtgcagtgtttcagatgtcacagacaggttcctctttgacgaagatggaacttccactgcttccctcctaccacgcaggaaacacagaagcaaccatcagccgagggcctgctggccgttctctctgggtactgtgtttggaaaaagcacaaaatcattaacttaaacatgctttttcaaaccaaacacatccctctcttagccctggagattcagagctgcctctccctttgaaaatgaatgatctcgcccgggtgcagtggctcacgcctgtactcccagtactttgggaagctgaggcgggtggatcgcgaggtcagcagtttgagaccagcctggccaatatggtgaaaccccgtctctactgaaaatacaaaaattagccgagcgtggcggcgggcgcctgtagtccaagctactcaggaggctggggcagaggttgcgtttagccaagatcatgccactgcactccagcctgggcaatagagcaagactccctcaaaaaaaaaaaaaagcatgatttcatccaatgccttcaataacagaaggaggtccaagtccagtgagagggtggaacgaacatactgtcacagtggaaaggacacgagacaggcgcgccaccgggttgagtctcgcgaacaaactgaggccagagtgccttccccagggctgcacgtcagtcaggaaaaaaaaaagcattctctccgacaggtcaaatcaccgaagcctcgggatcgtcgctgggggctgtgacggggctggcatgaaacgtccctctgtctggctgggcgatgggtcagtgctcaggagtttcaggcctttaaggcccggccagaccgcagggggactctgcagccgggtcggggtttcgatcctgcgctgcggccttgcaactgcgaggacttgggggtcgtgcttcgttcgcctggtatcctcgttcgtgcgtgtaggaggcgcctggcttgccgggcggtgccaggcggcaagagggagggcgcacggagcgtgtccgcccagggcggcccctgtaagcgctgcagaagcgctgctcccggcgcccggccccgccccagcctccgccccactaccgcgcagcgcaggctccgcccccagttttccccgccccgtggcggggacgccccgcccggtccggcccgctcggcctcggcagcagcggctgcggcgaaggcgcgcgaaggtaggtggccgggggcgcgcgcgtgcgcgggggcgggacggacgcgctcccggcggaggaggccgcgcgcctgggggcgggctggagccacgtaccggggctgggggcgctgtgtgttccgcgactgccgcggcccggcaccggaggccaggagagcgttcccaacaggctccgcggatgccccgccgcgtcctgccgcccatcctgcccggattgtcgcgggccgggggcacgacaggagactggggcctgcagggcgcagccgtccctccgccggccggggtcccctcgctccgcgggcggccgtgggaggccctcgcgacggcctctgccccccgcagatgccctctgcagctcctgcgtgcgggccccgccctgcactgccctcctcgtgtgggatccggtttcgtcttcattgcagccctgccgagtcggaagcatctccattgtgcggatggggaaactgaggcccagagcgcatagttgggctggccacggaggcagggccgccggatgctgtgcggggatggggccctgcaccccttgcgcctctcaccatgcggcctcaggcctctgtgcccggcagcgtctctggagtgggcattttgaacgagctccctcctgattttcacacagacttaagcctgacgaccatgctggggcggatgtctgcccctctggtgaccaggtcacagctcccttgggaagacgattgactggggaatggggaccctggggaggaggacttcagggtgccatctgtctgtttacgccagaaaacagagatttctgttttctttcgctgggctcacagcaggtgcttaataaacagatcttgtggcgggagcagacgacagcgaggttcaggcaagactccaggagtcaacccctggatctcggaggctccccacccgcgcacatttccctgacttaaccctcccctccccaagtctttcagccctttccacccaagtggcccctgtgggggtcactgcctggttttcaccctgatcttctgggatgcggcagatgctggctggatatgtgttcgctggtgtccttccgtgatccccgtctgtggctgacaccatctgtggcccaacatgaccccagccagagccaaggggaatcatttctttttccatttaacatcctatgttattacttggctcttagcattcattaattcattcagcagctcttcatggagctttggccttagcccatgcactgtggaagtgacagtgagctaagccaacctggcactttgggaggctgaggtgggaggaccgcttgagcccaggagttggagactagcctgggcaacatctcatctctacaacaagtaaaaaattagccagacgtggtggcacgcacctgtggtcccagctactcaggaggctgaggtgggaggatcccttaagcccaggaggtcaacgctgcagtgagccatgattttgccactgcactccagcctggaaaacagagcaagaccttgtctcaaagaaaaaaaaaaaaaaggaggagacagacaacatacatgttggagaaaatggaacagccactggagggacctctttagctgagagtcggggtagctccctcagaaagtgatatttttgagccaaaatctggccgacaagcgggagtcagctgtgcaaaagaagggggaagtgcgtcccaggcagagaaagtggcagtgcaaaggcccagaggtgggtgcctgcctggtgtttgaggaatcaagaaggccatgagcagccaggtgtggtggctcatgcctgtaattccagcactttgggaggctaaggtgggtggatcacttgaggtcaggagtttaagaccagcctggccaatacagtgaaacctcatctctactaatacaaaaattagctgggcgtggtggtgcatgcctgtaatcccagctactcgggaggctgaggtaggagaattgcttgaacccaggaggtggaggttgcagtgagctgagattgtgcaccactgcactccagctcaggcctgggcaacagatcaagactctgcctcaaaaaaaaaggccatgagagaaggggagagaggagatgaggtgggaaaagtggagtggggccagatctggtgggccctgtgggccatggaaggactttgaacttcattttaggtgtggtaagggctagtagagggccttgggtaggggaggggtatgacctttactgtgtgaaacttgagtgggtgaggggatgagcagggaagcatagagaccctcggggagccatctcagcagtccaggcagtggcttatataatacacatcggcgtcctggggtggtgccaggtacacagcaggcgctgcaggatggaagtcattgctgttactgtttttgtttatttgagacagggtcttgctctgtcacccaggctagagtgcagtgacacaaccacggctcattgcagcctcaaccttccaggctcaagcaatcctcctgcctcagcctctcaaggaactgggactacaggaggtgcatgccaccatgccaggccaattttttttatttttttggcagagatggagtctcactgtgttgccagggctggtctcaaacgcctgggctcaggcagtcctcctaccttggcctcccaaagtgttgggatcacaggtgtgagtcagtgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaataagctgggcgcggtggcgcatacctgtaatcccagctactcaggaggctgaggcaggagaattgcttgagcccaggaggcggaggttgcagtcagccgagatcgtgccattgcactccagactgggtgacagagccagactccatctcaaaaacaaaacaaaacaaaaaacaaaaaccctttggaatcaggcacacctaggtcgcggctgtgacttgagctctttgtggctgggtgcattggagccaattatttaacttcgctgagacttcacgctgtcatctgtaaagtgagtagggtggtgccaggagtgttaaagcaggtaagggacagatgtaacgttttgggcacagggcctggctcgtggttggttcaatatttttgtcataatttctagtcagcagcaggaggataacgaaggggtaagcggataagagcagctgctatgtttgaaacgagtaatctttgaggggctttttggctagttcctgccgctagccctggcaaaaggcaagtttggagggtggtagtggggagggaagggtacaaagggtgtctcctctgtatttggtcaccaaataatgtctcagcatctagaacaaggcacagggttctagcttggggactagaaagagccaataatactcatgatagtaatgataacagtagtaatagccaacacttacccgctgttgaactgcaggtagtaattaaggtaacactagctaatgtgatagtgaaaccctgaattctcagaggcttagcgcaatagaagtttatttctcattcatgaaaagccctgttgggtgtttggcaggtggctttctatgtggcgacccagggaccgagatcccttctgtcttgtggttgcggcatcccctaggaccttggagttatttccttctagctgatggaccaggaaggagagaaataattttatggaccaagcctaaagtggcacgctgtctttctgtcttaattctatggaccagaacttgaccacatggccgtatctgactgcaagggagtctgggaaatggcttttagccatattcctaagaggaatcggaaatgctttgtggtgagcacattgcagtttctgccacaccatatccaggcatatagcttagcacggagtattttatttaatgctcatgctagaaacaggcaccattattatcccattttgcagatgaggaaactgaagctcagagaagtgaagacactggtgcagggtcacacagctggtgaggggctggtgagccaagattggagtccaggtggccagatgctgaagctgttagcatccagatttctaagaggaattcagtctttttttttttttttttttttttggagaattgggtggaagcagtggacacatacacgaggttcagatatgacttcctgggacccacagaacccagcaggactctgggggagaactttggggatggagccaagggtgaatgtcacctggtgccaggggctgacatcctgtccccttcctccaacccttagggccgtggtcaggagaaggcacagaataatccagttcagtccctcaaggacatctggggccccctctgctgagctgggcatgcagggctggacatgctggtccaggggtatttttggcttcccccctgttctggtgggcaggtgtgcagcctgtagaggggattttttggaggctgcctagaggtagaagagtgggcgtccctggggtttgtagtggcagctctatctgctggccggtttagttttttgtttttgttttttttttgagacagagtctctctctgtcacccaggctggagtacagtggtgcgatctcagctcactgcaacctctgcctcccagtttcaagtgattcttgtgcctcagcctcccgagtagctgggactacaggcacccaccaccatgcccagctaatttctgtatttttagtagagacggggtttcaccacgttggccaggctggtctagaattcctgacctcaagtgatcgacctgcctcggcatcccagtgttgggattacaggcatgagccactgcacctggccagtagctggtttagttttgcccaaatctggcttgcttgccattgcaacttggcaacatttatcttttcagacctgtttcttggttttccatttgcagggcagtttccttagttgggcgtgagcggtccagcctggactgatgagcatttatacagcaccgtggcattctgggtctgacctggatacagaagtagagcctcaaagcgcaaatgcctcggccttgcccttcagtcactcattgggaggctgctggtctaagtggaatgagctttgggctcaccacttccctgaagcatgtcgccttgaataggtgagagcccaatgtctctgagcctcagttttctcatctggaaataggttgaagtaaggatttaatgagataatgtgaatatgccccctttggggcacagcatggagcagagggcacccagggacggagggctgaggcatagcagtgtagcaggacaagccgcaggcaaaactcttcagtcaccaggttaaagaaggaaggaactttattcggctgggaacttcaggagacttgtgtcttaaaagccgagctcctcgagtgagcaattcctgtccttttttagggcttacaactctaagggcaggagcccagacacgtgatgctaatgacaataggaacagtggcccccattggctaatagctcaccacctgccaggtgtggtaggtactatcagtcgcatttttttgttgtttttggtaggacagagtctcgctatgttgcccaggctggtctcaaactcctgggctcaagcgattctcccattttggcctcccaaagtgctgggattatagacctgaatcaccacactcggtctagtctcattttattttattttatttttttgagacagactcttgccctgtcacccaggctggagtgctgtggcacaatctcggctcactgcaacctcctcctcctgggttcaagtgattcccctgcctcagcctcctgagtagctaggattatatgcacatgccaccacgccccagctaattttttttatatttatttatttatttatttatatttttgagacggagtcttactgtgtcgccaggctggagtgcagtggcatgatctcgcctcactgcaacctctgcctcccaggttcaagcgattctcctgactcagcctcccaggtagctgggactacaggtgtgcaccaccatgcctagctaatttttgtatttttaatagagacggggtttcaccatgtaggccaggatggtcttaatctcttgacctcctgatccgcctgcctcagcatcccaaagtgctgggattacaggccaattcttgtatttttagtagagatggggtttcactatgttggccaggctggtctcaaactcctgacctcaagtgatctgcccgcctcagcctcccaaagtgctggaattagaggcttgagccactgcacctggcctggtttagtctccttttagagatgagaaaactgaggctcagggaggtaacctgttcaaggtcttactgtcttgaacaccatagttgcaagtgacagagctgagtctcacatgcaacctcagacctgatactgactccagagctgtgcgcctaagcactagagcacatagcctccttgccccagggaaagaacaatgggaggtggtgggtgacctctgggtctcagggccctgggatatagggactgtgccttttttttttttttttttgagacaaagttccactcttgttgcccaggctggagtgcaatggcgcgatcttggctcactgcaacctctgcctcctgagttcaatcgattctcctgcctcagcctcccaagtagctgggattacaggtgtgcaccaccacacccggctaatttttgtatttttggtagagacggggtttcaccatattggtcaggctgatcttgaactcctgacctcaggtgatccacccgctttgtcctcccaaaatgccgagattacaggcatgagtgcctgcgcctggctgggactgtaccttctggattttcaaatgaatgaaatgagtatttcttgagtgttggccacgtgaccccccagcaccatgtcatgtgctgggtatgcacacacgatactgtttcatccccggacggctccgagagatgagtaccaatattatcacatcttacgtaagaggacactgagtctcagagaggcaaagtcagtgtccctggtgcacccagctagtgggggctggggtgggtgtgaaggggccagaagcttcccaataagtgcctgaagggcaaggctagggcatttgtagttcgaggctctaccactgtgtctaggtcagacctaggaatgccgcaggtgttgcataaatgctcatcagtccaggctggaccgctcatgcccaactaagtgccaagcctggcctgggtgatctcacagcctgcattctttgccctacacctgttgtgggaaaacatactcccagcatgctgtaaatcctctcattcttagctaaccatgtgactcccgttctgggccagaaagatggtcacaaatacttaggactctggcctttcccgccgcatggctactgaccccaccccctgggcttggagggctctaggacccagcaacctgcgcagggtgaagagtgtgtgaggtcctgacctccaggtgtctcccctgtttcctcctcccattccctcttctctctcctccctccttttctctcccttctcctcccctctcttcatccttcctcttcctttggctccctgcctctgcttccctcctctcctgtcctttcccatcccctccctcctcagcccacatcctgctcctcccaccgcggtggtcacatgggggcgccgccggatttaagcttaatctgcctggtgctcagcacagcatcctggctgtggcgcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtgggtagagatgtccttgctttgtctgtggctcatagaacatctctcagcatatggggtcaatgcaggcctggagggcaccttccctaccgctaacctggcctggacccaagacccgagatgagcgtgggtgagagcagctgccctcctgttggcttcctgtggctggcgtggccctgcacgggtgggcttttgaatgccctgcctgggctgtagcaggccaggtcctgaggatgcagatggtgagtgcagggctagcatcagagtaagctgggctggggtgttgtcgctgccaggtgcccttgacccactgtgtgctctcccactgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtggaggaagggcagcagcaacagaggctttcctgcagtgaggatggaggggacctttttttttttaagatggagtcttgggccggatgctgtggctcacacctgtaatcccagcactttgggaggccgaggcgggtggattacgaggtcaggagttcgagaccagcctggccaacatagtgaaaccccatctctactaaaaatacaaaaaattagccaggtgtggtggcgtgcacctgtagtcccagctacttgggagactgaggcaggagaatcatttgaacccgggaggtgtaggttgcagtgatccgagatcgagccattgcactccagcccaggagacagtgcaagactctgtctcaaaaaaataaataaataaaataaaataaaaaataaataaataaagatggagtcttgctctgtcgcccaggctggagtgcagtggcacgatctcggctcactgcaacctccgcctcccaggttcaagtgattctcctgcgtcagcctcttgagtaactgggattacaggtgcatgacaccacgcccagctaatttttgtatttttagtagagacggggtttcatcacgttagccaggctggtcttgaacccctgacttcaagtgatctacccgccttgacctccaaaagtgctgggatcacaggcatgagccactgcacccagccagaagggggcattaatatgcaggcgccgtatagggcaacacctgtgtgcacctcttacaaatcttaatgctgtgtatatgagggggttccttcgtgtcctccgggaatgtttgaggttgcctgtatgtgttatgtgtgtgcatatctttaaggtcagatatgcatagacagattgacacctctgttttgaatgtattcccatgagctcatcccattaattcactatcgcaacaaatatttactgagcgtgagccatgccattccacagccaccattctagtactaagatacaatgaggaacaaaaaatccaggctttcctgagctcacattggggtcggggcatggtgggaagacacaggcatcaatgtaataaacagaaaccacgacagggctaagtgttctggaggagaggcacatggtgtactgaggcccctgaggttgacccaggtgcacctttgagctttgcctgcgtggtttgggtttgtgggctcacctgcatgtgtccatgcatgccccgtctgcgtgcccgtgcatggctgcatcaccccatacacacgtgcactgcccctgggcttgcccacatgtgctgctccccagggcgccaggctatcagcctacaaggcattgtgggtctgggcccagcctgccacgccctacagaagcctgagcctgccttcccaggaggcccaggactctcacccagggcccttccctgcagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaaggtcaggaccacccactcctgctcctgtcctcccacctgttcactttgccccgccccaacccctggggctcaccatcagctccccatccccagattctccagtacaagaagaggtgctcggagctggagcagcagctgctggagagatccggagagctggagcagcagcggctgagggtgggtgccagtgtggggcaggggcaggccctgccctccacctgcccaacctgatgctttaacctctctcccacccaggacacagagcacagccaagacctggaaagcgccctcatccggctggaggaggagcagcagaggtgagggcgcagcagggagggccagggctggcaggatggccccctgcgcgagcgcctactgatcccctgtgccccattcaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggaggtgggcatgggggtgcagggaggccagcctgacccaagaggaaggggcactgcagaggagggaggactcagaagcctggagagggagagggagcactgtccaagggagcctgttagcagaagtaaatagccgtcatcacaatagctggtctttatcagtgtgtagcatgtaccacgtgcacggtgtgcgttgacctttattcctcatgataactgcatgtggtaggtgctatcattctcctcattttaaagagaggttaaggccggtcgcagtggctcacgcctgtaatcccagcactttgggaggctgagagatcgtgccactgcactccatcctgggcaacaaagcaagactctgtctccaaataagtaaataaataaagagagtttaagtaacctgcccacagtcatgcaactggcagctgggatgcaaagctaggtcccttgcatttttgcccttcgttgctgcctcttgcagccaaaagaggacttgaaacccaggtccctgtgcaggagggagccatgaggcttgggaggctgagcatggccgctgcaacacagctctgtgcacagacccacaggaagacccaatccctgaacgacggtgcctcccaggatggtcggagatgagggaagcagtgggagggagtaaacccgctctcacaccaacccttccctcggcatgtcttccctccagtccttcaacgcctacttcagcaacgagcacagtcgcctgctcctcctctggaggcaggtggtggggttccggcggctggtcagcgaggtgaagatgttcactgagaggtgaggcctggccggggacggggcagcagctgagagccagccctgctctttatgtccaactgaactcagttgaatttcagttcaactcaacgcacttactgtgcacaagggccggtgaggacacagaggcaacttgtaataaccattaccacagtcgtggcagtcagcatttattagatgtttactctgggctaggctcattgtatatttcatttcaactaatattcatagcttccctgtgaggtaggaactgtgttcattcacatattacagatgaggacattgtggcgcagagaggttgagtgatcttcctgaggtcacacagtagtacataagtggctgagtcagagtttgaagttcctgattttttttttttctcagacggagtcttgctctgtcaccaggctggagtgaggtggcacgatcttggatcactgcaaccttcacctcctgggttcaagcaattctcctgcctcagcctcctgagttgctgggataacaggcacatgccgccacacccagctaattttttttttttttttgtattttagtagagacggggtttcaccatgttgcccaggatggtctcgaactcctgagctcaagcaatcagccagcctcagcctcccaaagtgctgggattataggcatgagccacagcgccaggccgaagttcctgattttaatccactagaatattcagctttgctaccaaggacctcacagcctcttgtgatgaaaagatgtagatccccaaaattctaggctgggcacggtggctcacgcctgtaatcccagcacttgaggaggccgaggcgggtggatcacctgaggttaggagttcaagaccagcctcaacatggagaaaccctgtctctactaaaaatacaaaattagccgggcatagtggtgcatgcctgtaatcccagctactcgggaggctgaggcaggagaattgcttgaacctgggaggcagaggttgcggtgagccgagatctcgccattgtactccggcctgggcaacaagagcagaactccatccaaaaaaagtaaaataaaattctagactgaggaagcgagtggtcagtgatatgtacgtggaacagagggaatgtcctcgaggctcagaaggatgggaggggtggggaggtcagaaaaaccactttgtggagatggaatttgcacagagcctcaagggatgggtagggttgaagcagagcagcaggcgctccaagcaggagcaaggcatgagcaaaggcatggaggtgggagcccatggcagccaggggggttgcaatgaagagctggtacagggaaaggagagcctgcctcagcgggggagcttgggcctgcctgatccgtgtgagcagtcagctcaacagtagtgtcagggaggctgcggagagagccccaaggcaggaggccaaggtatttcatttagtgcgttaaaaacattttagttagtaatcttttcttttctttatggctcactacagcctcagcctcctcgtctcaagcaatcctcctacctcagatcctgtgcagctgggactacaggtgcatgccaccaggcttgctgatttttttatttcttgtagagtcgaggtctcactttgttgcccaggctggtcttgaactcctgagcccaagtgatcctcctgccttgacctcccaaaatgctgggattacaggcatgagcaaccacacctggtttaataatcttttgttaatatcatcaaatagccagtgtctaaattttccatatgtctcataaatgtcacagatagaccaggtgcagtggctcacgcctataatcccagtacttcaggaggccgaggcgggcggaccacctgaggtcaggagttcgagaccagcctggccaacatggtgagacccctatctctactaaaaatacaaaacttatctaggtgtggtgacacatgcctgtaatcccagctactggggaggctgaggccccagactcgcctgaacccaggaggcggaggtttcagtgagccgagataacaccattgcactccagcctgggtgacagagtgaaactctgtctcgaaaaaaaaagtcacagatagtcttgctttagttttttctttacaatttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggactgaaaatacatttttttttttgagacagtctctctctgttgcccaggctggagtgcagtggcacaatcacaactcacattaggcttgacctcccaggctcaagtgatcctcccacctcagccacccaagtagctgggactacaagtgtgcaccactatatctagctaatttttgtttgtttgtttttagagacagggtcttgccatgttgcccaggctggtcttgaactcctgggctaaagcagtgcacctgccttggcctccgaaagtgctggaattacagaaatggcccaccatgcctggccttaaaatacaaaacaaaaccaaaaattttaagtagcctttaaaatttttatattttacttttgattaagtcacatgttcacaaggttcacatttcaaaagggtacacagtaaaatggctccctctcacctctgaccccagatattcctcttccctccttggaggcaagcagcattatcagcttctttttctttttatatatacagattttttcttttttcttttttgcttcttcttcttctttttttttttggccaccaagttaccatgagaagcattatcagcagtttcttttttttttttttttttcttttttgagatagagtcttgctctgtctcccatgctggagtgcagtggcacgatcttggctcactgcaacctccacctcccaggttcaagcgattctcccacctccgcctcccaagtagctgggattacaggcatgagccaccacaccccgctaagttttgtatttttagtagaggtggggttttgccatgttggccaggctggtcttgaactcctgacctcaggtgatcctcctgcctcagcttcgcaaagtgctgggattacaggcatgagccaccacgcctggcctatcagtttcttaagtgaccttccagggttatcttacataatcaaataaagcagatcacacacacacacagagacacacagacacatgcacacttttttgcatatacgcctggtaaaatttcatcttcacagttcttgaagatgcttccctaacctactagttataactgggaggtggctctgtgtcaggccaggaagaacttctccactggtttttttgttttgttttgttttgttttgagacatagtctcactctgtcgcccaggctggagtgcagtggcccaatctcggctctctgcaagctccgcctcctgggttcacgccattctcctgcctcagcctcccgagtagctgggactacaggcgcctgccacctcacccggctaattttgtttttgtattcttaatagagacggggtttcaccgtgatagccaggatggtctcgatctcccgacctcgtgatccgccctcctcggcctcccaaagtgctgggattacaggcgtgagccaccaagcctggccttccactgctttttcttggccacagagtgttccacagaatggatgtaccatcatgtacttagtagcagtccccttttgatagacatttaggttgtcaccaggatttcttacatgagcaatgctgcagtgaacctccttgtccacaagccatctcctctgtgctggggtatatcgttggatacgttcttagaggaggagccggtggggaaggtcctatgcatgcatagttttcagagctctccctcagtgccctccgttgtggttgtatcaccctcccaccagctgagtaggggagggcctgttacccccagagcccctccttgtgtattatgtatccctttttttttccccaatctgagagtggacaaatggcatcccagtgtagggttttttttttcttcctctttagtttttgagatggagtctcactatgtttcccatgctggcctcaaactcctgggctcaagcaatcctgcctcagcttcccgcatagctgggactgcaggtgtatgccaccgcacccagcctagtatagttttatttttattttattatttattttgagacacagtcttgctgtgtcacccaggctggagtgcagtgtcatgatctcggcttactgcagtctccacttcctgggttcaagcaattctcctacctcagcctcccaagcggctgggactacagaagtgcgccaccatgcctggctaattttttgtatttgtagtagagatagggtttcaccatgttggccaggctggtctcgaactcctgacctcacgtgatctgcccgccttggcctcctgaagtgctgggattataggtgtgagccaccacgccctgcccaagcatagttttaatttgtagttgggagcaagccccatccatccccagcctgtgctctctcccgaagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccaggtgggtacctggtggatgccgcacgaggcaggcgtccctgcagaaggtaaaactggagagttggggagaagggagcatctgttcactaggggaagggccttcctctgtgagctcagccagtcttcccatgcactgaggttccgaaggcacttgcccagtgtttatcataaacagcttagcctcctatggcagaacttgtggccgggtgtggtggctcacacctgtaatcccagcactttgggagaccaaggtgggggattacctgaggtcaggagctcaagaccagcctgtccgacaggcaaaaccctgtctctactaaaaatacaaaaattagctgggcgtggtggcgcgtgcctgtaatcccagctacgagggaggctgagacaggagaatcgcttgaacccaggatgtggaggttgcagtgagccaagatcacatctctgtattccggcctggatgacagagcgaaactccgtctcaaaaaaaaaaaaacaaaaaaaaagaactcgtgccccttactcctgccacctggacaagtcctcaactgctttcccatgagataaagctggtgggaacctcattcccatttcacagatgagaaatgtgagatctggagaggagccgggacttgtctgaggtcacacagccagggaggtggatgttagggtccctgcctcgggtttggagaagcatggtggacacagagctagtggatttgagaagctggggtggtcccgtattcacctctgttgctcccccaactccagagtgacagagctgggcctggcagtgaagcgtcttgagaagcagaatctggagaaggatcaggtcaacaaggacctcactgagaagcttgaggccctggtgagctgcaggtgcccctgagatggggcagggtgagatggggtaccggccagatccatggacgcaggcttagggctgggctgcctgggtcacccccagcgtcccactcacactcaggttcagccctcacaggtgtgcaggctttgtgggaagcacactcacctccatcccatttcttcctcccagcagccctgtagcataatcctcataacacagatggggaaactgaggcccaagaggggtaatgcttgtccagtctcagagccactaagcgggagagtcgggacttgaactcccatccacgctctccaggtccagatgcggcctctggcaacctagctgccccccacccccaccagtgggacactcactcccccagggtacagcctggtttggtcacccctctgtgtggggcctggcctgggttctaggtccggctctcctgcaatcgactgtgtgacctggggcaggacatagctcttctctgggcctggtctgttcagtgagggcctcgggcctgctgtggggtctaccaggtggctggcctatggacatggcttcagaggccacctggtcagtggtgggccaggtagggagggaaaggggaggtttcagataagacagaaccccaaccaccctttgtctccctaaccgcactccaggaatccctgcggctacaggagcaggcggccctggagacagaggatggagaggggctacagcagaccctaagggacctggcacaggtgtgagcccagagaggcgggaagacagcgccctgccaggcagtcccaggctcccccgccacgtctttcggtgacctgggactgaactgcaaatgggtgggggcctgggacccaggctgtagctgctcagcacccctgctagctcacccagcctctgccttggggagcccccagtctcagaggggaggcacgaccctttgggagcccacctgtgagcaaggccaaatgatgtcttcccaataaatgggaggcctcagcggcgagccgaggactgagctagtggaggaggtgaaatcaggaaggcttcttgtaagaggcagcatttggaatgaggcagcccccagcctcacctgggcgtctttgcccagctaaccccgcggttcctaactcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggtgccggggaggtctgagctggggggtactgaagaataagtcaccgtctgggcataacaccagtcaagccttatgcgtatggctctgcactaatatggtcgccactagctgcatgtgcctattaacgtttatttatttatttatttttaaaatggagtctcgccctgtcgcccaggctggagtgcagtggcgcgatctcggctcactgcaagcgccgcctcctgggttcacgccattctcctgcctcagcctcccgagtatctgggactacaggcccctgccaccatgccgggctaattttttttttttttttgagacggagtttcactgtgtggcccaggctggagtgcagtggcgcgatcttggctcattgcatcctcctcctcccgggtttaagcaattctcacctcagcctctgaagtagctgggattataggtgcccaccaccacgcccggctaattttttttgtatttttagtagagacggggtttcaccatcttggccaggctgatcttgaactcctgacctcatgttctacccgcgtccatctcccaaagtgctgggattacaggcatgagccaccgcgcccggccaacatttattttttagtattcagttttgttttgttttgttttgttttgctttgttttgagtcacactcttgctctgtttcccaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactatgttgcccatgctggtcttgaactcctagcttcaatcactcctcccacctcagcctcccaaattgctgggattacaggcataagccactgtgcctggctctattaaaatttaattaaaatttttaaaaagtgaaaattcaggctgggtgtggtggctcacacccagcttgctggccaacatggtgaaaccctgtttctactaaaaatacaaaaattaaccaggcatggtggcatgctcctgtaatcccagctattcaggaggctgaggtgggagaatcacttgaaccccggaggcagaggttgcaatgagccaggatcgtgccactgcactccaggctgggagatagagcgagactccatctcaaaaaaaaaataataataataatgctgggcccggtggctcacacctgtaatctcagcactttggaaggccaaggcgggcggatcatgaggtcaggagattgagaccatcctggctaacacagtgaaaccccgtctctactaaaaatacaaaaagtaaattagctgggcgtggtggcaggcacctatagtcccagctacttggaagactgaggcaggagaatggcctgaacccgggaggcggagctggcagcgagccgagatggcgccactgcactccagcctgagcgacagagcaagactccgtctcaaaaaaaaaaaaaaaagaaaaaattcagttctttagttgccctagccacatttcaagcactcatcaaccatacatggccatagaacatttctgtcatctcagcgagttctattgccagcactattttggactgtatttcttggagttttttttagagatggggtcttgctgtgttgcccaggatggtctcaaactcctggcctcaagtgattcccctgcctcggcctccaaaaatgctgggattagaggcataagccaccatgcctagccttgaagattttttttttctcttaatttgagacagggtcttgttatgtcacccagtctggagtgcagtggtgcgatctcatttcactgcaacctccacctcctaggcttaagtgatccttccatctcagcctcctgagtagctggaactacaggcacacaccaccacgcctgcctaatttttctgttttttgtagagatagggtttcgccatgttgcccaggctgatctctaactcctgagcccgtctcggcctcccaaagtactgggattataggtgtgagccatcacgccaggcaccctgaagatttttaagacaagaaattatccacttcttagctgccaggttgtttttgatattttgttgtttggtttttctcttcataaatgtaaccatctaatgaaaagtttgaaaaataggaataaaaagacagcgccttctcacagcctcatctgcccatcctaattcatttagggcactggttttccttcccattgtgttgcctggcagtgagatagcaaacgtttcctgcacacctactgtgtgccaggctcttggccgagtgttttgtatgtactctgtgatttagtcttcctgtcaaactcatgcaattcggaactctgttgttgtaagcttgagagactggctcagactcatacagcgtgtgtggctgggggtggcagggtgggaactggaattcaggtccatgtgagagtaaacccaagctttccatgcctggaaaggagaaggtctttttaagcagttgtgttcacagcaaacatcccattttgcattctgctatttttacttaacagcacattgtcgactgagcgaggtggctcacacctgtaatcccagtattttgggaggccaaggcgggtggatcacttgaggtcaggagtttgagaccagcctggccaacatggcgaaaccccatctctactaaaaataaaaaaaaattggccgggcacagtggctcactcctgtaatcccagcactttgggaggccgaggcaggaggaccacctgaggtcgggagttcgagaccagcctgaccaacatggagaaaccctgtctctactaaaaatacaaaattagccatccgtggtggcacatggctgtaatcccagctacttgggaggctgaggcaggagaatcgcttgaactctggaggtggaggttgcagcaagccgagatcgtgcactgcactccagcctgggcgacagagtgagatgccgtctaaaaaaaaaaaaaaattactgggcgcattggctcatgcctgtaatcccagcactttgggaggccgaggcgggcaggtcatgaggtcagaagattgagaccatcctggctaacacagtgaaacccccatctctactaaaaatacaacaaattacccggacatggtggcgggcgcctgtattcccagctacttgggaggctgaggcaggagaatggcgtgaacccgggaggcggagcttgcagtgagtggagattgcgctactgcactccagcctgggggacagagcgagactccgtctcaaaaaaaaaaaataaaacaaaatcacgctgtgaagttttttcgcacctatggccagtggggaacgtggcagctcatggcaagtctttggggtcccagttgttcccttctcctccctcccctgccgtggccaccatgtgcctgtgtagcaggaagctgtgggatctgcagactcagctctatcaggcttcccagaattgaggggcatggggtgttataggggacatttcctggtcacatggcctagcagagctggtggcacaattgccgtgtgtcccaggagcctagctcggcctcttctacctggtagggtgcttggagatcacaccagcacctccatccactccaagtgggcggactggagagaaggaaagccaggttcttctgctggagtgtgtgagtgaaatgagtcagccatggacagggtggtcagggaaggcttcctggaggcaggtgccttggaagactggaggatgtagctcatggctagaggagcagccagccaccttccctgcagagagcagccccagcatcccctctgctccccctccccttgtcctgaagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggccgtatccctgctcttctggatgctcctgggggcaatgcctatagctcagggtcatccagtgcctgagactcagctcctggggtctgagagttgtggccacagcgcagagggtccttggcaggggggcctgcgctgtccgctgcagcctgggctctgagcagtgctatccctagaccctactcaggggatcctctgaactctggccctgccctgcagcttgagctatttttgcacagctctgtggtgtgtggcttttaaatggctcataagcagcaggctttctgcggtgatttttttttttccatctcacactgtgtcccctccttgtctcccctaccctgtctctgagggtccatctctctgggtctcttcttgggcctcctcacctcctcccgacctttctgcctttcctcatttctcggggcctgaccctgcaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccaggtacgctgtgcacctgcgggcccacctgccttgcccacccatcctccccactcagtgaggcaccccgggcccagccctgtacctgtcttggcccctgcctccctttctgtccctggttctctgtctgtctctggttctctgtctgtctgtctatcccctctaggcgtcaaagcacagaagttccatgggccctcctcatctccccctccccagtgtcccatacacccaagggcactgtccctcattccctgggagcctcccctgggctattgttgctggtgggtgggtggaggaggcgtcctggtcctgggagggacgccctgctcacgaggccccactcctacctggcctccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggtgggcaaagctgtgtgtgggggtggtgtggagagcatgtggggcaggccgggctcccagccccctgcatccagtcctgggttaagtcacaggcactggagcctgcttctgggttaaatccagccccacttctgctagctggggaccttggacaagctgcccaatctcccatacctcagttgccccatctataacatggggccagccaggcgcagtggctcacgcctataatcccagcactttgggaggccgaggcgggtggatcacctgaggtccggagatcaagaccatcctggctaacacggtgaaaccctatctctacaaaaaattagctgggcgtggtggcacgcgcctgtagtcccagctacttgggaggctgaggcaggagaatcgcttgaacccaggaggcagaggttgcagtgagccaagatcatgccactgcactccagcctgggcaacagagcaagactccgtctcaataataataataataataataataataataatgatacagattaataataggtggagactttttagaattggaatcttagacttttgggaacatcacatctggaagagaccttaatgtttcagggatccagggaccttcatgcaaggtctatcctggagcgcctaggtttctgggaggggcctctagaggatggggtagggggtgcaggaagcagggtgcaggtctccaccttgaggcctgccgagcagctgcacttgggtctggtttatatattcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttggagaaggaagccctggagggcagcctgtttgaggtgcaacggcagctggcccagcttgaggcccgccgggagcagctggaagccgaggggcaggccctgctgctggccaaggagaccctgactggtacgaggggctggggacttggggggaacaccaggttccagcccagactgcagcctcccaaggtctggggtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacgtgggaaaagcgtgtaaggccgtggcacggtgcctggctgagtcaacagtaactgccgttcatcggtcatcaggcctgttagtctgagttctctgtgcttttcagatgactctcttggccccagaatcccagccccacttccctgcaccgttcccatccagtctctgaactcagggcttctttctgctcacctaacattaactaagcacctacttgggtcatggaaattaattttcctgtccatgtacacctgagccagacagaaccaggaagggaaatgctggtgggtttccaacccgggagatggtttttagatggtagctataccatttccatt

SEQ ID NO: 37 - DNA, 213371 bp, Homo sapiens
acatgttacttcctattcccataaaccctccactgtaggattaacacctaagacaccaaccaagacacaaaccaatacaaaaaaagatatgacccttggcgtacagtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgaaacgttgtgcctctgccccgacacagcctcatacgcctcactctttacacacacggtcacttgccccgcgcactcccgagccctttccagccctgacacacagctgggattctcacttccgatcagcggtcctgaacccgctcccagggcacgggaactcccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagtcgccaagaggaagtgacgtctgcctctccctttttccctcccgcccctgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcactatctgctgactcatctttgactttgttctcgcgatggtgtcaagagcctggacaccacggctggggtcgagatcccaccagtgtccagggacctcccccagcccaccagtatcagattctattccattgctcaaatcacaaaacatcgagtggagagttctctttggagaccgtaaagtaaagattctgtggcatggtggccagttaggccactggaagcatggcaaaatattgaaaatgagggattgggtgacagtgtagtaactgctgaatactaaatacttgatccaggccccattccctggagattgacagggagacacattgtccaggtagtagtggagaaatgctttctgggtatctgaccagcctttgtggaaagaactggcaccatcctgcagatgtaaccacctgatgggttcttcctgaccaatgtacacaaaaattcaattcatggagaccatggcactgcaggaaagagtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggtgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatggtttccagatgaaactgttccacctcaggtcatcaggcatcagttacagtctcataaggagtgcgcaatctggatcactcacatgagcagttcccaatagggtccgagctctgacgagcagctaatgctcatgctgatctgacaagaggcagagctcaggtggtaatgctcgaaagcctgcagctcacctcctgctgttcagctgggttcctaacaggccatggaccagtacctgtcttatggccctggggattggggagtcctgatttaaactataaactctatttttcccaaagatagcttgggagaaattgcacaggaatgagcaaagacagcaagcctgtgaggctagaaccaagatggagtcagccatgtcagctttctcttgttgtcataattttgcaaaggtagtttctgaggggctgcactggacacttcttaaaaacatgagacagatgttattgtatttactacagtaggcaagagagaccagcagagaactgggctcaacctcgaatacagcaggaggagttgaagattatagccaattggcaagataagaaagtcagtggatggaaaattactaagaggaacttgattagctatcaaaggtggttgcgaggactcttgctaaactagactcaacagtattctttcctaaaactggacttggcaggcaaagaaataacagagaaaagggctcagaggaaactactaaggtttggtcaaagactagagtccttgtcaactctacattgaagcttctgcaaataaacaaagaccaaccaaatgaaaaaaagcaaaagctatttattctgagcttgctatagcagggagtcagtcactgttatttgtgttttggcagagacttgaaggcagtcataaaggtgggaaagctttttaaaaagaaaggcttcaggggccgggcacggtggctcacacacataatctcagcacttcgggaggcccaggtgggtggtcacgaggtcaggagatcaaaccatcctgactaacatggtgaaaccccatctctactaaaaaatttacaaacaattagccaggtgtggtggcaggcaccagtagtcccagctactctggaggctgaggcaggagaatggcatgaacctgggaggcgaatcttgcagtgagccaagattacaccactgcactctagcctgggtgacagagcgagactgtgtctcaaacaaacacacaaacaaacaaacaaacaaaaaaacaaagaaaagcttcaggtatgcttggattggaggctgtcagcatggtgaagctgttgatagatgaagaaaatcaaagtattttaccccagaatatatttctttggcatattttaagatggctgtcagagagccagcaaacagaaggaactctgcaaaactgtcttttgtaggggaaatttacacctgcagagaatctgcattaatccagctttatcttgtcaggtttgagaaataaaaataagccctaggccctacaaccaactgaatggactccctcttggctgacaggaccacagagaaacttcgaaagcagtttctggatgtggcaggctaggaggttggacatgccacctcaaaaccctcccctcactaactgccattatgatgcaggagaacagcagagggaattggaagttggataaaaggcagagtgagtgaaagcagagaaagaagcaaggtgatggggtgggagagcaagaagcaagatataaggcagaagttgagcagccaaaacaaaaagtaagatttaaaaaagcaagcaaggctgggcacggtggctcatgcctgtaatcccagcactttgggaggccaaggcaggcagatcacctgaggtcaggagtttgagaccagcctggccaacatggcgaaaccccatctctactaaaaatacaaaaaattagctgggcgtggtggtgcactcctgtactcccagctacttgggaggctgagacaggagcatcgcttgaacccgggaggcagaggttgcagtgagccgagattgcaccactacactccagactgtgcaacagagcgagactctgtctcaaaaaaaaaaaaaaaaaagaaaagcaagccaggaccccatggccggtgagatccaaaccagtaaaggggcagctcctcagagataggcatgtgcattagagaaaaaaagtatccttaacatgactccatatgataatcagctcattaaaactcatgcatatggactgcacatcatgcatgtacttaaaattatgggatggaggcaatgtgcaagcacacaagggccaaagtaactaagcaacccacctatcaatcaaaaggcaaacactggctaacgattaggcatccttgggaagagaagagaaagaaacacacataaaaagacccaacgtacaccaaactaatactgatctcacatcccagagatcagcccactctccccactctgagactgttactgtgcttaataaattttgctttgctttgctgctttgtgtgtgtcatgtacagttctttgtttgggacaccaagagcctggaaatgcacggcaccatctggcaagaattaggattttttttcctaagggttaacaatccaagcctttggagagacttgcttcactgctgttatcaaccaacagcctgatgctttccctcccttttgtggttttgacaaaacaagcaagcagcattccctcctgataagagaccaccgacctaggaatcattctggccagactacagaggatgtacagtgagggttttcatgtccattgcctcagattttgacgtcagagggccacaaactccactctcagatgattgctaacgccaccattttatgaacatgagccccatggagaggcacgcagctcaactgcacatctgcacatttttcctcttataaacattcatattggaatattatttggtactgctcccgtgaaagatacatttgcagaatggactcagattagaagcattatacaagcactataatgtagcaatggcacatccagctctctacactatagaaatgtctgcagggtaaacatttccacaatgaccaaagatatctgtacaggactggtgactgcagcattctttgtaatcctaaaactatgaaactaaagtcatctcaaaaacattttgtttttttgagatggagtctcgctctgatacccaggcagtgcagcggtgtgatctcagctcactgcagcctccacctcccaagttcaaacgattttcctgcctcagcctcccgagtagctgggattacaggtgcatgccaccatacctggctaacaaaaacattttgaaaagggttaaataaatcatgcataaactgaggaaaaatactattttcaaaaatgatggagagaatcactttcatgatgaatgattccactggtcacattattgatagagcaatcaggaaacccaggcacatcctggaggtaatactggactcctattactaaaatatgaaaaaatggagacacgtaaatactcgtttaagcgtataacggactgaattagaattttatcacatcagaagtgggttcctaggtctctgtttcaggattccttagtgacacaggtgtaaacccggcatttcaggagatagccggctaagaatctggtcggggaggtgggcggcccttgacatggatctgtcataaattagtggcttgagactttgggaagataaaatcttccccatttatctagtgattgacattgcgtgaatgcttcaaaagttccaataagcgtccctgggtgggctcgaaccaccaacctttcagttaacagccgaacgcgctaaccgattgcgccacagagacaagcgcttccaactctactgggcatctaggaagggcgcactcactgaacttcctccgttccgtctattctcagggcccaccgggcaggaccactgagcaaggccttggaaaaccagagagattagagcggtgagtcgcgccggtcacgttggacgcctgcgtgttaggagattctggagccagaagaacagcagaattgccttcgcccgccctgcccctcgcctgctgcagaagcttccagaaactccctggtgggcgacccagcccgagctgcctggggccccaagggaagctgaacgccctgtgggctcctgggatggttcttcccgttctttgcgccgccttcacccattgaaggagcctgtgcccaccctgcccagtcgctttccgggccgctgaggagcttccgctgccatcttcggatcctgtgttccgcacgggggctccaccagggcagggatggtggtgagggtcgctcgtgggtcccctcgcggggagcagggtctggtactcaccagggcgcacgactaggacttgtggaatgaattcatcgtcgcctttagcttttagtcctttgaagagccctgagagtggaaatcaagagattttttccacggggaagttctttttacaaagcgttgatttctcggcacccggcagggagggcaactggcagggtctctggcgcaccttctgcgcggtggagccacgggggctcagctgggcggtggtgcggccgtggggtggtaggtcaagagctgggaaaggaaaaagcaaaagctgggaaagaagccggggagcggtggaccagacatccagacctcctgaaaggctcatgaaggggcacaggcaggatcttctggaagtgagaattgttttgtttgtttgtttgtttattgtagtagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttcaattgtctgtccgttaaataaataaaacccttttcctatatctttaaaattacgttggttttatcattttatgattacaagtaatgctgcagtcatcattcttgtacactctcattggccactggtgtatttctatagggtggaggcctggagagtagttgttccagcatagtgtttacatagcttttatttcattccgttttctttcctttgttgctttattagctataaccgttttcttatttcagaggctgctttagggtttccggaatacatctttaatttatcatagtctgctttctagtgtcattatgcctccctttctggcctttatcctagtgttatgtatctttactttatgcactataacctttgtgattcattattattacttttatttgttacgtcaaatattttttgaaagatttaaattataagaaaacgtgtagtacatgctttctaaatgccatttccaatattcgtttctttgtgtaggaccacatttttatctggtatccttttgcttctgcctggaggacgcaagatttcttgtagcgtgggttggtgaattcttttagcttccgtatgtttttcaatgttcttatttcactcacagttttgaaattttatttttgcatagaattctaggttaactttttttctctaggtactttaaaaatgttgccatttatgaagcattgtcatttaaaatatcatctttctttcctatgtttgtaaatatggcgtaaagccggtttcttgtgctggttatacaattttcagaatgtgtatttaaatttaaaatattaaattgtactaaaaaactaaaaatattaatcatgaatgtcctagattcatcttaagttccaacagtgcacttaaaatgtgcccaacctgagggtcaaacctacctgctgatgtggaatttgtgtttgtgagacattctcaacagcatttgctttccccagcctagtgattttcctcacatctgaatgtcttcattgcaaaaggaaacgtttttctttgcaaaaatactttaaaatattcttacttcaagtaggtgtactaaaaacaaatttctcagttgcatccctgaaatccatcgaaagcccgggagagacaatcaagtgcttcaggaccaagagtgaaacaggagaggacaaagcagggcttcttcactaggagtcaagccaaagtcaactgatttggtctccaatggagaacggaactcggttcaccagcaacgtgaggacgtggcccagaggagacggagtttcccttcatggtgccttcagataggaaatctaggattttctttctttccctttgatctacttccaactctccctttctgtttcttcaagatctttttcggatccctgggtgcgaaggacataaggggccagtggccttccctactggtccctccttgactgggtgtctttggagcccaagctcacccggaacattactgcccgctgcagacagtgagaggacaaaggagggcggtgggtgcagtgggaaccacagagtcaccgtgcacctgcgcccgtgggctcctagcaaattgaataaatgccccctgaagcttctctgcaggtcagagggaaggggagggtggctgccgacctggcgggagaagcttcaagaaacatcgggaggacttggccctgcccctgggccttgaagacaggcctggccaggctgattttgatgggtaggcccaaagaaaaggttcgagggcagcccaaaccccgaccctgagattaaggctcttaagtgtctgacagttttgagaatcgtcagtagaatcgatcctgcctgtatcaggagacttctttgccaaaattcagagaccaagaaagagaaagattgggcagatcaaaatctgtcattaaccaaacaggaaacataagttttctgacaaattgaatgtgtgctgtgagaaaaagactagcctcaaggagaacctggttttttggcttgagtgtagggaagaatggagttgccaccaacaatggtgcgttgaaacggcaggtgcatcaggctgtagatgtgaaggaattaaaaatattttaccccaaactacatttctttgacatattttgagatgtctgttcagaaagccagctgcagaagtagccctgcaaagttgtcttttgttggggagatttgcatctgtagggaatctgcattgatacagccaagtctttccttgtccagatctaggaaagatgaactgagagtctgacacctgtaaaggtctgaaagaaacttttagggtttattctctctgagagctgctacctgtaaggtttcatttacatattaagaccacctttgctagccgagcctcattttctctccctgccatcacttatcttgtccacaataaatggatatacctctgactctgattgcacctggttttggccatgctttgagccctcattcattctgttatctcgagatggtatataagcttctgcatcccattgtgggtaggggagggtaatcactctgtgactctccccatgcacatgttagtacattttatgccttttctccaattaatctgccttttgtgacttgatttttgagtgaaacttcagagagttaagagggagggtttccattggcccctacagttttggagctgtaaacaggataggaaagctctgctcttctggaagctgcagtgaagaacccaggatatgatcagctatcataagggtaagaatttttttaccagccaggctcctggcctccttctctgtgtggaatctcatcaagtggatggtaaaaatcactgtttctttcttttccctctccaaaatcttgattaattggagaaaaggatttgtgtgactagtcttgggtgtagtgactctggtgtgctttttggtactttgtggtaccaattcctattgtttaatccctttcttcccagaaattgtctgttcctttgtctttgtctctatgtgttattctgtcataaaagggggtactggttgaggttccttctcatcttattttatgtccttgagagcttgacttgtgaccaagtggaagcgctttctcttggtttccactatctggaaagaggcggtaactttcaggtcatactaggtggcctgtctgaaaatggctgggaaccccagcacactttttgttctgaccatgacaagctcttggggtttgtcttaagaagtcccatccctttgaggcttttgtcatctcaattcttgttgcctggttagttctaggaaagctcaatcccaagatggcctacctggtatcatggattcacaggtctgtgactggaagtccccataaatttgtgggttgctggaggcaaacatcatccttacccatctgtggtctactctactaaaaatacaaaaattagccaggtgtgatggcatgcgcctataggcccagctactcgggaggctgaggcaggagagtcatttgaacccaggaggcggaggttgcagtgagccaagattgtgccactgcacactagcctgggtgacagagcaagactctatctcaaaaaaaaaaaaaaaagaaagaaagaaaagatttaagagaacaattattttaattgaatacattttgtcaagattaactcaactttcccctagagtagtgaaagaataagcaatcgtaatttagattctaagttactggtctttgagaaagtgtgaaaaccaaaaaggtgccataagtcaaaaagagcaaaagtcctaattttcaaactgatgaaaataaagtactaaaaaattgaaatcatcatagttcatcttggtccttggcaaaatacaaatgtattgattcaaattataatatcttagctaccctattgtgcgtagctcttaccactgaggagaaaaaccaaacccaaacaaaagtgtgttcaagttggcaacaatgtttacaaacctgcaaaatctcttcagcctatcccttaaactccagacttggtatttactaagctctgtggtgtacaatacccaccttaatatccattcttgcacaagttctgttaggtataagccaagatgacatgagatttttttttttttttttttttttttaccctctcatgcctatgtttgcttttgcttccacagacccttctgagtaaggactatcctcagactactggaggcacttagtcacaagcttgcctgaggctcagagctggcaatacctgggagtttatgtcaatcccacagcacccagcaaccctgcctgcaaaatatttacccatgattgacaggtgcaggtgtatgaaagcccagctccttgacttgaggggcacctttgtggtgaattaggtttggcaaaagggaatccagaggccaactttgtaaaaatgcagatagataaatagaaagaaatctttgccttggaagtccagttgagaaagagagtgatttacttgagactctgaaaacagagactaaaatctgtactttttcatgggaaagaagcctatggtgaaagagaaacaaagagaaaggtaggaaatagggtgggtctactccgtagctttaaaccactctgtcatattataaagcccggtgaggttttaactaacacaagtgtctggactctacacatagagattctgatttaaacgcttccaggtgggtggaagccactagtagtcttaaaacactcccaagtaattttaccatgtggctagagatgaaaaggacaatctatctactagaatctcaagtaaccattattgaagtgccccaaatgtgcagctacctcatagaaaaggcttaacaccaccctttgatggaatttcccttcctctctccatggtcttgtctgcatagcatggaaaatagagaagagataaagaggtagatggagaggttgaacctgtaatttgcctatgtagagcagtttctcaaacttttctgaccacaagatgcagtgagaaatatacaattctttgtgatcagttttttttttttttttttttttttttgagatggagtcttgctccgttgcccaggctggagtgcattggaatgatctcggctcactacaagccccaccctcctgggttcacaccattctcctgccttagcgtcctgagtaggtgggactacaggcacccaccaccatgcccagctaatttttttttttttttgtatttttattagagacggggtttcaccgtgttagccaggatggtctcaatctcctgacctcgtgatccacccgcctcggcctcccaaagtgctgggattacaggcgtgagccactgcgcctggcctgtgatcagtttttaaaaaatcttttactatgtgtaatccaccctacctagaatttaaataaagcctgcagtagtaagcagtcgactatattgatttcacaacccctaagtggttcagaattgcaattagaaaatttttccttttggccaggtgtggtggctggagcctgtaatcccagcactttgggaggatcacttgaggtcgggagtttgagaccagcctgaccaagatggaggaaccccgtctctactaaaaaaaaaaaaaaaaaaaaattagctgggcgtggtggtgcatgcctgtaatcacacctacttgggaggctgaggcaggagaattgcttgaaccccaggggctggaggttgtggtgagctgagattgcaccattgcactccagcctgggaaacaagagtgaaactgtctaaaaaaaaaaaagaaaataaataaatttttacttttgctctgcctttttatcaagcaaaatcccaaaagaacatttactataaacatctttctgtgaatccttatttctgtcccagccaccatgacccaataatctctagagcctgttagtgttctccagattgaagccttccctctaactgctcctaaactctgtgatgtagtggaaaagttttgaggcctcgattctcatcccaggtttttcacctacagatcatacggccttagcctcttgacaccattgtctccttatggccaaagatggaactgtacttgggtggtatctgagcaccctgttggctttgacattctagggctcttcccttggcaccactctcttatttaaaaggaacaggatgtggacttaggagggttatttctctgcaaactatcctctctttcttatgacaagctatttctgaatgtgcacatttgaggctaagcaaattccttcctgggaggttgaaagacccttatttctctccagaggagtattatggagagtcaattgatgctgaggaggtggtagagacctagtgaactcatctgcagtggctttgagcaaggcttttagaatcataaggtgggtggggtcctgtgtcctacaccacaggccagctagttcatttcaggagacttttttttcaatctattattactatcttcttctagactgtagttcactactggagattatccacttagttacactcagtttgcacctggcctgtatcaccagtcagctctcactccagcctcaggtatcagcaagacctcaccaaagattattgtttaattttgtgtgtgtgtgtttttgtttgtttcgggtaacaactaatgttggaactatgaaaagctcttctctacttttaacaaagcttagtcacaaacagttccccagttgatgagaaaaactaaaacaacagaacaattgaaagtccaaatctgcaagctcatctctgagaaccgaattctacagccactccagatttgtactccaaatggatagtttgattgtagaaatcacatcccttcagtctgccaatgtgataagggcccaagagacagtgatgcctagattcatagataatcccctttcccccatcctatatataactggagtcaacagcagctggaggaaaatggcaagaacttggaatcaagattaggttagaataacactgctgtagacagtttatcagctcttcagcatacgtccgttttccttgaaggatgagcctgtagaaacctctgacaataaagtttattttacacccattcccttgcctatgattttttcatacaaatcacaattataaaactttcttgctccagctaaaagcaggaaactcaatcatgaatgtgttcactaaatatataccacagaatgataacaaccagtctgattgcatcacttgattccaaaattaaatgttagccctcaggggtgcaactacatgtatctccaactctggaagccacaggcaacatattcctgtttccttgcagggaaacagatctataagcagggcggcagtctgacacatgtacattcctgggaaacccaaggaaacaatgatagtgacgcagggcaggcaagcccccaaactgaaagagttttgctaatgtcgcgattggctttctatgttatttgaagactgagatctccatgaggagtgaagataggtaatgcctaaggctgaggcatgacctcactgggtcaccttagctgtaaagtgaggtcagttgtcaccttgcaaaccttttggtaatccaaatcttggaatgatttctttaagaatttagacacttccaatacttttcctgtccttgtggggaaagcttctatccacctggtgaaagtgtctataaatactagcaaatcttgtagtcccctgtaaggtggcatctggtttaagtctgtctgccagtcttcaccatggtatgttccttggtgttgtacaggtttaagcagggatcggggtatggggtggcttcctgagtggtaaccctttttatagtttggaacagtcccttccgcaagaatatttaggaaactaatttaaatggaaaatcctgtcccaaatgtgaggaatcatgaaaatgtttaattatttcccatctgtcagcctcaggaatagagtttgttcttttctagcaaccatccagatgggtctccctggaagccttttactcagtccctttaatttccttaggggtatattatggtgtcactgacacggatggagtacctggtagtagcgcagcagcctgaaataccagggtttccttagctgtggccttagctgctctttccaccagggaatttcctctaataataaaagtgtctcccttctggtgtcccctgcggtgagtaattgttatttctttgggagttggacagcatctaaaagttccaagatctgagtaaagttgtgtgggggatcccttggctcttgatagtcccctttccttccctatggctgcatgagcatggagcaccaggaacccatatttagagtcagtcaacacattgactcttgaggttttgttctttttttttctttttttgaaacggagtcttgctgtgtcgcccaggctggagtgcagtggcatgatctcagctcactgcaatctcagctcactgcaaactcagggattctcatgccccagcctcccaagtagctgggattacaggcgacccccaccacacccagctaatttttgtatttttagtagagacggggtttcgccatgttggctaggccggtatagaactcccaacctcaggtgatccacccaccttggcctcccaaagtgctgggattacaggcgtgagccaccgtgtccagcttaagtcttttcatggttggaaggccctaattagagcagctaattctgctttttgaacagaagtctgagaaggtaaacccttggcctcaaaaacttcttgttggctaagcttcctttcttactccctcatgaatatagctatttccatctctaaaccactcaacatttgggttagacaagagcttgtcttcaaggttgggccttctagagtagagctcttccgtggtttccacacaggagtcaatgagtttgggatctgtttcttgagacgtgaggtgcagcaacagagtagcagggtttaaaaatcaggacactttcagggtaacatctggggtgtcaagcagaagggtctgatatttaagtaactggccccctgttagccattggtgtacttttgcctctaggaccctctgtactgtacttcatggggtggcagggggtgggggtgggggtggggtggtatggcatgtaattgttgtcccaaggtaaacttactggtttcgtctaacgatagagtgatggtagtcacagatctcaagcttcttggtcacctagctgccacctggtctagctgtttagagaaataagccactggtccaaagcaattcctcagcctttgagttagaacattcgaagctgtcccttgttattcatccacatagagggtgaaaggtttttctaagttcgagagtcctgaggcaagggatgtccctggcttttcttttaaggctaagaatgccttttgacaggttccaagctccgcctcctgggttcacaccattcttccgcctcagcctcctgagtagctgggactacaggcgcccgccaccacagccagctaatttttttgtatttttagtagagacggggtttcaccgtgttagccaggatggtctctatctcctgacctcctgatctacccacctcggcctcccaaagtgctgggattacaggcgtgagccaccgcacccggccaacaagtttttttttttaaatgaacagagcatcagtgaatgatagtgcaagtttaagacacctaatagacaagttaaaggagtcctccaggcagaaggaaactgacaccagatgaaaatgtggatgaaaaaaaaaaagacactagaaatgacatctacataggcaaatatataattttaacatctgactgtttagctgggcacgatggctcacgcctggaatcccggcactttgggaggccaaggaaggcggatcacttgaggtcaggagttcgagaccagcctggccaatatggtgaaccttcctctctacgaaaaattcaaaaattagtcatatatggtggcgcaagcctgtaatctctgctactcaggagtctgagtcaggagaatcgctcgaacccggaaagcagaggttgcagtgagccaagactgtgccactgcactccagcctgtccgatagagtaagactcgtcttaaaaacaccaccaccagcaacaaaaaagcaaaaacaaacaaacaaacaaacaaacaaacaaacaaaaacacatctgactcttgaaacaaaagtaatagagatggattgtaaggtttataacaggtgtaaagtaaaatgcatgacaatagcataaaggcagggggaggagtcatgtgaagaggtatgatgccacttgaaggcagactgtgatgggttaatttttgtggaaagcaaggcagaatttttgaagtttgtttcttcaaatactttctgtttcccgtacatacaagctagtttgttctgcagagatctcattttctaggaggctcggagggggaccttctgctgtctgtcctcatgggatgcacaagacacaagggaacagtctttcacttttaaatacattgatgggtctgaggagatagatacaactgcattttttttttaaatgaggtgggattctcattggtcttgaacttctgagctcagtggaggcttcccctacttcagcctttcaaagcgttgggattaataggcatgaggcactgcgcctggtcacaaccaacgtttaaaatcacgtccctgggtggtctgtaaccaccaaccttatggttaacagccgaacgcgctaaccgattgcaccacagagacaacctcaatcgcttgctttcatctctatatagattaagcaatcactaaaccctaggagttgccatttgctttctgcgggacaactgtgcagactacaaagcttcagaaaaccggagaggctgagtcgactaatcgtgttgttgcacgttagaaacgcgtgcattgcgtgactctgaagccagaagggcggccgaatggccttcaccctgcgttcaccctcgcctgcttcagaagccagtgcctctggaaatgcctggatctgcgaccccagcctgagccaagtagggcccaagggaagctgaactccccgacgtctctcatggtagctctttctgttcttttgcgccgccttcaggcaatcatctgttccgcttgctctcccttcactcaactcggcttcagtagatggggtcggtggggcgggagcgggaaagaggcaggggagtcaaaagggaaaacgtgaaaaggaggagggagaagcaggggagaccaggactagacaatgggacagcccaggatgcccgtgcagagggcaccggctggatgcagagaagatgggacatgtatcagatcggagaggaggaaatggggagaagatgtgagagaaaatcacaagaacctgtagctgcccaagaataaagaagtaaaaatcgcataatgtttttacattaataaaaaaaatcgggggaccaggggcggtggctcacgcctgtaatcccagcactttgggaggccgaggtgggtggatcactcacttgaagtcaggagttcgagaccagccgggccaacatggtgtaagctcgtctctaccacaaatacaaaaattagctgggcgtggtggtgcacgtttgtagtctcagctacttaggaggctgaggcaggagaatcgcttgaacctaagaggcggaggtagcagtgagccgagatcgtgccgctgccctccagcctgggcgacaaagcgaaattctgtctctcaaaaaaatatataaataaataatagaggggtggggaagcaaaacgacgggcagtaggtgtggggcgccttgggattctctagtggttagtagtctgcgttgtgcctgcagcaacctctgttctaatccgaatcctggtacagtcagactctatcttggacccactggggcgaacccacgtgtcttttggtttgcttttgattcctgcaccagctgaggcctttatctgcagccagaaagccggaaagcagggtttacccctggccccacagcgccatactgtctggggaaaagaaggaaacccaagagtacacaaacagtggcccaaagagaaaccttccaagtgctctatgcctcaccgtttagcagaaaatatcaagcaactctcaatctagctggtctgtaccttccacgaatgaaataatgtatttattgcagtctttctggttgagatatttcaaatatttggtggagcttttaatgagagagacactctcgagtgtggaagaaaaaaaagaggggatgtgaagataaggcgactttaggacagaaaaaaaaaaagagacaaggaagccatgtaaacgtttttggatgggcgtgaggcgttgtcagtcttgaaccccgttatgtcaggtaaagagcgcagcctcttctaccacaaacaccatttcccacatggaggaaatcacagggatcagcaactctagagtgagatgaagaagcttcactctgggagaacccccttcgtgaccacggtctctcccctgccaggtaaagtggaaatgagcacatggcttgcagggacagcacagcctcctcgccctggccggtcgctcagggtcaccaccctccccactgccgcccctcgccattcttccaaaccactctccaccaaagattccaccgacagtcaccccacaagacaacccaggccgcctctcagcagcggctcccgccccgcagccaccgcgccctctcacccccgcgcggttctgcccgccgcctctgccgagtctgcgcacttcacctccctggctcccgctctcccctgagcttacagtggactcggggttcttccgaacccctcttgggagtactgaatggaaaagggggagcgtgcgcaagtgcttggtagagtgtagacgtcgtgggatttgactgtggtacaatcgcttcgacgtcctagtgctgatttttccacctgccttctgcttagggcaccggcagcagttttccgtctgtgcctactccacctgctgtccttgttgggtcagcgaacatcgcctccctctaccgctcaatcagcaaacgggaccgccctcgaggacctcacccgccgcttacccccctaacaaattcgcgggcatcgcctccggtcgcctcttcccaaggcctaacgagcgccttcgctggcaacggaggtgaggaggctccgctgactggctggtgcccgtgtccggggctgccacaaacgccacgacttggcttggcctctctcttagttattcgcagctcagcccgatgggcgtctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaagattcctgcgggagggcggccagtgtaaaacaattccctgaccgggaatcgaacccgggccgcggcggtgaaagcgccgaatcctagccactagaccaccagggacacacaggagggagctttctctcccttcttctgtcagaagcgacagcttccctgagctctgggaggacttgggccttgtgagggtcgctctttgctcctggagtctctcacaaggccattccctccctgctttcttcaaaaaaagagcctgcaagcgacacaccgagggctccgcgagggacaccgaggccacgagtccgaaggcctggagcgagttgcagcgacccggccgcagctcaccactggactagagatgcgcctttgcgaggtggcagcaagtgaccagtcggtcgtgcgtcgccaggtccggagccgcgcaccaggttgccaggaggaggcgggagcgcggaggcgcccggggtgagacgggggcaccctctgcatcataaaggacccagacgccagcaccctcaacgtcataaggaatcagacggatgcggaaaccgagacgggctggatgggaaactctttccaggaaggctccggggccctcagctggtctccgaccttcccctgcaacctgtgacacctgccattttcccatcttaggcgatggcaacgccacccttccgtttgctccgggcaaaacttcgagagttccctctgactctggagttttttcctcagatccaagagccaactggtcatcaattcgtaatttcccatcggctaagtgcgtgggcattgagctacacgcgagtctctccacctctgcggaatggctacttcggggtaggggaggggccctcccgtggattgtaaggtgtttagcagcagccgtcgcctccgctgactagatacatgccagggggttagcattctccctccccgcttcccccattcgtgacctagtgtcccagcgtggaggtgagaggcgtgtaagggcaaagttgccccctcttgagaaccactgatgcgcgttgtcctgctgtctgagcttgtgcagaggactctccagatgaaggctcaggggtcgatccagcttgagaccccctcgctcccccgcacagtcagaccttaggattggaggcttttaacatctctacatcatgagattcgaaacctttaggtcttttcttccgttctgtcctccaaatcggcctcttccgagcctgttgaccagggccagccaggcagacggctgggttcgctcaacgaggctcctctcggccctcctggagcttcaggcctctttcggttgcagagaaactttatgggccacttccttcggcatccccgggggcaggtgcgcggtgcccggggaagaagagggtttgactgcggttctcgacccccggcgaccaacctccaccccggtgggcgcgcttttccaggctcctgctggtcccactggccgggagttaggtctcgggtcagcctgagctccagagatgcccaggcccggaaggacacttaggggaaaccagctgctcactttggtcttgtccgcaacggacctcttgctgccaggaaagaaaggcgtcgagtcctgtcctgttgggtaggcggaagagagatcaaagggaagacaagaaaaatcctgggaggtttcaggatctaaagttaccatgaagtcgacctaacctcctctggaggtcctcccagtcctcccgtggctggcgatggtgaatcgagtttccgtctccagtttgccaaggcggacaaagccgacacaatgggcctgtccactatcttctttcatatacacaaaatgtcagcttttcctgtttctaactggcaacatcccgcctgatgaccagcttagcaaattagagactctccatgggattccatctgtgtcttagttcgggcttctctaacaccgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaatcttccgtcacaagtcagcaaccagcatatgtgagtgacagcatgtgttccactcagaaatgagagtgtattagtccgttttcacgccgctgacaaatacataacatagtccaggacgaaaaagaggtttaattggacttacatttccatatgactggggaggcctcagaatcatggcgggaggcaaaaggcacttcttacaaggcagcagcaagagaaaatgaggaagaagccaaagcagaaacccctgataaacccagcagatagtgagacttattcactgtcaggagaatagcacaggaaagacccacccccatgattcaattacctcctcctaggtccctcccacaacacatgggaattctgggagatacaattcaagttgagatttgggtgagggcacggccaaaccatgtcagaaagggatgaagtgacagcatatcctgatgtgtgtgatggttttatgagttattacctatttcaaaaattattgcaatgtgtaaaaaagaacaaggacttgtactatctgactttaaggcttactataagctattacagacaaggcatcaggagtgacaaatagataaacagactgagttaagagacttgaaactgatccacagctatacggtcaataaatgggttttcaataaaagcagttcaataaaagaaaataaatcatttcaattaatggacttttatatggatgtggggagaccaacaatgttattctccctcacactacacacaaaagtaatttcagccgcattacacaccaaaacttaaaagttaaagatataaagcatttcaaggatagtttgtgacttgttggtaggcaaagatcaccctaccaacaagcaggacacaaaaaatacatatataagaaagacatgataaatgagacttcatcaacattagccacaccttctcatcaaaagataccactaagaaagtgaaaaggcaagcaagtcacagacagagagaaaatagccacaaaacgtgtctgacctccacaccctgcagttataattatagtggtctggtacactgcgcccagtttctgctggatggagtattttctgggtgtctctaatgagtaagagagggccccatgggatattccttcagttcccaggtgaacagtgggaaagactccacattgaccaacctcgggggcctaaaaatccaggtcctataggagggtagagtatacctggaccctgacccagacccctggatgggttgtgccaagagacccagcaagggaaaggatttcctcctgcctcaggttctctgtccttctgtggttagacgacctgaacccaactccctccccaagcactggagatggggcttttccaagggctggggatcttgctgtcctgagaacagctgagcaagggggtcgaggaggagcttgggtggtggaggagaggaaaccgggtaagatgcatgaagccgttggctataccaggcacagagaggacccactgggacccaatggcctgcatgtgaagccaggccttgggccacctcgttcctcaaaggggtgctgacttccatggggtgttcaaagggactgtggaaagagaggccttcagcccacacctctgaatgcttttcgaccacagcatgccctgtggcctttatcctgctggtgtggaacagtcagagccctgcagggctgcagagcttctgtactgggcggcatcccagcctgagtgtcagagctcagagagcaggcaccggagcaagtagagaggagggcaccttttggacagaatgtgtgggacaagagcgacggctcatccattcaggttcctcagaaaatgagagtcaggaagatgagggcgcagacctgattccctacacagggctgaaagcagacaaccggaggaagagcagcacctgggccaacgaggtagaagacagaagaccacagtctactcctgccctcaatctcaccccttcccacccacatcctccacgccccctgatcaccttcctcagaagtgtaataggaatccagattccccctggcctggttgctgcgggaggcacagtggcctgatggagcctgaggcaggtgtgggaagatgtggattgtctaactggaggttgggagttcagggtgaggaaggagaagcttggagtgcaggatttggtggtatgtatgtggctgtaggcaaaagaaagagacaactaagccacttgaaataccatgagaattcaaatttagaaaattcccagggaagtatgcatgcaggcactcatgagatccaaaaaacagctgctgcttaactgcgtgttgcaagcaagccctaaattgctgattttgaaacagcctgatgggttcacaaagacaatttctgaatagtcttaagagcagaggtgcactaaagccactgtgccccgcagctcaggatcccagaaagttctttaaggagtaagtcttacttccatttatggaagatttttggagttgtccttagtcacccccaaaaatgttttggttaggagtagaattttagatgtcatcaatttaaaaattaaaactgaaacgctggaactcatagagagataaaattaagagaatccattcacatcctgagtagaaagatttttatagaacatgacgggctttaaaaataaagaaaaaatatggcaaaatttcatcaaattaaatgctttcagaactaagattaaaatctgaagccacccaactagctggacagatggcttctttgccaaggagaccccagagaagtcttaaatactgagttcctggccagtacttggaagctcagacacctctccttatactctctccctttgtggtttagacacaactgaccagcattattgttaaaatagagatcctaagactgacagaacagagtccttacagtagtaagataccatattataaacaagacctaaggccatgccaggcaaggttaagtcatgcacccctcaacttaaagaataaactatgttctaattgccacaggtttttttcttcttcctttttttcctctagctaaacaagcactggccttgagataagcaatgctgaagcacttgcagctcacccattagcataaactgactgagccctccctacacaagccataactacagctttgattggacaagagactgatttcagtaacttccccttgataagagagcactggctgtggacgggttctggacggtttacagaggctgtgcacttgactgcctttgtgtccctacttccccttttgaagcatagggcctaattataatgtatttaaatgtcatctccaccccaaagtgaacatgggttgcatgtaacaggcttgtttactcagcatgcatgcagcaggatcccttcatgaatattcagagctcctcctattccctgttgaatatgcatatgtggcccaccacatcaacataaatccctgttcccccctcccctccctggaaacctacttttcggtttcagcaggagggtatgcctcccagtctgtgggaatggccaccttgcaggctgtaaccatttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaagatcacaagcattcttatacaccaataacagacaaacagagagccaaatcatgagggaactcccattcacaattgcttcaaagagaataaaatacctaggaatccaacttacaagggatgtgaaggacctcttcaaggagaactacaaaacactgctcaacaaaataaaagaggatacaaacaaatggaagaacattccatgctcatgggtaggaagaatcaatatcgtgaaaatggtcatactgcccaaggtaatttgtagattccatgccatccccatcaagctaccaatgactttcttcacagaattggaaaaaactactttaaagttcatatggaaccaaaagagagcccgcatcaccaagtcaatcctaagccaaaagaacaaagctggaggcatcacgctacctgacttcaaatgatactacaagtctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccctatttaataaatggtgctgggaaaactagctagccatatgttgaaagctgaaactggatcccttcattacaccttatacaaaaattaattcaagatggattaaagacttaaatgtcagacctaaaaccataaaaagcctagaagaaaacctaggcaataccattcaggacataggcatgggcaaggacttcatgtctaaaacagcaaaagcaatggcaacaaaagccaaaattgacaaatgggatctaattaaacttaagagcttctgtgcagcaaaagaaactatcatcacagtgaacaggcaacctacagaatgggagaaaatttttgcaatctactcatctgtagattcatcagaatctacaaagaacacaaacaaatttgcaagaaaacaacaaagaaccccatcaacaagtgggcgaaggatatgaacagacacttctcagaagacatttatgcagccaaaagacacatgaaaaaatcctcatcatcagcggccatcagggaaatgcaaatcaaaaccacaatgagataccatctcacaccagttagaatggcgatcatcaaaaagtcaggaagcaacaggtgctggagaggatgtggagaaataggaacacttttacactgttggtgggactgtaaactagttcaaccgttgtggaagtcagtatggtgattcctcagggatctagaactagaaataccatttgacgcagccatcccattactgggtatataaatcatgctgctaaaagccaaatgattataaataaattatatatttatttgatttatatgattataaataaatgattattataaatgattataaatgccaaaggattataaatcatgctgctataaagacacatgcacacgtatgtttattgcggcactattcacaatagcatagacttggaaccaacccaaatgtccaacaatgatagactagatgaagaaaatgtggcacatatacaccatggaatactatgcagccataaaaattgatgagttcatgtcctttgtagggacacggatgaagctggaaaccatcgttctcagcaaactatcgcaaggacgaaaaaccaagaactgcatgttctcactcataggtgggaattgaacaatgagaacacttggacacaggaaggggaacatcacacaccagggcctgttgtggggtggggggagggggagggatagcattaggagatatacctaatgtaaatgacgagttaatgggtgcagcacaccaacatggcacatgtatacatatgtaacaaacctgcatgttgtgcacatgtaccctaaaacttaaagtataataaaaaaagtcaaaaaaaagactcaattcttgaatatacaagagaacttttgtaaatcagtaatatagagctaagccaaataaaatagggcaaaatatttgaatagtcctttgcaaaggagagtttcttatatgctggaagccacaagaaagtatgcttcataggattgctcattaggcaaatacaaattaattccacactgagatagcactaactactcaccagtgtatggctacttttttttttttttttctgagacagggtctcattctgtcacccaagctggagtgcaatggtgcgatcttgactcaccgcaacatccccctctggagtagctgggactacaggtgcatgccaccatgcccggctaatttttgtattttgagtagagacagggtttcgccatgttggccagattggtctgagagcatagctacatttaacaaagttagtacaccaaatgctgacaagaatttggtgccacttcaactgtcatcgctggtgaaaaacattctagaagactggcaatttatactgatgttaaacttatactcaggtcatgacccagcaattgaaggacttccatgaatctcaagtgcacacaaagactgttataagaatattcagcacaagaattcaataaccccaaaattgagaagtgatctatgaaactacatggatatatctcatgagtataatgaatgtaactgcagaaaaaaggccagacacaaaacatatgtacattcattcatgtgaactttaagaacaggcaattgtaacctgtgggaatagacatcagaatagtgataactaagaggacacagggtgggaatcacctggacaggggctctaacaggcctttctcagatgatggcaattttctataacttgagctgggtggtgataacattgatcaaaactaaacaaattgcactaaagatttgtgcactttatgtgaactgtagcttctttactgttctcattgcttgaacctgggagacacaggttgcagtgagccgagattgagccacggcactccagcctgggtgacagaacaagactacgtctcaaaaacaataataatagtaataatttactgttctcataaaaattagcagatggggaatggaggcaagcctgtgcagaccatgacaactagtttagattttattgtcagctcattaaaaactcgtcctcgttttgtgtttttaaaaaattccactgatacagccgttttctctaccagaaaagactataaccgcattatttcatcagtggaagctacagacaaagggcccttgagaggcggcatcttcacctacgggaatttttcctgctcaattgtgagacaaagagcatgtccaagttttcctatcggccaggccgccccctagtttctgcgctgtgggctaaactccagaagctggcgcccttcagggccagaggtttactctgctctctggaggctgctaggattaaaggcaaagcaaacgacaggtctattagccacagttgcaggttagaaaacactactgtgactcagattagaacccaggttgtggcaaccacaactacaagtattaactactacacgaccacaaagcctgctgacaagcattgcacttctatgttttgaatgtaaaaacactcacactattttatctgctttattgttggacgtccgcagattttcgtgcttttctgtctttcgtgcgcttctccctttctctccccattctgctacataattaaaaaaaaaatctcatctctcaggatccgaccactgcctctacaacaagcctcctgggaggtctctttgtcccattgacatctctgccttctttcgctgctttttttttttctttcttttttgacggagtctcgctctgtcgcccaggctggactgcagtagcgcgatcttggctcactgcaacctccgcctcctgagttcaagcgattctcctgcctcagcctcccaagtagccggaatagcaggtgcatgccaccacatttggctaatttttgtatttttagtagagacgggattttcccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatctctcggggaacaccgatgggcccacaaaacacgcggaggccgcggtcgctgacgatgtgagcaaattcggttcacggtgtctggggtacagccctgagggtctactggccgcctctgcgcaaggaccagtctccgccgctcccctcatctccacgcagattcttgcccacacaccacccctttctttgggccgctgacgcctcttggacctctgaggtgactgtcctgcccgcagcttctctccttccaagagcgtcatttcttgatcctctccatagtggctcaacggtaagcccaaggtccagcacgcgaatcaggaacctgatggttcttcgggtttgcagggatccttccagtgaatagatgaaagtcacaggtaccagtatgaaaactgcagtgactcaccggaaacacttcatgcttgtcagcttgctaagctgtttgagtccaacaactgcatggggtcctgagttagtctcctgaatgtctcctgccgctactttcgtgagtgttgtcgtcactttaccttgtggtggccaagcccctaaatgcactattaggttatgcagtatgattttcagcgtaaaagacagataaagagcaacagcggggtgaaaaagaccctcttgcattggccgggaattgaacccgggtctcccgcgtgggaggcgagaattctaccactgaaccaccaatgcctctgcgtaacaaccgcctgcaggataacagaaaacagtatccacaaagacttagaaaccgttccaagcggttttttcaagtgtcgactaaaagctaacaaagacatccaaaccaaatgtgtttttacaggaaacttttactagacaacgttataaatatcaaaatagctcatttgtcggatcaaactcttaactctgaaaaaggtctttctttctacctgcattacaaacccctataataaaacatcagaaattcattcacgtttcttttttctaatcctaaatcttccatcgtcaacctcaaactgctgccttagaggttctaagaaggtaacctaactggtagtttaggtaagtaaagttcaaatccagggaggaaatcagtagcagaagcagaattagaagaaagaggaaataaaaggacagaaccaaggtagagataatgaagaaacaaaggttggtccactaagttagtcttttgtcgctggtttttttggcaaaagagtaatgatcagtctcgtaatcattataatactattatttgtctgcttgaagatgtataaagcatttgaaggaaatgtgatatgaaaagatgaagaacgctcgctgtcaatgtttccttgtttgggagaatcccatttcctaagttaatatgctttgatgtattagctatgtaagcagtagactagtttaaggaaatattgacggtcaaatattagcatattagtcttttgatgaagttcaaatagtagagagatttctttcctcaattttctctggaaacattcaactgaagagacaaatccagagttttctccatatgttgggtctgggagtcattatgactttttcaaagacaggagctgtgacatggaatcatgcttcttctctagctgagaagccaagctaggtccaggctgcgtcataaacttgagcccaccaaggaaatcacccttcacattgacctcgcagagttttggctgttctctgttctttgcccaacacccaagacacacaccagctctggccaacaaaccttaacatatgatctatatccaccagagctatatttattcccaaatctccttctaaaatacaaacctgtactttctactctcaacttctaaatttacaaaggcctcatatgcatctcagagtcacagatgctaaaacttaaccggttttctgaggattatttggggaaggggtatgcatgcaaatgtatatacataattcatgtgatttaggaatattgactctatgacttccagatgcagatttagaacctttttaaaaaatattttgtttttgttgtcttgcaaatcagccagatctgcaacttaccagagtaaagcgaagccaagcgggacccttaggaaatgcactaagatgtcatccactttcagtgtcagcctgtgaaaatacaggcgatagaagagaatgaagagaacctgaaggaatttctggaaccaaagctaatattaagcaggcctcttgctggcagaccagtggaaactgtagcctggtcaacgatctctctagattgaggaggtctaaagtgtagccacaggttcaactacttttctgtttgtttcccaacctcgattaaactcactaaatttagggacaaaaaaacaaaacaaaacaaaacacgatgttcccacgcagtctcgaaccagagacctttcatatgtgaagcgaacataataaccactacaccacagaaactgcatatgcaccaaaaaaggcaaaatatcatcatgaaaatcttaggtcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcgtccgagccctgggcgccccgtgcctctcaggagtgtggacgccgcccttccagggatgcggaccccgcctcggggccttttccccggcgccggccgtcggggctcttggctcttctcgtcctcccaggaaccgtaggactctccttgccctccctcccgtaggccgaggggcgcgagctgcgcctgtttcctcacggaccctttggcctcagcgcctcgacgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacctactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacgtaagccataggaggtatttaagagtaaattctaccctgataaagtattgcactgaaaaatttagtatgggccgagcatggtgactcacgcctgtaatcccagcactttgggaggctgaggcaggcagatcacaaggtcaggagtttgagaccagcctggccaatatggtgaaacccctcctctactaaaaacacacaaaaaaactagctgggcatggtggcacatgcctgtaatcccagctacttgggaggctgaggcaggagaattgcttgaacctgggagggagaggttgcagtgagccgagatggcaccactgcactccagcctgggtgacagagtgagactctgtatcaaaacaaaacaaaacaaaaaatttaccatgccactgttcttcaactgttctatatatgttaattatatgtccctagataaatcgtaaggtctgtgagaatgaagatagttctgcgtttcacatcccttacagcaccagcatcacagagattcacagcagatactcaatgaataattagactcatctcatcctaagtctagataggacctttcatgtcttctgttttaaccaccacctgatgtctgaatttcttctgtgttgtgatactgtggctgactgtattttgcaatcatggccatcacataaactctcatgccatcaactgatgagacccaaaacaagagaccctaagtgagagccacccagctgagcccagtcaaaccacagaaccgtgaagcataataaagtactgtttgaagtcactaagttttagagtggttcttacttagcagtagataaccaggacacataccaagatgaatgtctgtgttttcaacacaaagtgtcaataacactgataactatggcaaatagcattgagagcttaatgtatgctgggcaccattctaagcacttgtactaattttttttttttttttttttgagacagagtcttgctctgtcacccaggctggggtgcagtggtaccatctcggctcactgcatcctccacttcccaggttcaagcgattctcctgcctcagcctcctgagtagctgggattacaggggtgcaccaccatgcccacctaatttttatatttttagtagagacagggtttcaccatgttgggtagcctggtcttgaactcctgacctcaggtgttctgcccacctcagcctcccaaagtgttgggattacaggcatgagccaccacacctggccagcacttgtattaattcatgtaaacctaatatccaccctttgagatgggttctgttatcatcctcacttaataggtaatgacaaaggctcagaaaggttaagaaggttgcatgggtagtaagcatcagagctaggcagtctgattccagtattaccactatactatactatactatactatactatactatactatactatactataccataccatatgtactattactttactgatatatccctaagaggaaatccctgagatctggtatctcccagatactgggacatcatcctatgccctcctgcttgcctacctgtcttttccacagacctatatctaccatttaaatcagtgtccttgtgaatacccagacatgttgtttcttccaactgcctgagctaccctacaccaagcacaaacttacacattttcaatccagaaagtgcccagacagtgccatccttacccaggccacgaggctgatctcagctcctcagccagcttcccttctagtcaattttttgggagctgggcctccagctgggatactctctggatgagactcttcaggtcctttttggcctgaagtcctggagagtagaaagccccagtgccatcagacagccacacctcatcctcatcagtgacactatgaggtgaagacccctccagggtgtcaagagctctcagcttccagggtctttccagactagatgaataatcacttgtaactgagagggactggacccggctcttgaagttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttacaactgtgtgaaaaataggcaaaggaaaataagactttgaataaatatatcagcatgttaacatcagtgtattggggcagtggtagtcagaatgagaactaatccacagcattttacccgatgccagacactgttctaaagcattttataagaatttactcatttaattgacattagtacctgatggggtaggtagttcctttattactattttaacatttgaagaaactgaggcataggaaagtttacaaattgggatttgaagcaacaagtctggccccaggatcttttctcttaactgccacactacacttcctcaagaatgagagagactgtgtttttcttctcttctcgttttgaatgtggtgggtggccctatagttgtagtccttttataatgcaaaccaaaattatttttaacttatggtttgcatgtttccaaaacctcatgtggtctctaagtaggccttagtatttctataataatcagttggatagaacttcatatgattattattattattagcagtatgccacaaactcattgtagaaattcaaacttatactcagcctcattttgggtaagagttctcctattaacctcctgtcctcctcttccccactacttgtcaggtgtggaattggccaacagcacccaaatgtgacagctgactccagggagggaaggtgagccccacaccctgtgctcttaccgggactggtggattcctcctgttcagcctcattcttgctttgaccacaagtctcatagcccaggtcctggaggtccacctggacctgcttgctgtcctgcttcagcaagggttcacctgcgtgggaagagacagcaggtgttacagaatgtctgaatttcccacatatgccctgagcctcaatggcacataccctaaccttgtggggcagggagggcagatccacagtgcaagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccactgaagctggcaagtgctttatcagcaggggttcaataaatgttgaatgtaaaacatggctgattactttttattttcaatccaacaaatctccatttctggtgagaaaatcttgccaaaaccaaccaagcaaatgcataaaagtatatcaaaaagaaaatgaaagcttccctgcctcccaatcccacttgcttggtttcagctattatttattacatggaggaagggggctaggcacccaggaagtcccaagtcctgttctgacaatcatctggcctccctgggcaaagggaaaagagggaaggcaaaaagaatataacattactgtttgcagaaatttccccttggtacaggaaactctggtaaactgagagagtatgttttccatgagggaggcctcaagggctcttctctggccctaagcccaaactggattttgcctcattttctaagatgcaaaggaaatggtaaaagttgatcaaaggagagggcagagaaagaaagaggacgactcctccatctcaggtccaccttcctcggtgttgcttgagggatcagaggaaatgcatgaacagaggtgcgtgggaactacggctgctctgtgaactcagtgccctccagttacgagctattgtgaggttccatgatgtaatggcgagcgctttggactctgagtacggtgatcagcgttcaagtctcagtgggacctttctgtataatgccaatgatattcctattgctccctaagcggaatgggggaaattgccccagtcatggtcacccaccgtccaggccactggctgtgtgcaattggagtcctagacccagcgacccagcaagacccctcccctctcagggtgaccctgggcctccaggtgacaggtctcctccactgaaaaggctgcgtcccctcaatcctagaccctgagttttcttttatacatgtcattgggccattgccctgtgtctctttggaagaaatgacctatatgaaaaactttacttccgggattccctaattccttcatcccttaggacggcgcagtttttcagctcctggtcttggctccagttctaatgcacacgtttcattttattgtcatgggatcccctccaacaggctaccactggattcctgtccttggggtctctgtggatggcaaccagatgctgctcttgtcccagatcctgacacctctctccagggaattgcctcccttagcctcctaaatcagccaatatttagatttgggcctgggatcgcagcaactgtggagaacagaggttcccgatccctggccagcctcccgcagtgaaggggagaggagcacagcagctgggaggggcaagtctggggccctgggcaacccccttcttcctgcccagactctgctccaaggagcagttgccttaggaccagatcagatggaaactcttttgttctcttctcatcagcagaaaaatttaggcaagagctctggaggacgttcctagctcctaaaaatggtgtggccaaatctctccagttttggaaatgcccaaggttaccaagtattttgagggctcactttggagcctctgaaaaggaggggtgagggcccatggaaggtacctgagggatgcaggggagagaggggaaagagcagacaggagggaggagagaaggaaggaaggggagaaagggcgtgtgagggccaggagccaggattcaccctgacagttcagtgactgctcccttccaacaagcttcccactgtggcaccttctagcaggtggtttccatctcttattgatgtcctaagaccttggctctatggaacggttctgttctatttgtctggcatgagtcctggcaaagtttctttttcaccatttgggggatgagatgggggtatataggtttgcaagtgactaggagctaagtcaggaacttgtggagccactcagagtcaactgtcaagtagcctccttctcccattcccctgcaggacgattgcctgcaagacagggcctggagaaggccagggcacccaaggccacagaaatgcccagggatgagtcccggctggagatgccttggctgaactcactgtgtacttccagggtgcacagggcaggtactctgggggtctggccgggagactgagcaaggggaccagggaggttatgcagaagacttctgcacagcaaggcagacattcttcttggagcccccaacccaaatcaggtcttccacctcctcttcctaaagaccctttactgcagtcattcttttactagaactgcaagtttatagaacatagatttcagtgtgctcatctggccaaccatcttcagtggccaatgcccaaggtaacctccctccctaccaagacctgaactcagagccttacctaaggagaagatgtcctgttctttctttcccaccagaactgccctggcccagaccccatttctgtctggtgaccaggacagtcccctcaccagtctcccaggttggggagggcagattctcctcagctccctgcccctgagagaccccaacagccttgcgtggctccagcccacagagggctatccatggcccatatctctcaaaactctcccctcccactctgaatccaccctctactgcatgctcccctcacagaacagacatgggtttttttttgtgtcctcgttttgcctacccataccccagattgacttttctgtctcagaactacctgtccctctttggacagtgtcttcttggtactacacatgaagatgtcctgctctcccctgctcaaggagagagtgcctgacctgagctgggcccatcagatccagtacttacccggaataggaaaaagatggagagggtgaccaaagattacaaaaatctctgaagcttatccacttgagagagagtccctgaagatactggcctttcatttcctgctatgtatatccagtgtgactgaactctgaataacatatacaagttataataatgtagtagttggccctcaaactaggacacaaacatgttagagggtaaggtagtgagaggcatgtttgggggtggtggtgatgagcaagtatgtgaaggagagatagtgcctacgcttgaaaatcaaaaaggaataatatctatttagacataaggagataaataactaaatacttgcttctatgtgatgaaactctgggagtacacaaggggactgctgttttactaaacaaattttccagtctatataactttgataaggtatccaaataaaaaaattcctttcccatatatgtatgtgtatatatatgtatttgtatacacatatatgtttgcatttttgtattttgaatataaatttttatagagtcctgtgaacccctcttttcaattaggatttgagtttgatgtcatgcatgcaatgtgatcccactgtgtgactacagaaatgttggcaaaagtaagttcagaggaaatggtaggcaagtacttcccagttttggccagaagatggagaaaaaaagaattctcataaaatattaaaagtatgacttgttacagcttcttttcatagtaatttggatagaaattagcaaaatcagaaatgtataaatactttggtctgacaattccatctccaggtatctacggagaaatagacaagtgatgcacgacagatacatgtgtcagtctggtctctgcagttgtatttgtaataatacacattggaacaatgtcatggccatcggttagagaatgtttgaagaatgacccattcatatcaggaaggacgtttcaaagatcaaagcctgatggaaatgctggaggccgtgacgctgataggagctcatgcgtgttgaccaattgctacgtgacaggcattggctccacgcttttcctgcactgctcgtttaaacattggacaaattaagtgttctgatttagcccattagacagatagaaatggaagcacagaaaattaatgggtttatctttaaacgcgagcagattaggtttttcacccagggcctgtggcttcaccataggtgtgattcaggttctgttgttctccactttaggaattcccagtattccaaatatgagaagctgagaaaacaaacaaactcaaaactctaaaaaccgggataagtaagggtagatgtttgctgggtgtggattaataatgaactttttttgcctcaagcaacaaagaggcaccttggaaaatagacaagagacaagaagaggagaagcttgaagatatatttggtccaaggaagagactcttcagagggaagatcacatcagctagaaacattaatgcgactggatgggctcaaaccaccgacttttcagtcaacttccgacagcactaacctagtgttccagagaccctgcttgttaaacagtgaaagctgttgctcaattgtgtcatccataattgtcaaatattgtcatttagtagcacaaggaagtattctctgttgccaagctagagtacccataactcttctgttttgttgaacattcttccccaccacaaaccctctttagaagactggtggctcctaaaacattgaggccaacagacctgtccttgtgcatgtttgggcattgatccagggccaaatcagtgggagactcctccacgcacatgccaggtccccaggtgacaactgcagtctctggatctgaggtcatccactttcccattcctagctcacctcacccatcatgaagcctggttagtattgccagagacccgagtgggcaggtgcccgcactaaagacagaacctgctgtgtgcccactttgctgatccctccatctttctagacaaggctttgtgagccaaggactttgggtttgctcacaaggcagcccctcacctagtaggcattagttcattatgtatagtatacgtatatgtgtatgtatatgtatatgtatatgtatatgtatatgtatatgtatatgtgtatgtgtatgtgtatgtgtatgtgtatgtgtatgtgtatgtatgtgtatgtgtatgtgtatatgtatatgtatatgtagtcctcaggttgtattccttaaatatatataatatatgtaattccttaaatatataattttaatacaaaatttttaaaagattcctttcataaacatttacaataacaccaagaaatataaactacatagcaaagatgtgaaagccagccaggcgcagcttcaaatcctagcgcttaggaaggccgtggcaggagggtcgcttgagctcagaagcttgaaactagcttaggcaacatagtgagacctcatctctactgaaaatcagaaaaattatccggctgtggtggtgtgagcctgtagtcccaggtactcagtggatgaggccctaggatgtcatcggcctgagaattccatgctgcagtgagctgtgtgatcttgccactgtactccagcctgagtgaaagagtgagatcgtgtctagaaacaaaagaagaaaaaaaaaaaggtgtgaaagcctatatattgaagattaccatgtattactgagagcagttaaagacctttggaatagagaacgttccttcttgcatttcaagattgcttttgttttggggggacacttgctgttttttaggaacatgaagttcttctcaggcattcctgtaaaaaaagccactttttgataggattgtattgagtctgtggattgctttgagttgtatttttatcttaaccatgttacaacttccaacccatggacacaagatgtctttccattgatttaggtcttccttagtctcctcgagcaatgttctgtagttgtctgtgtacaagtactgcaccttcttgaacaaatttattcccaggcatattatccttacaggtgctattataaatgaaatcattgtgtcagtttacttctcagatagctcattgccatcacaatggattgtttgctgaaagtttgctgaattcacttattaactctgatagtgtgtgtgtgtgtgtgtgtgtgtgtgtgtgtgtgtctggtgtctgtgtgcatgtatgtgtgtttgcctttgtatgtattgtttgggattttctatgcataggatcacaccatctgcaaattgagatcattttgttttctgttcaaaaatattttttctcatgtttatttttgaaagataatttggccaggtgtagacttgtaggtgacagtttttctttttttaagtactttattgcaaacttcttgtttgtaaaatttcctatgagaaatcttatgccatccttatatttagtgctctgtatgtaacatgttcttttcccttttattacttttaggatttcctttttatcactggttttgatggatttgattaaggtgttccttggtgaagttttctgcatgtttcttgttcttgggataatcatatttctgtaatatttgaagtttatgatttctatggagcttctaaatctttcatccagtatgttttaaatatctttttctctcttctccactacctgcccttcagggattccatttagccctatactggggggtttaaagttttgatgctgatggtctttatatgttttcaagtcatttgttaatgtgtgtttcatttatgttagtttcaacttctattccttctagtttaataatcttctcttctgcaatatttaatccagtgccttcttccatttcacactgtaaatcatagtttttatctacagaatttgatatttaaaaaatcttcaacctctccatttaattaaaatacaattatactaattgcggtaacgtccttttcttctatttccaacgtgtgtgtcaatttcaaccagattattagattcttcagtatgtgtcatgttttcctgcttctttgactgcttgatattcttttatttttatttatttgtttttggggggatggagtttcactctcgttgcccagtctggagtgcaattgtgtgatctcagctcactgcaacctctgcctcccaggtactcaagcgattctcctgtctccgcctcccaagtagctcagattacaggcatgcaccatcatgcccagctaaactttttgtgtttagtagagacagggcttcaccatgctagtcaggctggtcgtgaactcctgacctcaggtgatccacccggctgcttgatattctaagatttgatgctggagctttggtgtcaatgctcaaaagtgcccaaagacaccactcaacctcagtgtctatgcacacccaagcttttgcaacaggagaggtagagacagcagagatgaatgtgctacaacatgctggtagaaggtaccccaattgtgcttggggcttcctatgcctcatagaataatgtgccttccttaatttttcccataagaaccaccctacttcatgccctgtctctctgtccaaacaccaggacagccctcagaccagtctcaaccacccaatggattgacaaaggtccaaatatgattcagtggagaaggcattctcttgtcaacaaattgtgtagaaacaactggacatgcatatccccaaaggaaaaagattcacctgaacctcaatactgactcaaaaactaactcaaaatggattatgcaactaaatataaactataaaagtagaaaaagtatagcaggaaatataagacaaaatcttcacgacgcagttaggcaaagtgttctttgttatcaagaaacacaaaccattaaagaaaacattgataaattcaactttataaaaagtaaaagtttttgctcaacacgagacagtattaagagaacaaatataagctgcagattgggagaaaaacaggggaaatgacaaatgtgacaaaggacaagtgtgatagttacttgcacgtgtcactgtgactgagcaccagggtgccgggacattcggccaaatgtgattctggttgtgttccagagagtgtttcacatatgattaacatcgggatgggcagactaagtgaagcagattgccccccttaacgggggtgggactcatgcaatcaatcaaaggtcaggagagaattaagaggcctaatgggaaacaaatgctttcctgggtatccagctttccttccatcttgggaatttcagcctccataatctcagaaacaaattcacatatgtatacacacacatatacatttcataggtatgtggctaagattgtatttttaaaagttcagccatgagatgattggtgaagccagccaatgaataagggtgtgttctattatatgactcagtcttcttttgtacacgattgaagttctgcatttgaagtaggaggacaggagagagcaagtccacctaggatgataacagctgaatttctcaacagacacttcaaagccctaggcgttaacttagagagtcaaaaatcccacccataaccctgcccctaaacgccagggctagggaacactgtggccctcaggtgattttgtttcacttggtctgggagccacacaagggcagagggagcaggaaacactaagcaaatcgaggccaggacagcagggagggcctgttcatgacagaacacaggtaaaactatcctcagaaagagcatgtggagaaacacagatcatgcctgagacctggtggattagagcactggctactggggaattgaaaggaaggggcttcaccatgcagaggaccagaggtgccagtcttggaaacgcagaattgctgggagatggggaggcatggacaaaggaagcatcctctggagactcatggtgaagagaacaaatgaagtaactggcagaaattataggtcctggtagaacaaaatagaatcccacaatgagaacatacagcatgtatgtcccgcaaggaagacaatagctcctaaaaatgcaagaaaaatcattttgggcaaacaccttatatccagtaatgcgatccatgtatcaagaccacgaggaagattattaaacatgctaaactcagcgagacctgattccctcatgaggactctgttaaggatgagtaccactcagcaagtgatgactgtgacattcacttttgaacagctcatgagcattaatatatttaattgtggatctaaaccaaaaaccaaggtgtgggcaagatgacaaccacagaatgtcactggcatatgtttaggttcaaataccattatgagaagtggcaggtaaaggaggtaggaaaaagaaaacacatcatgtaactgactgtcatatggaaatatttgacgttgaaagtcataatttaaaatgtataaaccaaatattagaagtgtgtctagttcaaaggggggaaaactatgaaacatttttaatcaatatcaaacatgagctacacaacccttcctaaatgccagaggcacacacagacacacacacacacactctcacaaagaatataaatatctagaaccaagaaatggagtaaatgcattctgctacatatggtaaacatagcctacaaggtggaagagattagaaaataaacagggaaatggaaatgtttttattaattcacatcagtacccaccaaaaccaatcagcataacaaaagattataacactgaatgtaaaaaacaatccaacagtccagagtgataggcaaaagcttttaattgtatagattaaaataactttggacaaaaattaaaactcaggcagagaatgttttttttttcaacaacacacactagcaaaaacaaaggcacagtaaacattgaggcagaaagtttccagcgtagagatatgaatataataatagacacaggcagggatgattaataaatgataaaatgtttacaggatgatcattggaatacaggacatttctaattttgaaaaccaccctcccaaatacttcattataagtaaggtgtctctaaaagggacagatctcctagacccctccttaaccaagtaaccagtcctgatatcatgataatgctgatggacaaactagaccttctctgcccgcagatgggctaaggttggaaactcacagcattgtctctgcagtgttcccggcaaaacgtttaggctgaatttaatcatgaagacattttcagacaacttcagaatgtagatcattgagccagagagctgacctgtcctctataaacaagtccatgtcaccaccatcaatgacaacaacaaaaagatgaggaaatatttggggttcaaaataactaaagaaatgcagctatattatctttttactttttttgaacccaaaatatctcttctcctttttgttgtgtgatttgtggtgatatggactatgtgaaggagacaggtcagttgtcctgctcagtgttctacattctgcagttgtctggtaattacctcctatgaaactcaggctaagcgttttctgcaagaacatggcgttgttcatattctgcaccggcagagtcctgggtgacatgctgtctcctgccagcggctcctgactcctgttctctacaggatggaatcgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttaaagatggatcagctaaaacaattcaacactgaagatacaaagaatgaggttaggttcattgaaaccagggtaacacctttggatgagctaaacacaaagatgacactgaccttgagcaggtatagaagctcagagacatgactgcaaaatgaaatccctgaggaactttgtagctacccagagataagtggttcaaattaaaatgtctgactgatcactcccggcatgtgctgcacagttatgtgaacgtgtcacacctaacttgggtccattgtcttcagactgagcacagggtgccactggcatggtctgagaataggaatagagccatgcccactgacccatcctatgtctgggcttccaaatggaactatagtttcattcaaatcttcacgtgcctataggtcctgcctgcaggaatgacatctctcggcttagtaagggctgcttactgtgggaatatgactcccatctggaagaccaggtggagacttgttcccatcaaagtaagaaacctattgtccacgtcaagggcgaagctgatgtgctgttcctcaaatgagtaaaacacacttctgtagtgctggaatgagtcaggtagttcaaagtacattgacggagtcgaataacatctatccagtgagtcctgcaagacttcaggctcttccacttccatcagcatgccgctgagcctggaaaagcagacaaaactaaagaagcagccagggaaaatcagacaccacagagccccactagatttcagaagtaacgtaaggaagtggtaagaaaagaaaaggatagatccattagatccattaatgaggtaaaaaaaaaaaattattgcctttatgttgggatagaaaagggccaggtagaaaacaatgaaagagaaagacagagagacagagacagagacagagacagagagaaagtgagctagtgaattggccaggtgacatactggtaagggagtaaaaggacactctgagttagtgccctcatgacacacagcacactgcgatcatgaaaagagtgagctcaatagttttccataaaatatgctcaaaattcgatgcagtggccatgagagtacagcttttgaagtatggtcatcctatggtacgttagtaaatgataaggggaggaagaaatggaaacctaaacatctactgcaatgaaaaccaacagcaatgacagtaggagtaattcagccttcgttgaaaacatgaaatcaaacacactctggtttccctcaatctgttgcctccaggtgttaacacagaattaagcatccacaattgctgaaagttacctggggcatggtgggttttgatcttcttccccttcttttcttccccttctccttcttttcttcgttgatcttcttccccttcttttcttccccttccccttcttttcaatttctgcaataaattcagacatggacagacacattaagctgattcccctacacacataacaatccactgtctaaccctcacacagggacctcaggctcctcagcataagaataggagactgtgagagatatatttcaggaggcctgaaggctggtcatgatagaaattcctcggtttttctcccagaaactgtgggtaaaatgtccctattctagtagatcgttatcccaatatcatttgtcccgagtttgtgcaaacagttatgccatatttttccaatcaatttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagagtagaatcagagtgccacaggcatggcctgagactaggaagagagccatgctcactgacccatcccatgtctgggcttccagttagaactagagtttcattcaacctacatgtgcctataggtcctcactgcagcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggcaggcaggagtcaggctgttcaagacaactggaaggagttgaataacatctatccagtgagtcctgcaagacttcaggctctactgcctccagcagctccctgctgagcctggaaaagtaggaaaaagtaaagaataagccagggggaatcagaaaccacacagccccagctacatttcatggctaacataaggaactgtttaaacagaaaaaggacagatccattaatgaggtaatgaattattgcctttatgttgggatagaccagggccaggtagaaaagaatgaaagagaaagacagggagagggagagggagagagagacagaggagaaagtgagctcagcgaattggccgggtgacacactgacgaaggggtcaaaggacactctgagttagtgccctcgggacacacagagaacagtgatcatgaaaagagtgggctcaataattttccataaacttgcttaagattccatgcagttgccatacagcctttgaggtatggtcaacctacagtaagttagtaaatgataaggggaggaagaaatggaaacctaaacatctactgcaaggaaaaccaacagcaatgtcagtaggagtaattcaaccttcgttgaaaacatgaaattgaacatactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacgcagggacttcaggctcctcagcatgagaataggacactgtgagagatcttcttcaggaggcctgaaggctgatcatgatagagattcctgggtttttgtcccagaaactgtgggtaaaattccctattctggtagatcgttatcccaagatcatttgtcccaagtttgtgcaaatggttatgccatatttttccaatcgatttaaagcaaatgcccccaaatggttgctgggagaaaaactgcaatattcagccctgtctcatcaaatactcagattcttcatggtagcgaggattttagatgctgaaattagagtgaaggatgaaatctacaagatctacaaaattgagacaaaatcagagttgtgtgaatttgtcacatctgcccagatccaacatcttgagagtgggattagggtgccacaggcatggcctgagactaggaagagagccctgctcactgacccatcccttgcctgggcttccaagtggaactagagtttcattcaacctacatgtgcctataggtcctccctgtggcaatgacatctctcagctcagtaagggccatttgcagtaggaatatgaccctaaccagaagactcagtggatccttatcaccttcatagaaaggtactcaccatccatgtcaagagcccagccaacacgctgttgctccaatatgtaaaaggcacttctgtagggctggcatgagtcagtcagttcaagataacctgaaggagttgaataacatctatccagtgagtcctgcaagacttcaggccctttctcatccagcagctccctgctgagcctggaacagtgggaaaaagtaaagaataagccagggggaatcagaaaccacacagccccagctagatttcatggctaacataaggaagagtttgaaaagaaaaaggacagatccattaatgaggtaacaaattattgcctttatattgggatagactagggccaggtagaaaaggatgaaagagaaagacacacacacacacacacacacacacacacacacacacacacacacagagtgagctcagtgaattggccaggtgacacactgatgagggagtcaacggtcattctctatttgtgctctcaggacacacagtgaacagtgatcatgaaaagcatggcctcaataattttgcataaaatgtgctcaagtttccctgcagccaccatgagaatacagcttttgaggtatggtcaaccttcactaggttagtaaatgataagggtaggaagaaatggaaacctaaacatttactctaatgagaaccaaaaagcaatgtagtaggcataatttagacttgtctgacaagacaaaatcattattttcagcatgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacaggtacatcagtctggtcagtgtgagaacaggagactttgagagaaatattccagcaggcctgaggtcaagtcttgagaaaactggcttgggttctttcatgagccttgggcaaaattaccctgttttggaatgttatcttccctatgtgctctgtcctaggtttgtgtacacaaatgagcaactttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgacggacagatgagctaaagcaagcgaacttagaagacacagaaaatgggaataaattcagtgaaacctgggccacatctttcactgagaggtagacaagggtgacacttgccttgggcaggtaaagaaccacacagacatgctttgggaacaaaactcataaggaattttgtagctggcaagagacatttaattcagatgagctgatctgacagacaactcctggtcatgtgctgcatagtttggtgtgagcttgccacacctgccttgagttcaatgtcgtgacagtcagtccaggttggcacgggcatggcctgagactaggaagagagcaaagctcactcacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcaccgcctatgtcaacagccatgcagacttgctgttcctctaatgagtgaaatgtgccgctgtaagacttgtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactagccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacacagtgcagacacagatcttgtgtattaagggccccattttcccaatattttgatataatatatttaccttttcaatttcttttcttgcaaaaatactagccaacatactaccaacagataggaagaaagcatatatacatctctccctggatttaaacacatgggagagaataggcaacaccaagaaatccctgtttgagggtctggagtggacttccagcaaactccaacagacctgaagctgagggacctgattgttagaaggaaaactaacacacagaaaggaatagcatcaacatcaacaaaaaagacatccatcccaaaaccccatctgtaggtcgccatcatcaaagaccaagggtagataaaaccacaaaggtggggagaaaccagagcacaaaagctgaaaattccaaaaacctgacatcccttctcctccaaaggatcacagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggccaaccagaatgaacagtgtagagaagaccttaaatgacctgatggagctgaaaaccatggcacgagaactacgtgatgcatgcacaagcttcagtagtcaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgcactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagtgcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatgtatatatatttttcaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttccccttcctgtgtccatgtgttctcattgttcaattcccacctgtgagtaagaacatgcggtatttcgttttttgtccttgcgatagtttgctgagaatgatggtttccagcttcatccatgcccctacaaaggacatgaactcatcattttttatagctgcatagtattccatgttgtatatgtgccacattttcttaatccagtctatcattgctggatatttggcttggttccaagtctttgctattgtgaatagtgccacaataaacatatgtgtgcatgtgtctttacaacagcatgatttataatcctttgggtatacacccagtaatgggatggctgggtcaaatggtatttctagttctagatccctgaggaattgccacactgtcttccacaatcgttgaactagtttacactcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaaccggtaccagccactgcaaaaacatgccaaactgtaaagaccattgacgctaggaagaaactgcatcaactaacgggcgaaataaccagctaacatcataacgacaggctcaaattcacacataacaatattaaccttaaatgtaaatgggctaaatgccccagttaaaaaacacagaatggcaaattggacaaagagtcaagacccatcagtgtgctgtactcaggaaacccatctcacatgcagagacacacataggctcaaaataaagggatggaggaagatctaccaagcaaatggaaagcaaaaaaatgcaggggttgcaatcctagtctctgataaaacagactttaaaccaacaaagatcaaaagagacaaagaaggccactacataatggtaaagggatcaattcaacaagaagagttaactatcctaaatatatatgcaccctatacgggagcacccagattcataaagcaagtcctgagagacctacaaagagatttagactccacacaatcataatgggagactttaacaccccactgtcaatattagacagatcaatgagacagaagctttacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaaccacaacaaactgtcagaccacagtgcaatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagacacaacataccagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagacacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaccaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtccattttctaagagtgttgctgcaatacggacttatatcaccagataacatggacattaaatgtttagaggcatctatacatgaaacacacatgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgcaactgcactctagcctgggtgacagagcaagactccatcgcaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttccgtcctgatttcagggtgactgtgcagctaagcaagctgacttaaaggagatccggatgaaagctgagagcagtgaagcctggggaacaatatttccaaatacaaaggcaaggctgccagcttcctgaaacaggcatagaaactccatggacattgttcagggacagatgacttaatcacagatgacaagagatactgaatcgaagctaggaggcctgacagatactgcctgtgcacctcctgcactcaggtgactatgagattgtcacacttgcctggggtcgagtaacttgatactggggactggcagacaaaggcatgacattagctgagaaggacaaaaaaactccctgatatctgtttagaaacccatcatagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttcggcatctccctgatgagccaggtgggacagagatgacagaagattaaacacagagggattggaccccagggagtcctagctggttttgacaggcggcattaagagagtggtcccagaaagcaaaatggaggttccctttaagggggaacatgcaatcctgttctctctgcaacagagcatggctgccatgggaaccagagaggaagagagcagctggtgttcattgcagtggacagataggagctgaggaggatgaagactcagctatccctgtatggtgcagacatgacactcggcacacatagagaaacatgacagctgccgcaccctgtgtctaagctgggttatatttcacatactgtggccaagcaaatgcgggtttttggcccatcatagatgccagagagggtgtacctcctagatattcttcatatgttaccatccattacttgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggactttggcagctgtcgcccccatcctgccagatctgattcccaggcacaggcttggtgtcctgtcacagtttgcatttcaaacctaattctttctcttagaagcagacaaacttatcccacagtcctctatgcatcagaagatttcaagcctccaagtggcttctgctgtgttattcagggacattctatccatggggagtgctccagtctgaagcacttcctaccacgaaacgccaccacataaagtgccttctccaacatcacacggcgaggggcttcatctcattttggaaagcagttttaagtgttcccacatttgaatgcttcagacccttgcaagagacaatttgccatggagagagagaaactcaggaaagacaagtcattcagtcactgacagttactaagaacattgccgaaaagacaccctgggaaccttcattcttagtccagagctcttttcactctaacaagcctgctcctatcgcagcctccttcctgtcctttaaaactagatagatgctgcctcttactccaaagacaaccttccatcaagggaggagggacaattgcaatactgtgacctccaaccccatgggtttcccaactccgttcttacccaggaagtcctggtcatgtcatggccacataagcttagtggcaaaaaacaccattgatacaactgtcattgtgaaagtatggaggtctggagtctctcataagcctggggttttgggtcatcagggcctatggccaccttacctgggctgagcttttggacaaggtgctgtgccagtctacacccctcagccagctgttcttggaggtcctgcccctgggacttgtctggctcatccggagtgaggagggcctggagatgctgattcaatgagcaggaggcatctctcccttcccgtaacttctcccttaactgggtcagctctcgttcctgagagtgaaccaggactttatattgcctaaggtgagacggtagagaaaatttaagagtggaaagggttgagtgatccgctcaaatattgcaacagagatttctgagacaatgtcctcaaggagacctccaagcagaaggtcagcacatgttggaaggaatgtctgtggctaagagaaagaatagaaaatggtttacaggtttcctctgtatcagagagggctcctgcaagatcctcgatgatgttccattcatctttcccttctgtaaacaaaagtaggtgtcttcctaattccatttcaaaaagacatcctttcagtccctcactctggccatggacatttccatgtgaaaatacacatagtgcatcttgcggccactagatacaaagccatgtacagaaatgaggccaggtgcagatggggcgaattgaaaagatgaaagaagaaaagaatgacagggtcgagaaggcaacattgattgagtgaaagaatgagaagacgcagtcagtcagaaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccataaatttttattatccttcttctctgcttgataaatacttgtgtgttgcgagcctgccatggcaattcctgcccttcccctggcccagcttagttcttaagtctccccactgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgaggtctttgcactcttcattttctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagagaacctcaatggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgatggtttcccttttactgggaatttcaaggacaagtatgcaaaagattttaaaaatctttgatttttaaatcatatcttcagttatgattttaagaatcatatctgaagcataaagtgtgacacataacaccataaggccatgaaggaaatatgcccaaatgttaataaagtttgtgttaatttagaaacagcagaatgaagaactaatagatagtgtttactgtgtgctaataaatgttctaggagattgacaagaaatagctcatgtaattcactgcagcaatttacagaggtaggtattattgtagtaccctctgaacaggtgaggaaacagggacagaaaagacaagcaacttggatggagcccaggagacaggcccacggtctctgctctgtacactgcactgctatctccacacattctcgggtgcgatctttcttcctctttaggaacaagactctgtgccccaggaagcaggacttcactctcaccaagctacattctgcttcttattcttatttttatttatcattattagtattatttttttaacagtcttgccctgtcgcccaggctggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgtttcccaggctggtctcaaactcctgacctcgtgctctacccgcctcagcctcccaaagggctgggattacaggagtgagccaccatgcacagcccctactccctgctcttgatgctgtcacttatagatagcacaggttctattaggagcagactcctcttgaagcccctcagagcaggtactggctactatcaccaagtttccctcagagtcactagaacagagctttgcatattgggcctcaacagaaacttgaactgaataaaagttcactagtctcagacatttagaacaacagactagatgttatttgtctgcaggatcttacatggtacagagaggattcttgaaaacatgattgagcctcttggagaaaacaggtcattctgtgcctgtgtcagaaatcaataaatggcagtttaactctagtcccacccccacctgattgcaaacatggaaagttgctaaatattttgggacctctgtcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagcggcagccttgtctacttatttgaagatgatgtttccctggtttcactcttgtcatctccagtcttgatctcctttaagtcaacttatcttagctatgcagtcaccttgaaaccaggacataaacacttctacacttttcttgcttataagtttctataaagcaaggcttggccctgagatttttaccccatgagtggccaatgtttctgtgtagcacaaaaggtttcattttgcctttttaatttttttcttttttggttttttgttttttgtttgagacggagtctcactctgtcacgcaggctgcagtgcagaggcacaatctcagctcactgccacctctgcctcccgggttcaagcgattctcatccctcagcctgccaaacatctgggattacaagcgccaagtaacatgccagctaatttttgtatttttagtagagatggggtttcgccatcttggacaggctggtttcgaactcctgacctcaggtgttccgcccaccttggcctcccaaagtgctgggattaagatgtgagccagcacccccggtcagagacttttttttttttttttgagatggagtctcgctctgtctcccaggctggagtgcagtggcacaatctaggctcactgcaaactccggttcctgggttcatgccattctcctgccacagcctcccgagtagctgggactacaggtgcccaacaccgtgcccagctaattttttttttttgtatttttagtaacgacggggtttcaccgtgttagccaggatggtctcgatctcctgacctcgtgatccacccgccccagcctccgaaagttctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaacaatatgtgcgtatacagcctgtcctcagaattgatcttccatagcctagacagaggtatgagacacaaggaaaatagaggctacctgggagaatgtttacagcatcctgacattcatcatgagaggattctctgtctacaaccagagctgagttgactttgtcttcctcaaaggtgatgttgatgttcttgtgaggctggttggagtcacaagggccgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccacaccctgtgtctaagctgggttgaatttcacatactgtggccaagcgaatgcgggcttttggcccatcatagatgccagagagggtgtgcctcctagacattttcatatgttaccacccattacttgctcctgagtattcagtgttacctgggggcagatgattccagtactttctcagcctcctcaacttgaacatcttcatcctcatcttcgtcattttctgtaaatacaaaatgttcgttcagatatttcccacttcccattctccaagcacagtcagcccaatgtgcacagagacatgaacatctatgtgtggttcagcattgtactgaaaactgtcatgttttatctttcacaaaatgccctggcatggtttcctggtccatcgggcaatgcatttctgatctggagggccaccatcaagatgtggccaaatattgaaaagaccttttgcttcccatatcactggaggcttgtgcagcctctctctggactttggcagctgtctcccccatcctgccacagatctgattcccaggaacaggtttggtgtcctgtcacagttcgcatttcaaacctcattctttctcttaggagaggacaaacttgtcccacagtcctctatgtgtcatgagactgcacaggccctccatgtggcttctgctgtgttattcagggacattctatccatggggagtgctccagtctgaagcacttcctaccaccaaatgcccccacatcaagtgccttctccaacaccaaacggagaggggctgcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgccaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtgtagcagaaaataaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaataatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcaacttgcagccactagatacaaagccatgtacagaaatgaggccaggtgcagatggggcgaattgaaaagacgaaagaagaaaagaatgacagggtcaagaaggcaacattgattgagtgaaagaatgagaagacgcagtcagtcagaaggtggttctcactaagggtaagtggggtggtgatggcacaccattttgagtatactgagtgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccccacctgcccccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagggaacctcaagggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggtcatgaaggaaatatgcccaaatgctaataaagtttgtgttaatttagaaacagcagaatgaagaactaatagatagtgtttactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccacggtctctgctctgtacactgcactgctacctccacacattctcaggtgcgatctttcttcctctttaggaacaagactctgtgccccaggaagcaggacttcactctcaccaagctacactctgcttcttattcttatttttatttatcattattattattattattattattattatttttaccagtcttgccctgtcacccagagtggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgttgcccaggctggtctcaaactcctgaccttgtgatctgcccgcctcagcctcccaaagggctgggattacaggagtgagccaccatgcacagcccctactccctgctcttgatgctgtcacttatagatagcacaggttctattaggagcagactcctcttgaagcccctcagagcgggtactggctactatcaccaagtttccctcagagtcactagaacagagctgtgcctgttgggcctcaacagaaacttgaactgaataaaagttcactagtctcagacatttagaacaacagactagatgttatttgtctgcaggatcttacatggtacagagaggattcttggaaacatgattgagcctcttggagaaaacaggtcattctgtgcctgtgtcagaaatcaataaatggcagtttaactctagtcccacccccacctgattgcaaacatggaaagttgctaaatactttggtacctctctcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagtggcagccttgtctacttatttgaaaatgttgtttccctggtttcactcttgtcatctccagtcttgatctcctttaagtcaacttgtcttagctatgcagtcaccttgaaaccaggacataaacacttctacacttttcttgcttataagtttctataaagcaaggctgggccctgagatttttaccccatgagtggccaatgtttctgtgtagcacaaaagattgcattttcctttttcgatatttttctcttttggttttttgttttttgtttgagacggagtctcactctgtcacgcaggctgcagtgcagtggcgcaatctcagctcactgccacctctgcctcccgggttcaagtgattctcatccctcagcctgccaaacatctgggattacaagcgccaagtaacatgccagctaatttttgcatttttagtagagattgggtttcgccatcttggacaggctggtttcgaactcctgacctcaggtgttccgcccaccttggcctcccaaagtgctgggattaagatgtgagccagcacccccggtcagagactttttttttttttttttttgagatggagtctcgctctgtctcccaggctggagtgcagtggcacaatctaggctcactgcaagctccggttcctgggttcatgccattctcctgccacagcctcccgagtagctgggactacaggcgcccaacaccgtgcccagctaattttttttttttgtatttttagtaacgacggggtttcaccgtgttagccaggatggtctcgatctcctgacctcgtgatccacccgccccggcctcccaaagtgctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaagaataacaatatgtgtatatacagcctgtcctcagaattgatcttccatagcctagacagaggtatgagacacaaggaaaatagaggctacctgggagaatgtttacagcatcctgacattcatcatgagaggattctctgtctacaaccagagttgagttgactttgtcttcctcaaaggtgatgttgatgttcttgtgaggctggttggagtcacaagggctgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagcgaatgcgggcttttggcccatcatagatgccagagagggtgtgcctcctacacattttcatatgttaccacccattacttgctcccgagtattcagtgttacctgggggcagatgattccagtactttctcagcctcctcaacttgaacatcttcatcctcatcttcgtcattttctgtaaatacaaaatgttcgttcagatatttcccacttcacattctgcaagcacagtcagcccaatgtgcacagagacatgaacatctatgtatggttcagcactgtactgaaaactgtcatattttatctttcacaaaatgccctggcatggtttcctggtccatcgggcaatgcatttctgatctggagggccaccatcaagatgtggtcaaatattgaaaagaccttttgcttcccatatcactggaggcttgtgcagcctctctctggactttggcagctgtcgcccccatcctgccacatatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccacggggagtgctccagtctgaagcacttcctaccaccaaatgcccctacaccaagtgccttctccaacaccaaacggagaggggcttcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgtcaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtatagcagaaaaaaaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaagaatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaattgaaaagacgaaagaagaaaagaatgacagggtcgagaaggcaacattgattgagtgaaagaatgagaagacgcagtcagtcagaaggtgattctcactaagggtaagtggggtggcgatggcacaccattttgagtatactgaatgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccctgcctgcccccatggggtcccctcacctgagctcctcagcttgcttgagctgctctgcaagcttctcctccttgaactgtcgctcattcctcagcataaattttatgaggtctttacactcttcatactctgagaaaagacagacacgcctgcctcagtggaaggctggacatgctgctgtggtcactgcctacagggcagaagccaggtccatcccaaggacaaaactgtcccccgtaccaggctctaggcagggatttccacatctttactcttcagtctcctgactttctggcatcttatcctccaaaatttaaagacgaagaaagagaaattcaaggcacatcaaggaagttgacaagatgattcaaccacaacgaagtggagtcagaactcacagcccctgaggtctgactctgaatgcggggccactttcccaagacttgcagcctctcctctgaaacactgcactggggcatgaagtagtgatttcttgtacagttgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggccatgaaggaaatatgcccaaatattttattagtatgacaggcagcatcaagatttagattagttgtgttaatttagaaacagcataagattagtttgtgttaatttagaaacatcagaatgaagaactaatagatagtgtttacactgtgccaattaatgttcaaggagattgacaggaaatacctcatgtaattcattgcagcaatttacagaggtaggtattattgtagtaccctctgaacagatgaggaaactgagggacagacaagacaagcaacttggatggagcccaggagacaggctgagggtccctgctttgcacactgcactgctgcttccacacattctcgggtgtgatctttcttcctctttaggaacaagagcctgtgcaccaggaagcaggacttcactctcaccaaggtactctctgctttttatttttatttttgttttatttatctttttgtttgtttgttttttgatgagtcttgccctgtcacccatgctggagtgcaatagtgcaatcttggctcactgcaacatctgcctgctgggttcaaaggattcttctgcctcagcctcccgattagtggtgattacagttgcccgccacgacgcccatctactttttgtatttttagtggagatggggtttctccatgttgcccaggctagtctcaaactcctcacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacagagccttgcctgttgggcctcaacagaaacttgaactgaataaaagttcactagtctcagacatttagaacaacagactagatgttatttgtctgcaggatcttatatggtacagagaggattcttgaaaacatgattgagcctcttggagaaaacaggtcgttctgtgtctgtgttagaaatcaataactgtgagtttaactctagtcccacccccacctgattgcaaacatggaaagttgctaaatactttggtacctctgtcttccaactttaacaaaatgttaaaatacccatttctgttttcctagaagtacaggaaggatgaaattatttttgatggagagagcatttagtgtctcagagagaagacaggacatcattcatcactttcatgatggtgagcctatagatcttactgtatttcttctgtcggttggccaggaagccggccagttgagttacaaaacatttctctttgaggtttctgaactgctgtttgttctctgccagctgggggcgcaatttctcgttgatttctaaaatgttcgtctctgccttctcgctggaccaagggccagctgataccaccatgctgacgtttgtggcagaagaggtggagccagggactggggagaagaaacccaaacatatgatgggttaaaaactggtgaaatcaaataggtttaatcaggactgagggatgtcagtaactgaaattcttaacttactgttgtgaaaaatgtgatcactccccacagcactttaggatccttcaccacaaaaacaaggttcgaggtgcctgaactcagagctgaaagcactgccagtagctcagactctgataagagtgaggtagactgtggccagcgtgccaggtaaccgtctgcagttgcaataacagaattagaaggtgggggtgtcatggaatcttaggagccctgcattccaattgcccaggctttcctgaaacacaggcaccctagtctcacctgagggtcaccaccaatggggatcattccttcagcattcactctcagtattcgtgtacccttgtgatgatgccacagacccgtgtctttcccaatacatctaagcatattcctcactgtttatctcttgtctgtacaacatcatcaaggcagaaacagtttcccaacaggttgtattttcttaatggtagtcatgaagtcaccccacctgctctcagttaaaacagagcttaaggcctttccacaggtgtaagatatcaaacttttagcctgccctgatttcctctgggtcttctgcagttttgtctgtatccactagaaagtgaatgaataattcatttgtaaaaaatgttgtctttcctgtctcagtattcttcttgctgtttcccattgttatgttgatttcttttttctcactggggcaccatctttgcttttcattacactctagaccagtttgacatccctatgtccagagctcttcctctatgtgggttgatttggtttttgatgtcactgagcgctacattttatacttgtcacttatggatgtcattctagtgtcacaagagctcttttcaaggtatcaagtgatcaaaatcatttatatagagatctcctgaaaacatgtgtgaccatctatcttgggaagtttcataaacctgatgctattttgttgtttccattttgttttcccatatactgaaaagaacagggccatgagcggttcttatgcaatatggtttgatatatattttgttgagatgacctaacaccattgattttgggttgcattccactaacagaacatggcaagatcaaggttatggtcacggttggttggtgatcctcagtgttgcagtagaaggtgagtttgagatgagaggaatgagtaggaaagagtgatcccctgaaccacctcctcgctttctcagctttcaccccacctaggttttgtgagcctggaacttgggagactgttctgtagcccaggtctcctaagattggctgctggacttgcctgagttgagggtgcggtgggttgaccctgggctgcccagcattcatgtggtagtgaaggaaggaggactggatcaatcccatttcaaagcatgtctctctgcactccacactgtcctccaatgacactgtaaggaaaccgctttaagacgtatcaacggctttaagtaaatgtattttctggcatctgggagacctgacattctgtgtcataatgaaaatctgtcatgtttctttattttaaaaatgataaaactgcaggttcacagagttacatggcttacttgaggtcacacggggatgagttttcagcactgccaataaaagcaatcacatgaattattcagtaattattcataggatccatataattcagtaaatattcacataattatttactagttgttcattgaccaattcgtacaaggcattttgctcaaaactgtgtttatatttggacattgtatcttcatcataatcctgtggtaatgctgttatccgtaagtaacaggtaagaaacctgaagaggagggatagcaaatcatgtatttggacatatttcctttttttttttttggtttttgtgatgctggaagaatgaccagaatgagtcataggaagagtatacattcctgtagtattttccaggacagaggtgtgacctcctagagtactgggaccaaaattcccaagtgtctgcaaccttgctttaacagtatgggagatcacctctatcacctggaattcccctggaactctggaatatacaagagaagtatgagacttgggtcttcccttggctgtgtttaattcactcttctatggaataccaatgattctcactaagactggccttttcataagcacaatgtgcattttatggagaagattttacactttgctctatttagaaagaataaatatgagcagtggtttaggttttatgccctggacttaatatgtttctgattcctgttttgagattaaattctcatgtaaatagaaaaatacttattatttctcataaggccaagtttgttattagtttgagtttttgaagatgaagcacaaacttttgattttatctttgtctgtctctgtcagcgccactcgttgtctctcagtatgacctggacttgcccctgcacttacccttgtcctgctgaaccatctccatgcactgtccaattccatcagtgattcgggctccttccaaggctccctgaaaagggcacagagatcaggacattaggcacattccggacacaaaggcaacccatactgtagagtgggcagctgtgtttccacttccctaatattccagtgatgtcctcaaactgaaaggaacactttccctttttaggggtctgttcttcatgtctcagtgcctctgatctagtcaacacaactgtcctgaatgtgaaagaacttgctaaatttctagtttcttgttaggtggctaaaatagatttataagacttccttacttacccatgactgctgaagtttgaattcttagcagtacgattcgttttcttgtaaggtgagcagcttaggaaagattggccatcttcctgtgcaaaaagaggcaaacttaatttctactcaaagcatgcttgaatttggaatcagggcttccactcttccgaagttggagtgtcactgcgacaggcatgtgtcccgaagggctcgtgtctctgctatactcaaagtttaaatggagcccagcaagccagatgtcctttacttctaggttccctcaacagtttctcctccgctttagagaccgcattgaaaatattcttgttctgctgttgtgttttggctttggaatgatgtgatgcagctcaatgggtcccacccccaacttgatcaaagtaagaaacagctgggaaagtcagtgcaaatacaagttcattgtcctccttgcagggattctgattcagagggctcaggtggggcctggaatgtttgttaacatgactcagatgtgcagtcaatttggggactcactgacagcattgaccttacagtttatgggatgattctttctgtttggtgatgaagaaactgaggcacacagagtctgtaacttgcccaagttccccttgttgtaagtcctggagccagatctcaggtggaccagtgcttctctcccctatacctcatttctgagaaaaggaaatcttctgcaatttgacttctttcatctaacacatttcctcacaacatgcagccagcatcatattttggccacttactattaaagtgagatgcttttttttttttttttttgagacagggtcttattctgtcacccagggtggagtgcactggtgattatagatcacggcaatcttgaacttctgggctcaagcgatcctcctgcctcagctttccaagtagttggaactataggcacacatcaccatttctggctaattttatatttttcatagagacaaggtcttgctatgttgctcaggctggttttgaacttctggcctcaagcgatcctcccacctaggcctccaaaagtgctgggattacagaagttagccactgaacctggccctgaaatgcttttatttctttcttttttttaatgaaaatactggacatggagatgtggaaagacaccttgctttattacttttgttgttattattatttctacagtagaatttatacatcacaaaattcaccatttttaagcatacatttcagtgtcttttaccatattccaaaactttcgcaaccatcgccactacctaattccagaatattttcataatgccaaaaagcatgcctgtacctatgggcagacactctccaattccccccttcttgcgctctctgacaaccactaatctaccttctctatatattgatgtacttgttctgggcacttcctctatatggaataacaaagtgtggtattttctatctgcttcttagaatattgttctcaagtttcatcctttctagcctgcgtcagtacttcaactttttatggccagataatattccactatatggttataccacattttgtttattcatcaactcatggtggtttaagatgtttccactttttaactattaggaataatgctgctgtgaacagctttgtacaggtttttgagtgaacatctgtttttcattttcttggttataaacctaggagtgcaattgctgcatcatatgtcactttatgtttcactttttgaggaactcacacactgtttactaacttcagtagctatatcattttagattcccaatagtaatatatgagaattccatattctccatcacttttgaaacatgtgttgtctttatttttttcttaagtcatactgctgggtgtgaagtggtatctcattttggtttaaatttacattttcctaatgacgaaaaacattgaacatctttgcatgtgcttcttggccatttgtgtgtttcctttagagaaacctctactcacagctttttttccccattgttaaatgtggttgtcgtttattgctcagttatatgaattccttatacactctaggtactagacctgtgtcaaacatacaatttggaaatagttctcccattatgtggattatcttttcacttccttgacagtgtcctttgaagcatacaagttttttattttaatgaagtccatttatctatttttcggttgtttgtgcctacttaaaaaatgtctaatccaaaatcacaaagatttgtacctaggtttccttcaagacatcgtcttttgaatgagaactttcctgggttttagaggagggtggacattgtttattgatgcctcctgtccattaccgatgtttctcttgattgttattcatatgctcaccacccctccatggagcatccatggcctgtgacagagctctggggactgatatccttccactgactttggcgctggtgagagccctggtcatgtgattcagcttggccttaacccgacccagttgcacatattcctcaggccctttagagttgaagtcgagacctctctgagaacgcttgccagcccatgctcttctaaggctggagcaaacttcctccatctattccagacagaggggactgcaggggttggactcactcaagatatctctggtgttagaaagaagacctgtttcaggctttggggaagattgttcaatatgaactaggtcctctctaattatttttaccgtatgtgtgacttctttctagaaacaagggaagaatatttatgttagaacattttgtctattctttgtcaattgttgtttatctacaattttaacatggataaaggagagttcagtgtcaatatattcttaacaactaattacggctcatgtccaccgccatgcgatcatatttaaatctgtcaactatcctgttacttaggtattatcctgttcctgatgagaaaacaaactcagaaagattgcaaaatttccctaggtcacaaaactagtgaggagaggagtaagaattagatatccgttccttttggccttcaaagctaaccttgtaccattagatcaaactgatttacatacttttgctggaattagtctcagacttgtggttctcacttgattttcccaaggaaacagtgtgccactttaatatcatttcaaactttgaaatttaaaactctttttattatacttttttgtctttgttctattccgttgcttttggtttcttctcaacggatccctcttatttatatgctaaatatttgttacctattttctgtcaattttcacctttttgagtgtttgttatctgtctgttgtatgctaacagtttttcactgaggtaaaatttgcgtagagtatactgcaaaaaaacctaaaggcacagcttaataaattttaatataattataattgtaaagtaacacccagttaaagacagagaacattttcccccatgccacaaagttctgatgtggtccttgccagtcaatactcatcccccaaatgaagaatatattctgaatgttgtcactgccttagcccctttgtgttgctggaaaggaataccagaggctgggtaagttatcaagacaagaggtgccttttgctcatagttctgcaggctgtacaagaagcatggcccccgcatctgctcctaatgagggcctgaggctgcttccacttgcagcagaaggtgaaaaggaaccagggtgtgcagagatcatatggcgagagaggaagcaaaagagagcaaggaaaggtgagaggcactttttaataaccagctcctacaggaactaagagagtgagaattcactcactaccttctcccagggtggggattcatctattcatgagggatccactcccatgacccaaacacctcccatttacccccacctccaacactggggaccacatttgaacatgtgatttggaggggaccaatatttaaacttagcagccaccatagattcattttgcttgatcatgtgcttcataaaaatggaatcattttggctgggcctggtggctcatgcctgtaatcccaagactttgcaaggctgaggcgggcagatcacctgaggtcaggcgttcaagaccagcctggccaacatggtaaaaccctgcctctactgaaaatacaaaaaattagccaggcatggtggccggtgcctgtaatcccaggcaccagatatgtactggtatctcatatgtacaggacatgtactggtatctcattgttgtattgattgatgttcctgatggctaaactgtagagcatcttttcctatgctaattgaccattcatgtatcttcttttcttaagtacctattcaagtcttttgagaaattgtttcattgtgctgtttatcttattaaacttatatatatatacatacatatatatacaaatacactctaaaaaacccctttgttggaaataaatatatctcctatattgtggtttcttttaatgttctcttaatgttccctgtttggagataacgatagataatcttcaaaaaggtgaatatacacacccacacccacccacacacatacacacacacacacacacacacacacacacacacgtgagccaccggatccagcctgttgaatttatttctaagcacaacatgtatttagatgttacttgaaatgaaattgtatttttatttcattttccaaatgctcattgctaatacacagaaatacaaaagactacttctattgagcttatattctgcaacattaccaaactcactaattacttttggcagatttttatagatttctaggattattaacatacacagtcattatctgtgaataaagacagcttcaattctttcttttcaatcttttcaatacttttatttttcttactttattgcattgatttagatctctagtataatgctgaattgaaagaataacaacagatattctacttttttctctgatttaatagaaaagcattcaatcctatgccatttaatataatgttacctctgagtttttttcaaatctacccttaatagggttgaaagtgttgccttctcttcttatcatgctgagagttttctggggtttgtttttataaatcatgaaaaaagttttcaattgtgccaaatgcttttactgtgtatgacaaggtaatcatatggtttttctcttttgccctgataatacataacattacattttcttaaatataaaaaagatttcttgaatcaagctaggacagtttttttaattataaacttttaacaaatatattgaaatataacttacatgcaattgagatgcatgaaagtgtataatcattaaagtgtataattttaagagtttgagcacactatacacgagtcaaagagaaaggacagaaaatactaacgatggctcagcacatgtggtctatcttgctgaatgctctatgtgagtttgagaagagttatttgttagctgttcttagatgtattttgcttaaatatcgacctggctaacatgtgtcattgattgtgtgaattaattttgttctagtgggcagtaaaattactgtctgatcactttggacttatgtggactggttcatgttttattacaacggattcatggaaagcccacagcatttcccaagaccctctaatttggcaggactcaatcaccaatccacccctttgtgaatttgtcagggtttgcttttaggctttagcaggttggtctacaataggccttattgaaaagtgtgacacttattcctaaagcacatccattctagtgtctcagttggatacctgggtgctaatgaggtgtgcatgagttcttcccaccatggatggcagaaactccatcatacattccccaaccctcctccacctcaagtacctctggtccaaactcaatttcatagcagccacccctctgttaaatctgttagtcttttccttgtgcaggtagagtccactccttgataagtatgcacatggaaccccacatagactttgagagctgcacctttgatcagctgtctcctcactggtgccctgccctgcagattgcagttgcttcagccgtcttgaactctgatctctgccttctcagctcagtgagctgccctgccctgagtggactctagctcactatgcagctgctgagaaattctccccaaacaactaggaaatcatggggcttcccccttaagttttctcttggactgcctgttgtacactgctgaaaacaattttacgtttgtttatggaggcagggttagtctgatatgatttattctaacagacagaagcagaaatctgttatactcttttaattactgtgtctttataatattatggtagacagaatcctaagatgacccccagtgatctttgctcttatataatcacttcctcctgagtgtagacaaagctactgaggagatgtcactcctgtgattgtgttacaatttatggcaaaaacaagttaacagatgtaatcgagatcccaaatcggtccaatttaagatagacagattatctgatgagcttgacctagtgaacgtgagttccttggagggactgaggacttcctggagagatgtgaagtgcaggagggtttccatgcagggcgatcctcctctgctggctggaggaagcatgcagtgggaacatgggaggcctctaggagcagcgagaggcccctggctgacagccagcaagaaaacagagatctcagtcctacagtcacaaggaactgaactcagctgacaacctgaggaaacttgagaggaagttcttccccagaacctccagaaagaaacccagcctaatttcagcctgtgaggccctgagaagaagacccagagaatccaggcctgaacttctgatctgtggacactgcaagaaaataaatcattcttattttacgccgctaatgcttgcagtaatttagtatgcagcaatagaaaattaatacaaataaaatggagaaggctttggagtggggacaagaaggaaacggtgggagagggatgcctgtatgctgatatggttgatgcctgtatggttgaattgggtctaccgttcctcatctaattagctatggtctattaaggtgcatagctacacacaaatattggtactacgttcaattcagaggaataagatattgcattcttgacagtagacaagaacaccctgaatttggggtcactgtatcataagtcatgttatcaggtccctctaggaaggcttagaggaagatttccaggatacacttgtgacaacattgaaggcttcttttttccccaaagggacccgatctcccctcagtcgagaagctccaagtctctgaactggatgccaggttataaattccccctatactgactccatcaggcttctgtcctcagaactagagtttatcagtaaaagatagactcatgggagtctaggcatttattctcttattttatataaatcagttaatgtgcaggaacaaaacagactttgaagaaagacactcacagttgccacaggaaaacaccttcaacatcctcatgagtcatcatgggtgttctgttgggaggacttgataggaggctttcctcctcacgggctagtgcagatccaggggaaatgtcatcaagtcctccattcggagggtagcagctgaggctgctgattcgttaggcctcctgcagctggagatgcaagtagtgcattttcatggccaccgcagggccctcagtttagcattcttcagagccagcatccaacaagccacagaagctctgagtatttccctttcttcagtcacccacataaatggcttcagggccttctggggaaggcctgaaggaagatttacagcatacacttgtggcagcattgaaggcttcactcttcctcaagggatccaatctcccctcagtcaagaagctccaggtatctgaactggatgccaggtcataaattcccactatggtgactccatcaggtctctgtcctcagaactagagcttttctaagtgtaacgtaagttgatttcttagtagatgtcccatccattacattcccagacacctcacaatgattcgaatgattagtaaccaccacatatccctgcctctcagggaaatccctcccgccttgtctctagatggccaagtcccacggcctgtcctctactcttccagaaccctgttgttctcactgacagcagggagggcaaatccatgcagcagctcccgccatgacctccagcctgcagaggatgggcgccacaggacttttaaacgcatgccgctgttcccctcacctgtgcatttcttaacgccttggtgaggagaatgtctctggatcttccttgatgggagctaaaggaacaaaggtaaataatgctatgggacccactgagaactggggctgtggaagagtggccactgaagtaatagacagatgcagctattgccagatactcagtgccagagcagggagggacagggaagaaatacggacctcaccttcctctcacttccaggatccatcgggggccctccattgctaaacctaactagaagtgtgcacgcacgggagccagggatgcattctaggagggacgagccccgagtggcatgagacaggatggaaatgagtggacagtggatctgtgggaagaaggaggggatgttatgggaaaacaaaaggagaatactagctaagaacgctaggtgacattaatattccgaagtctgtgctcatattcagcaaagaaagttcagcataaagcactaaataaggagtcaagatattgtacttccaactgttgttccaacagctgtattatgaagggccactttatttcatgcctttctaatttgacctaaagtgccaggtggcactggggctggcacagccttgctcaattatgtgttgcagagtacacagagactgccaggctgagggaagatgcaagagaatagaagagatgctctcagggaacaagagaccacatggccccagagtcaggggcagcatcagccactgtcagctgctcattttcccagacagagcccacaagcctcagccatgctttgcttctgcaagacgcttcttcaccttttcaataaacctgcctgaatttaagctgacagggtttatttctccttcatcataaatgaaattcttcaccacaacaatctccaatgaattttgggcacagcaggcaggcccatttctgcttctgttccactatctctcctgtaggttgaaaaggaggaggtactgaattacctccaaatgttcctctggctctgatattctgttattctggttcctttttggctactttgtttttggtagcgtgtatcctaaggcgtccagttgaacaacttttgtctactgtgtccaggcattcctggtggtatttcagataagactctcttgggttgctgaactcacaaccactgaaccaattctatgaccatctgtttcatggccacatgtttgctcattttatatgtacataaagggaggggacagacagcaaacttgcgtgttacaaattgtatcatcttaaaaaggaaacaaggcaacactttgcaataaaaccttaagatgcatgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaactagtaaatcttaccaagatctgactttctgcagatataatattattttgtttgaccatccttatcttcaagggctaccaagaaggaaccaagaatttatttacctccccaagggaaaaggttttaccaatgagaccctttctcaccatgaccccaggaccccatatgccctgttcacttgagtgccctgtgtggcctgatagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaagctttctcaccttcgtacactaatggttggaaggtacaacagcatatgcactttgggaaaaaatatctggcatattcttacagaaacaaacaactacctattctatgactcagtaattcctaagcatttatccaagagaaactaaaacctatgtccagaaaatgacttatacaagaatgttcatagcagttttattcataatacaaaaaactggaaacattcaagtatctgtcaatacaagaatggatcaataaactgtgatacactcattccatggaatggctaaaggaacaaactggtgacacacagaacaacatggatgaatctcaaaaacatttggagtgcgatagaagccatacccaaaaaagtgtgagaaaaaaagataaataataatggttccaagaaatgcacagcagacagcccagaggcaaagacccacaggacggcgggccggtcccaggctgtcgatcctaattaagaaacttctgctggattttgcccagctccatttccaaactattttgggtcagtgacttctttatcccttccatgttgcctcattttgaactagaatcactgtaagtgttattctatgtctgtcacatcattccacagtaggggcagataagctgtttagaatggctaaaattcaaaaaggtgaacacaccaaatgctgtcaaagatgaggagcaaccagaactttccatcgctagtggaaatcaaaagggtacagtcactttggaaaacttaagttcactcaaaatcctgcacagaagtacttacagcaattttattcatcatcgccaaaacttggaagtgcccaagatgtctttcaccaagcgaaagaataaacaaactgttgtagccatacaaggaaatctgattcactgattttaaaaaacaagttatcaagccatgaaaagacatgaaggaacttaaagtacataatgctagaaagaagccagtctggaaacccacatactgtaccactccaactctaggacattcttggaaagtcaaaaagatagaagtagtaaaatggtgagtggttgtcaggggtggaggagaggaggacgcgtgaaatggtgaagcacagggaattttcagcagtgaaactctttcgcatgatgctgtattggggatttaggacattatgtaattgccaaaacccataatctgtgaaactcaaagaatgacctctaatgtaaactatggactttagttgataatgacgtatcaacagtggttcatcaattgtaatgaatggaccacactaatacaacatactagtagggaaaattgtgtgctggaggacaggggagcctaggagaactctctgtattatccactcaagttttctgtaaacctagaactgttctaaaaaataatgtctattaactgtttttttaattaggatgcagcagccccatatcaaggttttggtggcatcctgtaattgtgtggttagtacttggcattgaagtgcaccaacctggagtcagagcagttggagatttcaaggcctgtgccatttacctctaaccctggggtgcccctggaatacagatagcagatcggttaaggagaagcagcctcagcaatctagacagtgcaggtttctggtgaggacaggtaaaaaccatctgggtgggcagaacttggtgaagaccagaaaccactgagactcagcagctgccgcagtggcacccacaaatcaaaggagggggctgggaagagctaagggctactggatgagctctctgcctgcaagacagaagcagatccagagattttggaaaataatgtaggtttcagtacagtgtgatctcttcaaaaaagtagagagaatgaaaaggaaagaaaaagagagagcatgagagagaaagaagaagaaaagaagaaaggaagaaaggaaagaagggagggaaggagggaaggaggaaggaagggagggatggagggcgggtgggaaggagggaaagaataaaaagagagagaaagagagttggagggaagtagggaaggaaggaaggaaggaaggaaatgaacaaatttacatgaagatgagaacagtggggaaacttacaccaccaatattttccattaacaggaacacgctaagtagttattagagaaagacacgctactgtaaaacaatatactgtttccatggggtacaacaaccccttcctcctcctctgaaacacattctatctctggctcactgttgccagagacactgagtcttgtctttggatacgttctggtgcccacaagaatgagatgagacagtggatcccagaacaccaggccacgaacttccctgttgctccttgtccactccagaagctacccagctgcagttggggacctcagcccctgggtctgatgtcatccatttgcctttctcaatggacttctctccttgcactggctcctactcccccaggacctgtgggtgaccacatgagaagaacacaaacaggccatgcccctttctttctccccctctcaatgcctgcagtagtgggttccatggggtagtgacctgagatttactcattgtggggcctctagcccagagcagggcctactacctcacagtcaccccatgaatgctcagtgaaagaagacgtccaccacaaggtcctggggaaccaagaattccactgtggcccataaattctaagtctacaggattctggaatgggagatgggaaaggccttcaaaagtggccacttttaacccattatactggcaactgagccatgtttccccatcctggacacatccagagggcactgcctaaaaccagacacatctccccacccaggacagtgtaggagccttagcctgggggatgcaggtggacagggagggggtgagccaccaaagctgaagagcagaaagcaggtgaaaggggacagcagggtggaaacagagagaaatgggggcagagaatggggggtgagaggggaagagtgaggagagggatgcagatctagctagtaaggaaaagtcctggagagaacactgtcctctcctgaagtaaaatcacttctacctgaccacggcactgcagctcatgggcagcacatgctgtggatatttgttcattcatttaacaaatatttatttaatatctgttgcatgccaagcaaggccctgcaatgtttagggaccttgacatcttcccttcacatctgagtcataatacaaagaggactctctgaccccactgagctggcaatgcctcgggatttttacctgttggatctggcagctcttgatgtcagcccacaccatgtgaggctgctcttggtgcacccaatggggaagtttctacatcagggcctcggagaatccactggaagccctggacagtgggagtcagcggcatccccagtgtggaggccaagagcacacagtgcttaagctccaggcaccctcaggaggacggcaagggacaattggctggtgagagcccgggtcaccgggaaccttcgcctgggtctaaacaggatttgccttcagattgcctgtgagataaaagagagaaatcaaggttaacgttgagatttagggcttcggtaacttgaaggatggagctgccatttacggagactgggaagacccagggaagagcagattgaaaggtggtgggaactagaggtggttgggtttctgtcatatgtaatcaacagtcctgaccagcctgggcaacatagtaagaccccgtctgggaaaagaaaaaaggaaaaataagctgagcatggtggtgcacacttgtagtctcagctacttgggaggctgaggcaggaggattccttgagccttcagttagcggttagtgagctatgatggcaccactgtactccagcctggggggaaaaaaataaagagtcctgactaaatactagagtagccagggaagttttcacaaagtaagtaatatttgaggcagatcttagtgaacaagaattccattatttctgttagggaattaagagagtgtgggtgtcgttagttaatgcttattaaagtagctttggaatctcatctactggtctagctggtctatctgtacacgtatattgtatatgctgtctctctgagctttcgctaggttatgctacggtaacaaaagccccaaaatcttagcagctacacatacgaaggtttatttttcattgacatgtccttttatggcaggttgactgtgactctactctatacaagctactttatttgttagatggtgaaaactgtgatactcggaggttgttgaatatggtattagtatgttcattcattcattcatttaagaaatatttattcaatatctgtttcatgccaggcaaggtcaagtactgagaatacactggtgaatcaaagagacaaaatctctaattgccaggagcttatattgaaaatcagattaaacacatacaaaatcatcataataacaacaatgaatactatattcataaataatagctgtaagagattttagtacatcttttaaattagaaaaatataaaaattattaaaactaaaatggccaggtgtgatggctcatgcctgtgatcccaacactttgggatgccaaggtgggaggatcatttcagcccaggagtttgaaaccagtctgggcactacaggaaaaccctgtctacaaaaaggagaaaattagccgggcacagtggtgcatgcctgtagacccagctactaaggaggctgaggtgggaggagtgcttgagcctgagagatcaaggctgcagagagccatgatcataccactgcactccagcctgggcgacagagcgagacactgtctcaagaaaaaaaaaaaaattatttgatgtagtcctaaaactattatgtagaatactattgtttatatcacagcacgtgagccccttaaatggcttaacacttatttaggtatgatccataaagcttttctggtaattaagtatacttaagaacaattaagtataaaagagttactgccttgacaggaagattgtaaaaattttaaaaagacaaataaataaaagagtaaaaactgtagctctgtgaggctcaaataacatctaattcaagtcacaatgaacatctagcaatcattctgaacaccatataattcacttaatacgttttgcctgaacacccaacacatctgaattaccaacacccatatgtagccaagaaactggcaatcatttataaattatcacctatgactccatctgctctacgcacttattttttaaattttattcatttatttattatttttatttgttgtagagatgggatctcactatgttacccaagttggtccagaaacagaaacagacccacactaatttcataaatcagatgaccatacagtcattcgatttatgaaaaaaagtgccacatggtgcggaaggaaaaggatggtcttttcaataaatggtgctggatcaagcagacacatccatgtagtaaaaagtgaatcatagccaggtggggtggctcacacctgtaattccagcactctgggaggctgaagcgggcagattacttgagcccaggagttcgagaccaacctgggaaacatgttgaatccccatctctacaaaaaatatgaaaattagccaggcatggtggcacatgcctatagtcgcagctactcaggaggctgaggtgggaggatcacttgagccaggagatggaggttgagtgagctgagatcctgccaccacactctagcctgggcaataatagactgaggccctgtctgaaaaaaaaaaaaagcaaaaactaaaataaaatcgttataaggttaacacagaaaaatgtgttcatactcttaggttaggcattgatttcttaaacaggacacaaaaaacagtaaccataaaggaaaagattaataaagtataatttcattaaaatgaagaatctcaggctgggtgcagtggctcatgcctgtaatcccaaccctttgggaggccgaggcaggtgtatcacttgagcctaggaattccagaccagcctatgcaacgtggcaaaacccatctctactaaaaatacagaaaacagctgagtgtggtggtactcccctgtaggtcccagctacttgggggctgaggcagggggatcacctgagccttgtgaggtcaaggttgcagtgagctgtgattgtgccactgcactccagcctgggcgatggagtgagatcctgtctcaaaaagaaaaaaaaaaaaagagaatctcccttcatgaaaaaacaccataaaagagtgaaaacgcaagctacagattgaaaaaagggaaatgcaatacatataaatcctagaaaggaggcatatccagaataaagtattacaaatcaacaggaaaacaagcatatcaatgaaaactggataaaaagatttaacaggcacgtcacaaaagaggacatataaatggcaataaaagatactcaatctcaatgaaaccacactgatatattactgcacccctactagaatggcaaaataatttttaactgacaggtatcagcgaagatgtggggtaaccagcatatccctgctaaatggtacaactactttgggaaaatgttcaacaatatgtaatactaaagttttatcattcatatacctctaaaaccaacaatgccacccctacaaatataccccagactagtaatgttcaatttcttgatctgtggtggttcacttggtaaaaattcattacttttttttttttttttttgagacagggtctcactctgccatccaggtcggagtgcactgccatgatcacggctcactgcaatctcaacctcccgggctctggtgatcctcccaactcagcctaccgggtagctgggactacaggcacacgccaccacacacagctaacttctgtatttttagtagagaaagggttttgccacattgcccaggctggtctggaaatcctgggctcaagtgatctacccaccttggcgtcccaaagtgctgggattacaggtgtgatcactgcgcccgggccacctgcacatgtaaaattgtgaacttctgtatacttcagtaacttttccaagatttctttgacgcaaagttctcagaaatcttaaagctagcatttcagaatagaaaaagtagcttctggttcactagtgaaattttaccaatagaatttaaaaacaaaaagctactaacgcatatcagctcagaacactaccagcagatcttttctttaacttcctgaagcactgggattcattcttttggcaaagaaaggatgaacaacactgtaacccaaagaaaagataccactgccagaaaagacttcttttcgaaagcagctctaagcaaaagataggaggaaaacaaggaagccaggccaaacgtcttggttaactctccgctgaaaggacgccacatgagatgatctaagaagccagccagccagccagacgcagggaaatcacagcaactctttggagtgcaaacagcaaccccacaatccaatctacccgaaatcctgcggttcatttgaggcttgccccgctagtcaggaggtgattcagtgatggctacaaatgctgctcatgtgcatcctggagctggcacacctggcttgcccatcaccagcctggagacaccgccaggagcagaagcccggaggccagtaaagaccccaactttgcaagtcaggggcgcgagcgcgctcgcctctcaggtccgcagagggaacggatttctggcctggagggtggggtgcggggtcagtgtcctctacaggatataggaggacgtgcccccgaagctgctccgtccctccaccccctgggatgccacagaacacccgccagcgagtttcttccccagcgcccacgagagttgggctgcgggcggcagcggcaggcgaagaatccagcgcggggaactcaggccccggcggtgcacgaccccccacagcccccacccgcccccgcgctcgcgcaacaaaacttgccacggccgcgcctcgacccagctgtgcgcccgcgggtcccggattcaccgcccgcccagcctggcgcggcgccctcacctcagaaacgctgggtggacttcgcgtaacttcccattcacagggcagccggcagccgcgccgccgcgcctcggcccagctcctggcgccgcagatcgcccgtcccgcgttcccaaaagcaccgcgctcgctcagaagctcgggcagcctcgcgaccctcacctacgcctcccagtaccgccgctgtctcaaccgccacccagcccctcgcctgcgcctgcgcctgcagcccactggctcctcaggatcccgatgggcgtgtcaggataacccaaggcgcaggcgcggcggggccttaaagggacccggcggcctcttctgcacaacgggttcgagcaggttaggggccgcgcaggcggaggaaaggagtaacccaggggaaggaccgagtgcagcggggacggggaaatccctctctcccctccgcctgtctttcaaagcaccagccctcgaccctccaaatcgctggtttccccggccacttgaacagcccctgccaggttgaagaggcaggagacacaccccctctggggctggagcgaccccgcgcttaggactgcaggcctcgcgctgccgcaccgccccgaatctgacttccaggcacgggcacgcggtgcagtcgggcaggcttcagaagagcccccagctctcccagaggtggccttaggtcactctcaaaaagaataaccaatgtgtcaatggcacttgtagttattttctaatttaaatttattaacagattttgcagatgggcttccactgaaataagcctttgagaaaaagaaaaactttttttttcaacaggattagaataccaagaaataggaagtaaagccatgccgtccacccagctaaaaactttgaaaacttgatattttatctaaggcaaatgtttgcataactttaggtcatgccattatttaaagtcaatttcagttaacaatttcattgcaactgaatctatcttgtataagaaaactaagatacatccctgataatctacctctcccctcctatactccatccgtcagcaaatcctactggtttttaccttccaaattttccttgaatctgtcctcttctatctcctccgtcaccaccctagtctaggctgccttcacctggggagtgagggtcgagggactactgacctagtcttcttgtggtttacccatatcccctttatcgcctctctaatctcaacacaacaggcagagtggcttttccaaaatataatgtgaccgtgtcacttcccagcctaaagcacttaaacaccttcccattctcttagacaaaacctcctaactaaccaagccccgaatggccaggcgccttgcccacttcttcatctcttctcactactcagaccaattctgttctgctctctctgctccagccaaactggcctcttttattccctatttaccagcttcctggcctccacagagcttttgctcatgctttgctctgtgcctggaaagttcttctaacccctattcttctgagaacagctgtagtctccacctctgaaaagcaccttctgacctccctatggtggtcccttactcctatcacattgcatgaaactgtaatcgggtggttattttggtgaattttttactatcggctacgtaagcccagggtttggttttgtttgcttcatgatttgtatttccacatttgttaaatacatatttgttcataaatgagaatgatggatgctagaagttgaagtaaatttggcataaagtcagagaaagagaaaatgtcacaatctgacagttggagtcagaatgtagaaacttcagttatattaaaactgattttatatcgttttaggctgagttgtcttaggatgctttgggtaacctttaaaactgagttctcaaagagccttgtataaacacctgaattaataatgataagccatggggtggcccacataaaactaataacattggttgctttaagagaggaagactgagccaggcacagtggctcatacctgtaatccaagcactttgggaggccaaggcccgcagatcatttgagctcaggagtttgagactaacctgggcaacttggtgagaccctgtctctacataaaatacaagcaaaattagccaggcgtggtggcgggcacctgtactcccagctatttgggaggctgaggtgggaggattgcttgagctcaggaggttgaggctgcagtgagccatgatcatgccactgcattccagcctggatgacagagcaagatcttgtctcaaagagagagagagagagagagagaaatgaagactggtgactggtggctactggtgggaaggagatttttactaaatgcccaaaaggtttaaaattgtaacttttttatttcaaagtctgtgaagataaatgacacaaaagagcacataccttcccatttatttgaaattctagaaaggggaaaattaatctgtggtgaaaaaatcatagcagtggttccctctggcaggggattgactgggaagttacatgagagaaatttctgggtggtaaaaatggtctctgtcttgatagggatatgagttatataagtgtattcatttgtcaaaaaacatacagttaacatttcaatgaatgtaaattttaccttaaaaactatacgaataaatgcaaatttaaaatctgctagctaacacctagttgagtactcagtgtctatgggcattggccgaggctatacatacacgattttctttagtcctcataccgtcctcatggggtaggtattattatcataacccccttgcatatgaagaagccaaaatgcagtaaataccaaataacttgcctcgatttatacccctggaaaatgcgggaagagctttaaacaccatcagtcaaatgccagaagttgttaaacattagactctatagcacttctctgaaattatagtatttttggtatatgtatatatatatatatatatatcatctactagatcaagagcttcacaatgattgaaatcatagtttgtctttttgtttgaggtttatgtttttattttacttcattattttaaagactgagtctcggccgggcacggtggctcatgcctgtaatcccaacactttgggaggccaaggtgggtggatcacttgaggtcaggagttcgagaccagcctggccaacatggtgaaaccccatctctactaaaaatacaaaattagccaggtgtggtggcacgtgcctgtaatcccagttactcaggaggctaaggcaggagaatcgcttgaacctgggaggtggaggttgcagtgagccaaaattgtgccactgcactccagcctggccgacagagtgagactccatctcagagaaaaaaaaaaaaaagactgagtctcactatgctgcccaggctggacttggactccttcattcaagccatcctcctgcctaggcttcacctgggactacaggcccaatatttttgtcttaagtttctaagcagtcccaagactttgcacagtagctgttcaatgtattttgagtgaatgattaaaaacaagcttgatgtcgattttattggtacaatttatatttacatatgtaatatttatatgcttttatatatttatgtgtgcatgtatataattggtactaacttagcactgctgtgcctaagtgcctgagatgcatctcaaatgaataggcctgaggagagaagcttgtgtcattagctctgaccctgcagcactaatcctggtttacccctttctttcagtctccctgagcacaatttatttgctgaaaggccacatctcactatggagtgaggatcaagaagtaaaggtctgaaagagagaagctgcggggctggggagactgttggtcggagaggcgtcgggggcccaaggaaaagggaggattgtggggaggaatcggcgtagagatgagaggagcagcagagacagagtctcacgcagaggtgtgcccagacaccctgaaccaagttacttaacctcgtccaccaccgtggcacccgtggggtccgtgggcccgtcggtcttccaggagggattctgtgtccctgttattgtgtgtcaacatgtgttagcctgatatttatatttttaatgagagaaaacgaactctggaatttgcgaactgttttttcgttttgctttatacctcttggacactccttccgaaggattgggtctcaagggcagtggggtgtgactacggtagacagggctgattaattttcatccaaaactctttggcggattcccctgctctccgcttctccggtctaacagtagtttaaaatagaagatcagcaacatttggagagtttttttctttgcattttaatgataaacttgatttattccattccaaaagttttcttattctgaggttgtctttctatattttgagtataaaacaatggccatactatgttggaaccaccaaggttcttctcttcacttgttcatttgtaatgtctctttataatctgagaatttcctgagcaaactgggaactgttatacataattccttgtttttcaacattctttgtaaacaggaatcaggattggggatggggagggagggaggagtaggagtcctgatttgtggaacagaaaatcatggattacttatgtgatggagcaaagggtttaaaaactcttagcatccccagatttccccttttactgtttgctgaagaaaattctgtctttgactcccttccttaccctctccgggcctgtgagaagcttcctccctatccagtttatttcctcctctgctccccgacccaccccccacagccccctcctctttttcagtgaagccgctggaggaaagtcgggtttgggagaagacccacacaggcaaggacagcaggagaacactgacatagttacactcttgtcaccagcacttttattaagacgtgaaaagacaaagacaacagaggagagcagagaataatatctctgtttcagctattccaggatgttatgccaattatccagagtccttgatctgatgtagtaaagagctagggacattttccctgaaggctttgattgctggcaaaatctcattaaacgtgtatacattcataggttggccataggatggataaaagaagagcctctggcctacatctgccacgatacatgtgcaaaaatgctctctgcagcattatttttcattgtaaaatagcagaacaaatttattattcaataattataaaatggtcaaatgtatgtgactatatttggacaatgaaaaatgcagctgttaaaagcagacaatactgatgattcagatgatgttactgatgaaaataataacagatgacaattattgagcatttatggcattcttacaggcattaccttatttaaagttcagaactaccaaggaaaagagtaacttgtggcaggcgtgagaggttccgaggcacaaaaggaagataggcattcaaggaacaccaggatagaagacccagagtaggagaagagagaggaagaggagtccgccagatgggatgctggaaaccgcgggatagctcggtggagagagggcgctcctgctccgcaagcctccctacgacggcaggcctacccggtcctgctcctgccggctctgggcatctggtttctgccgctccatctccagggagatggtggccaggctgtgccgtgtacccatcaacttctctgacagcgccatcttctcagactccttcagagacaaggcctgggcagaggcaggggacaaagggcttgggggatgggctggtcctgggggcatgctcaggcttcttgctgcctaggaaatgtgcccactgggggcttagaggcctgagtgtgccactgcaggtggacccagggcagacatgcagccctggaaaagggcacaacggcagtcacaagaatcccggacgtggataccactcatagagctcactaacccgccacagcaccctgactgcagagtctttctttctacccatcttacagatgaggaaactgaggctcaaggaggtaaagtgactcgcccaggtacacagctggtgaggagaggagatgggcacagtctgccctgtctccgttacattataggaaagttagggatttgttatttggggggacacgtcagctgatgcctgtgggcatcgtggggactgctcagaaggcagccatgaggatccatgcccagcgtggggtgggacgaggcatgggagaatatggaacagctttcctggtgtcacgactgtcactgtcactcagtaagtgctcactgtgtgccaggcatggagcacagcaaagcctcacgaacccccttctaatcctcccctcctgcaggtaaggaaactgaggcccccaagagggcagtggcctgccccagggctcctagctgccaagtggcagagcagggcccggccccagaactggagcagctcagagagcagcagaggccacgccagggctcacgaacctgctgcttctcgctctcggccaggaggaggccctcgtcatgctcctgctgcagggcagcaatctcctcactcagctgttccttctcagccttccgccgggccagcagctcctcctgctcacgctgcagctgactctgcagctgggcccgctcggcctccagctcccgccatgctgcctcctagggggccaggactggacgcgtgtgacacaccaggaggggcccaggcagaccccccaaaacatcagggcagcaagagccatctggcccccataccctcagagatggagggtgaccaggtaaatacaagggactgataagggctatgacggggacacgccagggccgtgaaagtgccaaggagcagcagtgggctggcctgggggtccgaacatgatcccctgcggagagacaagtaactgtcagccaggtaaggagagaaaagaccaccccaggccaagagcacagcccctggaaaggactacaggatgcagggtgcagagggaaacagggcacggtgagtcacagggccagagccccaggcagtggctgggccaggacaggccgtgtgggccatggggattctaaggacagtgaggggagtgggagagaggactcgagccaaggtgacaaggagcaatctgatttttagcttaggggatgttccgacagctgtggaagagggattggggttgggatggaggagagttaggactggctgtgaggaatgaagggggtcaggggttgccagaggagctggagagaagaacacagatttggggacattaatgaggccaagccaggcaatgcaaagggcaagaagagcaagggggaggtcacagttcagatccctggggactggacaggcgggcaggcagagcccacaggcaaatagcagcccacccggggagcccgagggcaggtgcctgcctcagcagttgtccctagcaactctgtgagaagcagacagagctgccacttcttttttttttttttttttagacagagtctcgctctgtcacccaggctggagtgcagtggcgtgattttggctcactgcaacctctgcctcccaggttgaagcgattcttctgccttaccctcccaagtatctgggactacaggcgcgtgccaccatgcccagctaattttttgtgattttaggagagatagggtttcactgtgttagctaggatggtctcgatctcctgacctcgtgatccgcccacctcagcctcccaaagtgctgggattacaggcatgagtcagcacgcccggccaagccaccccttctttaagagcttcaccatagctcatgcctggaatcccagcactttcggaaagagctttaccgccccctgatggagaagcgtgataaccaccacccaaggccatggggactgcagggtgagtggcatgccctggagccatgtagtcatagcctgcacctctgtcagaggaagccctgtctaggatttggtggctgagggcccctgttctgagggccactctggagagcatgccagtgccagcaatcataactcatggagcatttgctaagtaccagtcactatgttaagccctctatgcagatggtctcagctcatcctcaataccttccactatcctatccctatttctacaggtggggaaatgaaggcacagacaccttgggtagcatcaccagtaagcgaccaagattagattcaaacccaggcaatataaccccagagtcagtgttctagtaacttccctggccccttgcctttctacatgctcaggtctgcgtggcccttcatatggaaacttcttagcaaatgaaagtgctttcctgctgtgcattaggtcaacatttcccaaatgtggttgtggaccctctgcatcaggattaccagggctggaccagatttgggacctgggtatctgaatgtctaataaggaccacaacctccccaccacccctccagtcctcccagctgtccccagggcctccacaacagagagggagtcccatttcacagatgtacagaccgaggcagagcaagaacgatgatgaaacactggctcagacttctgcccacccctccccagctgcctgaaccttttcacgctggagtcactgtaagtcctcctcctgggctgcccactgctcccgcagagaggcctgggcctcccgctcagcctgcaccagcttctgggccatcagctccttgtctagactggctttctcctgcgtagctattatttgctgccgcaggcccgccaactcccctgcacgagaggaatgggggaaagggcagggttgggttgaaatttttccttgggccagcagacttaggccagttgagccatatgggcaaaatcccagaggcagagggcctgcctggcatccagtttgggtcctcttgaagaagtggcttgtcctctctgggcctcagtttccctatctgctacatgggcccactggccctgacccctttcctgcctacctagaatggcattaaaggcataaaatgactgatgagaaggcctcccaaatgggacggatgtcaaacatataacaaccctaggccaggtgccatggctcactcctgtaatcccagcactttgggaagctggggcaggtggatcaccttaggtaaggagttcaagaccagcctggccaacacggtgaaaccctgtctctactaaaaatacaacaattagctgggcatggtggcggacgtatgtagtcctagctacttgggaggctgaggcaggagaatcgcttgaacccaagaggcagaagttgcagtgagctcagatcgcaccactgcactccaacctgggcgacaagagtgagactctgtctcaaaaaatcaaacaggctgggcgcggtggctcatgcctgtaatcccagcactttgggaggccgaagtgggcagatcacctgaggtcgagagttcgagaccagcttgaccaacatggtgaaaccccgtctctactaaaaatacaaaattagccaggcatggtggcgcgtgcctgtaatcccagctacttggaaggctgaggcaggagaatcgcttgaacctgggaggcggaggttgaggtgagccaaaatcgcgccattgcactccagcctgggcaacaagagtgaaactccatctcaaaacaaacaaacaaaaacaaacaaacaaacaaaaaccctattactgactcagcacttactatgcgtcaagcacccagctaagtattttagacataacctcattttgtcttcataacatgcctatgtagtttatcctcatccccgtttaacagatgatgaaatggaggatcagaggagatcagcagcaacttcccacagctgcacagctacacataaagcatctcctttaatgactgacatgaacatacctgtcaagcattaactatcagcattaatggaaacgactacagggaatggaaatggtatagccatcatctaaaaaccatctcccgggttggaaacccaccagcatttcccttcctggttctgtctggctcaggtgtacatggacaggaaaattaatttccatgacccaagtaggtgcttagttaatgttagatgagcagaaagaagccctgagttcagagattcgatggggaacggtgcagggaagtggggctcggattctggggccaagagagtcatctgaaaaccacagagaactcagactaacaggcctgatgaccgatgaacagcagttactgttgactcagccaggcaccgtgccacggccttacacgcttttcccatgtcatcctggcaacaggcttagaaggtgggcattgccacctccaatcatcagctgaggaatctgcagcccagagaggaaaggggcttgctcaagggaaggtgagatctaagtggtggcacaggactggaacccaggccagccagactcctactccagtgctcccaacttctgtgagactacagacattgggaggttgcagtctgggctggaacctggtgttccccccaagtccccagccactcgtaccagtcagggtctccttggccagcagcagggcctgcccctcggcttccagctgctcccggcgggcctcaagctgggccagctgccattgcacctcaaacaggctgccctccagggcttccttctccaagctgcagcacatacagtgcgtgaggccctgggactcagcctccctggccccaggaaactgtggatctcagggagtggccaggcatgggccaagtgccaatctacctgcctggccaggcccacactccctggggaagcctgagcccacagctaggacgagttggcaagccagactccttagtaactgcccctgggggcccgtgcctgggtgaggctgttcatggcgtggccccaggaggaccgcccagggcgggttgggcagagcccaaggccttactgcaggtgtgtggcctcctctgacacggtcctgccttcacgctccgcaggccgccagctgcacagccaggccagcgtgctccttggctagcgcctccttctcccgggccacttgccccagcgtctccacctgtcactgggcctcccaccgggcctgctccagctcctgctcccgcctgctcagctgccaggagagctggctcccacccagagactgagtagcactcccagcatcccccagcttgttcatcgtgcagtaccccaactctgggcctaacccagtcctggcagaaggcctgggttcgagcccagggtctgccctgatgtgctatatgtacttgggcaagtcatgaccttctctagatctgcaatgcacgtgtgtacaaaaaccagggcccggccggacacggtggctcacgcctataatcccagcactttggcaggtggatcacttgaggtcaagagttcaagaccagcctggccaacgtggtgaaaccctgtctctactaaaaatacaaaaattagccgggcatggtggtgcacgcctgtagtccctgctacttgggacgctgaggcaggcgaacagcttaaaccccggaggcagaggttgcagtgagcccagatcgtgccactgcactccagcctgggcaacagagcaagactgtcaaaaaaaaaaaaaaaaaaaaaaaaaaagaaaagaaaaatgagggtcctcactcagctttggaagtaacagaacccttgtattactctaagcagagaagctgaatatataaaccagacccaaatgcagctgctcagcaggcctcaaggtggagacttgcaccctgcttcctgcactccctaccccatcctctagaggcacctcccagaaacccaggccctccaggatggaccttgcatgaaggtccctggatccctgaaacattaaggtctcttcgagatgtgaagttcccaaaagtctaagattccaattctaaaaagtctccacctattattaatctgtatcattattattattattattgagacggagtcttgctctgttgcccaggctgcagtgcagtggcacgatcttggctcactgcaacctctgcctcctgggttcaagcgattctcctgcctcagcctcctgagtagctgggactacaggcgcgtgccaccacacccagctaattttttgtagagatagggtttcaccgtgttagccaggatggtcttgatctccggacctcaggtgatccacccgcctcggcttccccaactgctgggattataggcgtgagccactgcacccggctagccccatgttataaatggggcaactgaggtatgggaggttgggcagcttgtccaaggtccccagctaggagaagtgggactggatttaacccagaagcaggctccagtgcctgtgacttaacccaggactggatgcaggaggctgcgagcctggcctgccccacatgctctccagaccaccccacacacagtttggcctacctgtgctagctgctcctgcagccaactgagctcatggtgcagtgtggggagctgttgctccagcgcctcctgggcctgctccgccactcatagggagccctccaggccctgccgtgccacctcctgctccaaccacagctcctccagccactcctgctctgccggcgccactgtggcctcctgctccgcctgccgctgccggccctgcagcatggccttttcttcctccagctgtgggccggaaaggagtggggcctcatgagcagggcgtccctcccaggaccaggacgcctcctccacccacccaccagccacgatagcccaggggaggctcccagggaatgagggacagtgcccttgggtgtgtgggacactggggagggggagatgaggagggcccatggagcgtcggtgctttgactcctagagaggacagacagacagacggagatagacagagaaccagagacagaaagggaggcaggggccaagacaggtgcagggccgggcccagggtgcctcactgagtggggaggacgggtgggcaaggtaggtgggcccgcaggtgcacagtgtacctgggtgacaaggcagttcagatccaacttgtcctgagcaaggctctcgttgagggcgctcagcttggacagggagtcctgcagggaggcctcctctgccctcagcttggtcacggagagctcgagctccatgcggccagcctcaccctgcagggtcaggccccaagagatgaggaagggcagaaaggtcgggaggaggtgaggagagacaagaagagacccagagagatggaccctcggagacaggggaggggagacaaggaggggatacggcgtgagatggaaaaaaaaatcaccgcagaaagcctgctgcttatggagccatttaaaagccatgcaccgcaaagctgtgcaaaaatagctcaagctgcagggcagggccagagttcagaggatcccctgagtaaggtctagggatagcactgctcagagcccaggctgcagcggacagcgcaggcccccccgccaaggaccctctgcgctgtggccacaactctcagactccaggagctgaatctcaggatgaccctgagctataggcactgcccccaggagcatccagaacagcagggatacggccataaagagaggtcagtccacttatggctgggaccagaggtccagaggtctgtggcctgtgacaaagatcagcctgtatccagaaggaaggggtcagtctgtgaccaggctcagaggtctgcctgacactgggaccagtctgtgccagagtgacaaggcttggggctgggggtcagaggtaggtttgtggttgtgcagcagacagggacccaccttggtcagcgcctcggccacctcggtcttctcggcctgcagcatgtcccgttgcagcgtggcgcggctcagcgcctccctcacctccaccagctccttggccaggactgagcgcttcccttccagctgctctagttgtctatggctgtgggacaaagggtgggtgggtggcccatgtcactttcctgcccgaacctcctgtagccagcaagatgctgggccggggaccaggcctgaggcacgagtttggagagaaacagcctgagccacagggcaaccaagcccactaccgcttagctccatgaccctgggcctccgttttcacatctgcaaaatgaggtaacacttgcctcgtgacattgtttgtttttttgagacagagtcttgctctgtcgcccagtctggagtacagtggtgcgatcctggctgactgcaacctctgcctcccaggttcaagcaattctcctgcctcagcctccctagtagctgggattacaggtgctcaccaccacacctgactaatttttgtagttttagtagagacggggtttccccatgttggtcaggctggtcttgaactcctgacctcaggcgattcgcctgcctcggcctcccaaagtgctgggattacaggcgtgagccaccgtgcccagcctgttttaaggatacaaacttcacatgtgcttaaaatagtgcctgacacatctccccaaggaccttcagaaacaagaataacatgctccaccacagtctactaaacatcatcagcgatcacgtccctgagaggtaagcagcgcagtggtgaagaggttaactctgaaggcagaatgtctgggttcaaatcctggctcttctgctaactgtgtgacctggggcaagtgacatggcttctctgtgcctcagtttaccatccacaaaatggagataacagcttctatgtcacagagttatcatggagttaaatgagagaactgaattgcttaaaatggtatctggcacttagtgaaattagtaaggatattattattcttctaactaaatttttaaaatactactactaatattactagtgttattttaattattcttgttattatcatccaagttctaccttttaactagttctctgactccaggtaagtgactatacctccctgagccccagtttcctgaaatgggtctggttagaaaacccgacatcagaggggtccagacggtaggaggcccaggacccagtgggtgtcacctaaccccatgggggcactgtcaggggacccgaggcacatttgaagggtcctggcagggaggtgagatgctgctaacctgcgctcaagctcccggcgaacccgtgcgccattctgcaccgcctcttcctgctcttcctccagccggtcccgctggcgctgcagctcctcctgggcaacctgcagcttctcccgctcctgcggcagctcctcggcctgctgctgggccacctgcaggctgtggaccaggttgctcttctcccttcaggacaaggggagcgggagcagaggggatgctggggctgctctctccagggaaggtggctggctgctcctctagccatgagctacatcctcccgtcttccaaggcacctgcctccaggaagccttccctgaccctgcccatagcagactcatttcactcacacactccagcagaagaacctggctttccttctccccagcccgcccacttagagtggatggaggtgctggcgtgatctctaagcactctaccacgtagaagaggccaggctaggctcctgggacacacaggcaattgtgccaccagttctgctaggccatgtgaccaggaaatgtcccctagaacaccccatgcccctcaattctgggaagcctgatagagctgagtctgcagatcccacagcttcctgctacacaggcacatggtggccacggcaggggagggaggagaagggaacaactaggaccccaaagacttgctgtgagctgccactttccccactggtggtaggtgcaaaaaacttcaagacgtgatttttttttttttttttttttgagatggagtctcgctctgttgcccaggctggagtgcagtggcacgatctctcctcactgcaagctccgccttctgggttcacgccattctcttgcctcagcctcccgagtatctgggaatacaggcgcccgccaccacgcctggctaatttttttttttttttttgagacggagtctcgctttgtcacgcaggctggagtgcagtggtgccatctcggctcactgcaacctctgcctcccgagttcatgccattctcctgcctcagcctcccgagtagccggaactacaggcactcgccacgatgcccggctaattttttatatttttagtacagatggggtttcaccgtgttagccaggttggtctcaatctcctgacctcgtgatccacccgcctcggcctcccaaagtgttgggattacaggcgtgggccaccgcgtccagcaatttttttgtttttacacacagtctcactcttgcctaggctggagtgcagtgacacaatctcactgcactccacacagcttgctgcaatctccacctccagagttcaagcgattctcctgcctcagcctcccgagtagctgggattacaagcgcctatcaccacgcccagctaatttttgcatttttatttagaagtggggtttcaccatgttggccaggctggtctcaaattcctgacctcaagtgatctgcacgcctcggcctcccaaagtgctgggattacaggcgttagccactgtgcctgggcaattttttaaatttttagtagagatggggtttcgccatgttggccagtgcctgcgggacaagaccgacggcgccacgcaggtgttcctctagggcccgccgctcactctcgctgtcgctaagctgcttccgcagggtgcccagcaggtcctggcttgcctcatagcgcccacgcatgttctggggcgtggggatcacagagtctagcgggggtcctttgaggcctccagagcccacctactctcttctggttccagggatacacactagcctacgctaggcggggtccagggcctggacctgccctggggcaggataggggcctaggcctgagagccaggcttccactcccctcctatgtgccctcaccaccctctgaaccctcatctccctggggtcccggacaactcctatcaaagcccccgggatgccagacaaactcccaggcacactcgtctcctgggttctgatcccacccccagggctcccaggctcctcccccttgcatcctggttccactctcacactcctccctaccctggctctgcccctagttcccaagctctcatcctaggctgtgatttcccttgctagaccttttcccagggtcctggctctgtatgaccagggacctgtctccctctctaccaggaccctaacactgtcgcagcctcctccctccaccggctgcccaagcacccacccccagctgcccaagcacccccacttctgggctggcttcagcgcagagccctcgaccacctccttgggggtcctgacaccctcagacactatttctcagggctctggctgcaccccagggcgctcagactcctcccccagacacgcccccacccccacctggagggcgcgagcccctccccctgggcctctggctgcgcccagaaaactcaagccccttcctacctggaccttcagctggcaaaagtgcagggcggagagaatcagggcaagcgagcgtggagtcttctgagcaggccggggaggggcctctgcggggcgaacggcctcggcccggcgaggagcgccgcggtggagacggggtccgctggcccgagagcccccgcaggctgcggtcggacgctgttggacgcaggctgccgctctcagcgtcagacaggacggcctgagggtaagggagggaagcaggaggccgcagagttaggaacttcggggttagctggcaaaaacgaccaggggaggctgggggccgcctcatcccaaatgctcccgcttacaagaagccttctgatttcacctcctccactagctcagtcctcagctcgccgctgaggcatcccatttattgcgaagacatcatttggcattgctcacaggtgggctccgagagggccgtgcctcccctctgagactgggggctccccagggcagaggccgggtgagctagcaggggtgctgagcagctacagcctgggtcccagggccccacccatctgcagttcaatccgaagccaccgaaaggcgaggcgggggagcccaggaccgcctggcagggccctgtcttcccgcctttctgggctcacacctgtgccaggtcccttaggctccgctgtagcccctctccatcctctgtctccagggccgcctgctcctgtagccgcagggattcctggagtgcggtgagggagacaaagagtggtcggggttctgtcttacctgaaacctcccctttccctccctccctggcccaccactgatcaggtggcctctgaagccatgtccataggccagccacctggtagaccccacagcaggcccgaggccctcaatgaacagaccaggcccagagaagagctgggttctgccccaggtcacacagtcgattgcaggagagctggacctagaacccaggccaggccccacacagaggggtgactaaaccaggctggaccctgggggagtgagtgtcccactggtgggggtggacagttgggattccaaaggcagcatctggacctggagagcgtggatgggagttcaagtcccaactctcctgcttactggctctgagactggacaagcatttcccctcttgggcctcagtttcccatccgtgtcattaggattactctacagggctgctgggagggagaaatgggatggaggaagtgagtgtgcttcccacaaagcctgcacacctgtgtgggctgaacctgagtgtgagtgggatgctgggggtggcccaggcagcccagccctaagcctgtgtccatggatctggccggtaccccatcccaccctgccccatctcaggggcagctgaagctcaccagggcctcaagcttctcggtgaggtccttgtcgacctgatccttctccagattctgcttctgtagacgcttcactgccaggcccagctctgtcactctggagttgggggagcaacagaggtgaatacgggaccaccccagcctctcaaatccactagctctgtgtccaccatgcttctccaaacccgaggcagggaccctaacatccacctccctggctgtgtgaccttaaacaagttgtggctcctctccagacctcacacttctcatctgtgaaatgggaatgaggttcccaccagctttatctcatgggaaagcactggaggacttacccaggtggcaggagtaaggggcacaagttgtttttttgtggttttcttttgagacagagtttcgctgtgtcgtccaggccggaatacagtgatgtgatcttggctcactgcaacctccacatcctgggttcaagcgattctcctgtctcagcctccctcgtagctgggattagaggcacacaccaccacacccgactaagttttgtatttttagtagagacagggtttcgcctattgggcaggctggtcttgagctcctgacctcaggtaatctcccaccttggcctcccaaagtgctgggattacaggtgtgagccacagcacccggccacaagttctgtcataggaggctaagctgtttatgataaacactgggcaactgccttcggaacctcagtggggtgcctgggaaggctggctgagctcacagaggaaggccctgctcctagtgaacagatgctcccttctccccaactctccagttttaccttctgcagtgacgcctgcctcatgcagcacccaccagggaccctcctggcactgaggtcagccttgtccaggtcgctttgcatctgctgctgggacaggtccttctcgtggagcaccttgtcccgcagctgctcctccagctgggcctgcttctccagggctggctcgacccggctctctgccagccgcaggcctgtgctcattcccaggccggcctcctggacagctcccctcccagctgcagcgggtcccttgggaagagaacacaggatggggatgggatggggctcactcccaactacaaattaaaactagtctggggctgggtatggcggcccacacctataatcccagcactttgggaggccgaggcgggcagatcacctgaggtcaggagttcgagaccagcctggccaacatggtgaaaccccatctctaccaaaaatacaaaaaattagccaggtgtggtggtgcactcctgtattcccagctacttgggaggctgaggcaggagaattgcttgaacctaggaggaggaggttgcagtaagctgagatcatgccactgcactccagtctgggcgacacagccagactgcgtctcaaaaaaataaataaataaaaaataaataaaactacactgggctgggtgcggtggcatgcacctgcagtcccagctatgcgggaagctgaggcaggattgcttgagcccaggaatttgaggccagcatgggaaacatagtgagactccatctcaaaaactaaagaggaagaagaaaaaaacaacaaccctacactgggatgccatttgtccactatcagattgggaaaaaaaaaaagggacacataatacacaaagagaggctctggggcaacaggccttcccctacacagctggtgggagggtgagtacaatcacaatggagggcactgagggagatcttcgaaaactatgcaggcataggaccttccccaccggctcctcctctaagaatggatcctacagatataccccagcacagaggagatggcttgtggacaaggaggttcactgcagcattgctcatgtaagatatcctggtgacaacctaaatgtctatcaaaaggggactgctactaagtacatgatggtacatcctttaagtggagaactgtggccaagaaaaaccagtggagaagttcttcctggcctgatccagagccacctcccagttataactagtaggtgaaaaaagcatcttcaagaactgtgaagatgaaattttaccaggcgtatatacaaaaaagtgtgtgtgtgtgtgtgtgtgtgtgtgtgtgtgtgtgcgcgtgtgtgatctcatttgctcatataaaataaccctggaaggtcacttaagaaactgataggccaggcacggtggctcatgcctgtaatcccagcactgtgggagaccgaggcgggagggtcacctgaggtcaggagttcaagaccagcctggccaatatggcgaaatcccgcctctattaaaaatacaaaaattagccaggtgtggtggctcattcctgtaatcccagctacttgggaggcggaggtgggagaatcacttgaacccgggaggcagaggttgcagtgagccaagatcgtgccactgcactccagcctggagactcgcagcacagcgagactccatctcaaaaaaaaaaaaaagaaaaaagaaaaagaaactgacaatgcttcttacggtaacttggtggccaaaaaaaaaaaaaaagaaagaaaataattgtatatataaaaagaaaaagaagctgatgatgctgcttgcctccaaggaaggaatgggaatatctggggtcagaggtgggagggagccattttactgtgtacccttttgaaatgtgaataggtgacttcatcaaaagtaaaatataaaaatttgaaaggctacttacaaaatttttttttctttttgtttctttttcagatggagtctcgctctgttgcccaggctggagtgcactggtttgacctcggctcactgcaacgtccgcctctccggttcaagcgattctcctgcctcagcctcccgagtaactggaattacagatgtacgtcacaacacccagctaatttttgtatttttagaagagacggggattcaccatgctggccaggttggtcttgaactcctgacctcaggtgatccacccgcctcagcctcccaaagtgctgggattacaggcatgagccatgacgcctggccttaaaatacattaaaaattatttgtattttaaaaaattaaaatgtattttaaggccaggcgtggtggcccatttcttgagacatagcaagaccctgtctcaaaaaaaaaaaaaaaaattagctgggtatagtggtgaacacttatagtcccagctatttgggaggctgaggtgggaggatcacttgagcctgggaggtcaagcctaacatgagttgtgattgtgccactgcactccagcctgggcgacagagagagactggctcaaaaaaaaagtattttaagtccataatacaggttaaatcctttcctttcctttcctgaatgacctgtaccactggttatccaatagtaaggagggaaagtgcctcattatagaattctaattaatatacacaggagtgactaaatgagaagctcacagttttgcagcctctaatgagtgggttggatcttgaaaagagagacagctggcatagggacatcctgatggaagaacacattctacttatggagtcttgatcaaacgaaaaagcaagcagaagagcctgaatctgacctagctttacatccaacatccaatttacaggaaatacatgggataaagaaatatgttaattgacaccataaggatgcaaccagcaaaatccagaccatgagaatctccaaggacaactagcccagtttcctgaacaaataagttaaaaaggacttcaaagacaaagcatgggccgggcacggtggctcactcttgtaatcccagcactttgggagaccaaggtaggtggatcacctgaggtcaagaccagcctggccaacatggtgaagctcccatgtctactaaaaatacaaaagttagctgggcgtggtggcgcactcctgtaatcccagctactcaagaggctgaagccatagaattgctgaacccaggaggcagaggttgtagtgagccaagatcctgccactgcactccagcctgggcaacaaagcgagactccatctcaaacaaacaaacaaacaaacaaccaaacaaacaaacaaaacaaagcaaccattcgcactttgtgaatgtctatggatccggattcaaacaaattgtaaagaaaaaactaaagcaagactatctgtgactttttatttatttatttattttgagacagagtttcactctgtcacccaggctggagtgcagtggtgtgatctcgactcactgaaacctccgcctcctgggttcaagcgagtctggtgcctcagcctccccagtagctgggattacaggcatgtgtcaccacacctggataatttttgtatttttagtagagatgggggtttcaccatgttggccaggctggtcccgaactccagacctcagatgatctgcccgccttggcctcccgaagtattgggattataggtgtgagccactgcacctggcctatctgtggcatttatgagacatatggaaaatttagacgctggctatttgatgatattaagaaaagattattaaaccaggtgcagtttctcatgcctgtaatcccagcaccttgggaggccaaggcaggaggatcactggggcacaggaattctagacccgtctgggcaacaaagtgagaactcgactctacgagaaataaaaaaatcagcaagcctggtggcatggacccgtggtcccaactgcacaggacctgaggtaggaggattgcttcagaccaggaggccaaggctgcagtgagccataaagaaaagaaaagattactaactaaaagtaagtccttgatatcagccagatgacactaaatcccatccattcccctgagctcacaggggggctgcctagactccagaaaaaaggctgtgcctagtcctagactctggcatgcaggaggtcagaaggctgaattctccactaaactcaaaagtataaccagtccagactgggtgtggtggcccgtgcctgtaatcccagcactttgggaggccgaggcgggcagatcacctgaggtcaggagttcgggacgagcctggccacatggtgaaaccccatccctactaaaaacacaaaaattagctgggcgtggtggcacattcgtataatccccgctactcgggaggcagaggcaggagaatcgcttgaaccttggtggggcagaggttgtagtaagccgagatcgtgtcattgtacttcagcccgggcaacaagagtaagactctgtctcaaaaaaaaaaaaaaaaaaaaagtatgtggccgggtgcggtggctcacgcctgtaatcccagcactttgggaggctgaggcgggcagatcatgaggtcagtagttcaagaccagcctggccaacatggtgaaattgcgactctactaaaaatacaaaaagtagctgggcgtggtggcatgtgcctgtaataccagctacttgggaggcggaggcaggagaattgcttgaacctgggaggcggaggttgcagtgagccatgatcgcaccactgcactctagtctgggtgacagagcaagactccgtctcaaaaaaaaaaaaaaaaaaaaaaagtagccctctctaagtcttaattccttcatctgtaaaaacagaataatgacttatgttagagatgctgtgaagagcccagggaataacaagtgctgtctgcataccacataacctgtccgctctcaaaggtggctgggctgatgatgtctggaagaagaaggctgggagaaatgctggttcccaaagtggtcagtaccaaggccacctagtccaacccttgcccctaggcctgtggttcctttggggcagattccagtctcgccaccacccagccaggggagtctgtgttgaatgggccatgtcctggaagtatgaaaggctcagccctctgagctgctggatggctctgtcctgtacccgccagtccataaatggtcagcagagcacatggcccacctacccgagccaaaggagttgggaaaaatctgtctgggtggccccctcatcctctcaacacacaggcctagagggaaaagggtactgtctaatgccagtcagtgctgtcctgagctcagctgctaagaatagcagggagtgaggtggtggtaaccagcaggactcaggcagaacagaggcccattacacacctggctgcccacaggctgccaccacctgctcttccacctttcatgccagttcctaccctactcatccacacagacagaaagctctggaaggggacgaaggtggcacaaagcaccctgacaaagtagccactacccaggctcagggatcacatattcccccagtgtaagccactcccagccctgagctgtaggagcagagatgcacaaaggcccctccccactgctgctctgtcccaggccaaggccaggtggtggctatgcagtcggggtgctcagctagtagcatagaaggctaaagccaaccccatctctgaataccccagtggaccaaggataaaggagcctttctcaaaagcagttacaggccaagcatggtggctcacacctgtagtctcagcactttgggaggctgaggtgggagaatcacttgagcccaggggtttgagaccagcctgggtgccacagtaagaccctgcctcttaaaaaaaaaaaaaaatttagctgggtgctgtggcatgtgcttgtggtcccagctatgtgggaggctgaggtgggaggattccttgagcctggaactttgaggttgcagtgagctatgactgggacatagcgagaccctgcctcaaaagaaaacagttcttaacaagcccacacttggagtggctactcttgtacctgacccccaaagtcgtgtgcctgatcctgagagcagactgcacatatctgtgggcagtcggcctgagacagccaccactgagtgcctacagcacggcccatttggccaagaccagcaacttccctgacctttttggatctcctaggtcccagttcagggccctgaatccccacaaccactgactgacggccctaccacctgctgtctctcctggcggccacagcagcagcagcagcagcaggaccatctctggtatcacatgaggtagggatcagatggctctgagaacaggccaggactgagtatggggtgggggtgggcaggaactctctgcaagcaggcactttctgaccaccacaattgcttaaatagaacaggtaatgatgctgccttttggacctgcctaaagagcagaagtcgtaaaagacagaacagctaaggctgataagggggtgagagacagggacaaccgtgcctcactgcagggacggagaacctacttgatcctttgaagaagtaatctggcaacagtcttaaaagtgactgcagttcaaacactctagccacacgactccagccctgggcatcctcacagcattgtttacaaaggcaaaagtccttccaaactagggcacttgtatgggccacagcagaccccctggccctaaagatgctcagtaagatacattgataatgtggaaaaatactcacgggataacatttgataataaaaataggatgcaaacttctggaagtgagggacatgtccattaccttgatggtactgatggtttcacgggttttatctatatgttaacacttatcaaattgtacactttaagtgtgtgtagtttattgtatattaatcatagctcaataaaaatgttttaagaaaagaactgaaggtgacaaatttttttaaagttttctatacagcataatctgaactacatacattataagataaacagacatgaagttaaaaagcttctgcatagcaaagtaaacgatcaacaaagtgaagagacagcccacaaatgggagaaaatatttgtaaactacccatctgacaagggattaataaccagaatatataaagaacgcaaacaactatataggaaaaatactaatagttccatcaaaagatgggcaaaagatacgaacagacatttctcaaaagaagacatacaaatagcaaacaggcatatggaaaggtattcaacgtcactggtcatcagagaaatgcaaatcaaaactacaatgagatatcatctcaccccagttaaaatggcttttatccaaaagacaggcaacaacaaatgctggcgaggttgtggaacccctgtacgctgttagtggaaatgtaaattataatagtgcaatcactatcgagaacagtttggaggttcctgaaaaaactaaaaattgatcaggtgtggtggctcatgcctgtaatctcagcactttgggacgtcgaggtgggaggatgacctgaggctaggagttcgagaccagcctggccaacacagcgaaaccccatctgtactaaaaataccaaaattaactgggcgtggtggtgtgtgcctataatcccagctacacgggaggctgaggcaggagaattgctagaactcgggaggcagaggttgcagtgagccaagatcatgccactgcactccagcctgggcaacaagagcaaaactccttctcaaaaaaaaaaaaaaaaaaaaaaaaaaaaggccaggcacactggctcacgcctgtaatcccagcactttgggaggccgaggcgggtggatcacgagctcaggagatcaagaccatccttgctaacacggtgaaaccccgtctctactaaaaagacaaaaaattagctggacctggtggcgggcgcctgtagtcccagctacttgggaggctgaggcccaagaattgcgtgaacctgggaggcggagcttgcagtgagctgagattgcgcccctgcgctccagcctgtgcaacagagcaagactctgtctcaaaaaaaaaaaaattttttcaaaaagaaaaaactaaactaaaaattgagctaccatatgatccagcaatcccactgctgggtatatacctgaaagaagggaaatcagtatatcgaagagatatatacctcaaagaagggaaatcagtatatcgaagagatatctgcattcccatgtttgttgcagcactgttcacaatagccaagatttggaagcaatctaagtgtccatcaacagatgaataaataaagaaaacacggtacagatacacaacagagtactattcagccataaaaaagaatgagatcctgtaatttgcaacaacatggatggaactggaggtcattatgttaagtgaaatgagccaggcagaaaaagacaaacactgcatgttatcacttatttgtgagagctaaaaattaaaacaattgaactcatagaggcaaagtactggatggttaccacaggcttggaacggtagtgtagggcttgtggggagatggggatggctaatgcgtacaaaaaaatcgaattaataagacctgtctggtagcagaacagagtgactgtagtaaataataattgtacatttaaaaataactaaaagagtataactagattgtttataacacaaaagataaatgcttgaggggatggataccccatttaccatgatgtgattattacgcattgcatgcctgtgtcaaagtatctcatataccctataaatacatatacctgctacatacccacaaaaattaaaaattaaaaatgtaacacaaagaaagaaaacagaaaagaatcgcatttgaatagtcatgttaaaataacaagatagcaggtgcttttccttctttttttagagacagggtcttgctctgtcacccaggctagagtgcagtggcatgcagaggccagctcactgcagcctcaacctcctaggctcaagtgatcctcccacatcagcctccctaacagctgggactacaggtgcacaccaccatgcccaggtaatttctgtattttattgtagagatggggtctggccatgttgctcaggctggtcttgaactcctggactcaagcaatctacccaccttggcctcccaaagtgctgcgattacaggtgtgaaccactgtgcctggccctctaagtttctgctaaaatgtacttgtaacttttacactgactacactcaaaagtattaaacttgtaaagaaaaggccctggaggagtttgttctttacaaggtcagtcagaagctacaaggggccaggctggggccaaggtgagggcaggtacatgcaggggcagatgctgggtgtggagtaggtgccaggtgctagctgggcatgaatgtgcacccgctccctgacctctgctccctgactctcacaaggaactagcactgcctggagacaggaagaagcagcgtacggaaggcagactctctggccagagatctcgcagccaggagcacagtgagaacagagcctaagcctatctgtccagagcccaggctccctttccctacaactgcagcctccttattctgctctggcccagcagagtgaggaggggccgcccacccagccatacctgccggtggctgctgggggtgcatggtcagaagaggaaagatgcggttcaggtagtcattcagcagcttctcctgcacaatgcctgagccacaagtcagaagggagaaaagggccacacgatgagtgcagctcctggcccctgctggccccagagacttctggtcctaggccagccacaggtgcagcaaggcctgaggcctttgtcccttccttctcctcccaacaagaggagcctccttccttctctgccagcccttacctgtgaccctggatttctcagcatctgaggtcagcctacagctcttgcgggagaaagacacgccggcccccttggatgccatccttcgtctctcatgggcagccagtggtcctggaggctgaggcagacacagagcctgtctactcagggccagccaggggcccccacacctgacctcagtcctgccatggcaggaagtcttgggagcaggtgaggccaggggcatgcacactaacacataggacaggggaatgcaggggctcccagcttcctacacaggcagggtagccagggtctaggcccatgtaacagggaccacttcttgttctccagtgtccctgtgcccagcacagggctgggcagagagcaggtaccagatatatttttgccaaaccataacaaaatgtctcagctctgtggaaatcagaccaaaatgtccaaagtgaggtgtcctaggggcagagcccctgtattcatctcggttgtaagccatactgagtccagctcacaaccagaagcgacaatcctacacattcccccaagtgcagaccaccactggtctggtcatctctagccataagtcccacttactccccacaaggctggagcctctttcctcagccctgggttcctcccttcttttatccatggtcctgatagtttcactgttcccactcacacatgtggcctcccacctcatccaagcaccacccttgcccagccctcatggcaaactccattggtcctcctagtgcatctatccctcacatcatgttgctgctgcagctgctccaaaacctgcactgagtccctggtgctggcctcactgatgtgtagctgtgctgtccaacacagcagccgtcatccacgtgaggttacttaaatttaaagttttaaaaattaacaattcgatttctcagttgcctcagccacatttcaagagttcaatgaccacatgtggctaacggttactctattggacagcacaaaggtagaacattcccaccatcatataaagttctattagacagcgcaggtctagagtttcgctctgcagcactgccttagccagcactccctactctgccgttcagtctcttatctcgccccaaacagaccctctactcccgccacaaacccctgtgggtctgcaccacgcctgctcctcgggaaggtgattttcccgacctcgggccctcggtgggcctccatgatcggtgccccttcactaccacagtagttgaagatctgattaaatgcagtcattcatttgatgagcagaccttccagacacccactccgggtgtcagttgctgaggacccaggtgagaggcggaccttgtccccgcccggggactccctgtcacggctatcccgtccaacctcgccggggtatccgggctcagaactgaacctactccgtctgggagcccaaggatggctcccccaagtcgcccccgcctggccccaagctccagaggacctgccagaccagcttccgctcggagtttcgcactcagatcccggcgctgcaggtgccctcgcagtggactaaactggaccgcgaagggaatagccggaacccgccaggctcagagccctgccgcccctcactcaccccgagcctcggccgccgcgacccggttcacaacatccgcccaacctctcggctacggcgtccgttcagggccaaatcacgcgcacgctcgcgcgctgagcctccagccgcgcacgcgcaccggcccgcgcccagcctccgctaggggaccccctccgtggcttcccaccgggttgttccaggcctcagcttcgccgaaaggcctcaccacctccgacctccgcctgccccggggatgctcccagccctgctgcggcagaacgcgacgtgctaaccggaatccctaggccgcctgtctcctacccatacttggaggccccgctcagacggtcctgaaaacgtctgaaaggcggttcctgccagagtccctgctacctgttacctccacccctatttagtcctagtggacagcttcgctcaccttccctgggatgacacttctggcggctgagatgagcgagcctctctgggctctgccgccgggcgtgggctgacctgcctacagctggggcctgataaggcagcagcaaaagggtggaggggaggcagtgttgaagctggggcaagtaattttccccaatttacagggaaaaaccgaaattcagaaaagtttaatgtcagccaggggctggaacccagacctctggcagctgtcactttcacaatgcccttgggctgactaggctgcagaggggtttcaccccaaccccagggcacctcaagtggccccaccaaaccttcctaacacctgaccactaagtagggaggcctctcagggggctagctgtgctaggcccttgcaactgacctgtgggacctgaggcctggcccctcatggctcctgtcaccaggtctcaggtcagggtccagcaggccctgagctgacgtgcggagccagagccacccaatcccgtagggacaggtttcacaacttcccggatggggctgtggtgggtcacagtgcagcctccagccagaaggatggggtggctcccactcctgctgcttctgactcaatgcttaggggtccctggtgagtgcccccaaccttgatccccatctgccttcaggaggggcttggccccattctcctattctgggatgagaaaaaagtcagggagccagaggctcagtgggcatggggcagtgaccttggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgcctttgtgcaggtgagagcccagctttggagtctgaatgcctagccagggcccctggctgggtaatgtgatggctctgagccttagcattctcatttgagagatgagatggggcaagctccatcacccactgctctcacagagcgtgtgtgttagatctgagcccggtgcctgggccactacacagaggcaccggtgataactaccaagtctgggcctgcttcccaggggaaattttttgacaagtatctgtgcaggggggctagactggcccttgaaagtgcatacagggtccatcccagaagccttgtagctttgatcccctgaatgaacaaactgtggacatgccaatacacattactgacatgtatgcccacctgacctgcacccactctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccggtgagtggccactgggcatagataagactgggggcaggggagcctgggccgtggcgttaccttgtgccttcttctctccagggcgttccactacaatgtgagcagccatggttgccaactgctgccatggactcaacactcaccccacacgaggctgcggcattctgggcgctgtgacctcttccaggagaaaggcgagtgggggtggagaggggcagggtgggagacaggggacctcagcccaagttgatcttctgtctcttgctcccagactacatacggacctgcatcatgaacaatggggttgggtaccggggcaccatggccacgaccgtgggtggcctgtcctgccaggcttggagccacaagttcccgaacgatcaccagtgggacaaacaccttccctccgtcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcggcatcaaatcctgccgggtgggtaagcggcgccgggtcaagctgggagagtggagggacaagcccacgcccatccacgaacccactggctctttgtctccagccgcgtgtgtctggtgcaatggcgaggaataccgcggcgcggtagaccgcaccgagtcagggcgcgagtgccagcgctgggatcttcagcacccgcaccagcaccccttcgagccgggcaagtacgcgtaggcggtatcggcgccctgggggccgggctagggaaggtccaggactccaggggcagggctccgtgtagggcaactgggcggggccagataagccagagtcccagggtcttcttcacgccccattaccgcccccaggttcctcgaccaaggtctggacgacaactattgccggaatcctgacggctccgagcggccatggtgctacactacggatccgcagatcgagcgagaattctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgcgggtccgctgagacgccgcacaagccgcagtgaatccctggtgctcccggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagccctcaccaccaaaggctggctcccttaaccgcagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagaggtatgtggacaacctgggagggtgtgaggtggggctgagccttgtggcctcagaccctgagtgcccccattcttgctaaagatctgtgaccctgaaccagcgtgtggccctgatctgcctgccgcctgaatgatatgtggtgcctccagggaccaagtgtgagattgcaggccggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccagggccctcatcagttctcctacctgccagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctagtgcagtttgttttcatggtcttaatttttgctaagactccactgcttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaggagctgtttttctcctttctttcccccggcaatatttactatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaaggggatgcctatcaattaattcatttagagagccatacaccccaagaaataaattatttgtcctctggagcttgtcacagggggatttttaaaaaaacattaaacagaaagacaactgtgcatcttagaaagataaaaggccaattcttcctctccggctgataggttcttaataatagtgatatctactaataagatgttttacatagtgtaaagcatgttcacatacaaattacttagcctctttgagcctcagttttcttatatgtaaagctggattaatagtacattttgtgtttaaaaagatgatgtatatgaagtgtttaccatttttcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggctctcagaaaatattctcagctattctgttagcttgatctcctaccatctgagagtgggcttccttcaaacaaccaaatttccaggtatttctaaactgcccttcccctacaccattctttgattcagtatttcaagacccctaagagaaatggtacatttacgtgtaagcacaggatagtgaagtatttacaacaagtgctttggagccagcaaatatggatcagaatgcagctttcctttcctacatacatgacattgggcagctaatttctaagattttacttctttgtctatgaaagtggagtactagtacttgctttgtgcaactctgatggttgttacatgaggtagcatctagaaacagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacgcaggattttctataaccctctttctgctttgagctcctaaaggtatttcatagaaaaatgaccttatttttaaatagagggggcagttgaaaatcagtgaacggacctaccccctaatgatttttttctcagacataattataataattagcattataaagtgctaattatctttggacacagaggacctgcacaccagagacagaggtccgcattaagtaaagtgaatttcactttcttcagttgtgagatttctcttttttcttctttgtaatgatgcaaagatatatcatccaccaagcctcatttaaaagctttttccagttaaggaaactatctcttggccatccacagccagactccatattgagattatggatattcaaagaaattgtctttcccttgtatattgtcataactttttgtgaaatgttcgttttatagttccaggccagcacctagaaccttgctagaataaaaaactgcagaaatcatgagtttctagtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgtaaaaaaattagacgaggaatggggcattggtgtaagattatacagagtgtaaagttgggctttctcttatcatctgttgtcaacaacaggatgattgttactgttacccactccttaccatcattcacacagagacattggatattgaggagagactttaaaacagaatattagtaatgcagagctataaagagccacgatcatattaatacaatcctccatacacatagtgacctgtctgcagctccagcctagagaaacccagttattcatttgtagtgggcagccccattatcagaaagcgctattcaattggaagtgctcatctgtgttaggtcaaaaacgacttcctctaaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttttggaatgctttagaaatttagcagttatcttttttatgtattttacatttgttacagctttccttggtggacagatatgagttttctacttgaaaataaacacgtttttctttaaaatatcattaaataagagtgtaattagtgatataaagcaagatgactaaaaagaatctctcattattatgtttgcacagcctgtatagaaattatttgaactagaaaggatttgctaagtaaattatttctatttccctcacttaatagtgaatattatggtgattaggggaaaaaataagctttcttttttcttttgagatggagtctcactctgtcacccaggctggagtgcagtggcgcgatgtcggctcactctgtcacccaggctggagtgcagtggcgccatctcggatcactaagccatctcggcctccccagctcaagtgattctactgcctcagactcccaagtagctggaattacaggtgtccgccaccatgcccagctaatttttgtatttttagtagagatcaccatgttggccaggctggtctcgaactcccgacctcaagtgatccgcctgtcttggcctcccaatgtgctgcgattacaggcatgagccaccacgcccagctaaaagaagcttttctgatagtaactttgttttcccattctggagtttatggcagtatgaaaaagactgaatttataagcagaagatctgtttttgaaatccggggacctgtatttcacaatggctttgatgtgttttgattgtgcacctttagacaacttatcagtttcctcatttttatacagcaataaaatagtaacagctacccattaaattctgtacagaagctagggacagacgcaataacacttgcatatctataaaggctttgtaaatgtgggtattatatctaatgtttatgcacatgctgtttgattattttcatttggaattccactccattaaaggaaaagtaacatacgaattcagattcttgtaagtcttcaggcatgaggcctccattgactaagtacattgcctacataatttctcctaacccaaatgaatctccagttaaaccaagctggtggttatgtactgtctccagaggatgccaagcataaagtccttgagtatattcatcttggatcctctgattggacaactgcggtattgagacttcaagttcccccttgaaggccccagacggtacctgtaattttactcaagttttaaatgtatgctctttgttaagaaagagtgacaatgatttgatttattttccgtgactggggttagggatgggggagactctaggaatgtgacttaccagtgaggttctagttttataaatcataggacaagttttgataggcaaatgttggactatagggctgaggttgttttccaccacaacatatagacttctactagcccttgaaggaaaaaacacgagaaaatcagttgggtcagctgagtattcctttacgagtatggaacagacttacataacaattctgcaggtaatggctctggaaaggtcaaccacttagttttggacaactcttttctattctgtataaccactttttcaccaaaatgatactaaataaatatgctataggaagctatattttgacatgactgttttaggcaaagatacactcaccaacttactccacaagagtttctaatcagagaatatcatatggatctatttgaattgctcccatgcttggctgagcccaaaataatttactgtgcatatgtacaccaagtgagaaggttgaggaggtgtcacttgtacatctctttattcttttttttttgtatgtgtgtgttattttcatgtgttttgaaaggctctcttgcttagcttttattttgccattaaagatttttttctgtgctataactgtatttttaagtctggtttgagttcaagaaatccacaaattcacaaaagattaggaataatttgtgaacaaaatgatgcagaaataaaaaatgcattttccaaataactcccttgcagtccttctcgcccaactaccactttctattaagtttcttcttcctactctatgaagtgccatgagctttcaattcattgtattttaagtataagctatacttactaaccttcacgttattctttgctacttaaataagcttgctttcatagttcaattgacgtattgtttaactgatatttttaattggtatattttgatatatattgataattgatagatacataattcatttgagatattttgggtatggagggttggaaggaatcctttcataatttttctacttaaaagaaatcttttttcatttaacagcttttcccatggggatagagttttcatgaataaagcaaagtcattaaatgaggtatatggtacatcttttaagagtcacagaaagaagcaacaacaatttacccaggcagagggtataagtttagaccttggttgcctgatttgtgggacaagttctttaattttttttctttatattttgacttttttttggactctctcctccccttccaggctccaggtcaaatacttgacacctgaatgatgttcaattatttaaaagatggattggccagctcagctcctgtctcagacagactgtctttaaatgtattttcaacatgtcttcagacagttatttttcctctgttcaattttgttcatcttcttacttaaccgttcaagtgctcctatttcctttttaaatgtagtattgagaagtgcaaacattattggaaaagagagtctcactagcataattgtgcattatcttcctcttatatcgccggcctccctgcacccccatgcccacctcctcctcgcgcctccatgccgcctcccactgctccagctccttgcagctgcgagtccagtcactggtcacctttcgtatctcctcactcagagcctggttggccaaacctgcctggtccagctgttctcagagcatggcattcacctgggccaggctggcactcctgaatggggcacaggggatcagtaggcgctcgcccagggggccatgctgccagccctggccctccctgctgctcctcctccagccagatgagggcactctccaggtcttggctgtgctctgcgtcctgggtggcacagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcgtctccagctcaccagattgcagccacagagcctgctccagctgcagggaagggccctgggtgagagtcctgggcctcctgggaaggcaggctcaggcctctgtagggggtggcaggctgggcccagacccacaatgccttgtaggctgatagcctggcgccctggggagcagcacatgtgggcaagcccaggggcagtgcacgtgtgcatggggtgatgcagccatgcacgggcacgcagatggggcatgcatggacacatgcaggtgagcccacaaacccaaaccatgcaggcaaagctcaaaggtgcacctggggtctacgtcaggggcctcagtacaccatgcgcctctcctccagaacacttagccctgtcgtggtttctgtttattacattgatgcctgtgtcttcccaccatgcccccaccccagtgtgagctcagaaagcctggattttttgttcctcattgtatcttagtgctataatggtgtctgtggaatggcatggctcacgctcagtaaatatttcttgtgatggtgaattaatggcatgagctcatgggaatacattcaaacagaggtgtcaatccgcctatgcatatctgagcttaaaaatatgcacacacataacacatacaggcaacctcaaacatccccagggggacacgaaggactcccctcatatacacagcattaagatttgtaagaggtgcacacagatgttgccctatacggcgcctgcatattaatgcccacttctggctgggtgcagtggctcatgcctgtaatcccagcactttgggaggtcaaggcgggtggatcacttgaagtcaggggttcgagaccagcctggccaacgtgatgaaatcccgtctctactaaaaatcgaaaaattagccgggtgtggtggcatgcacctgtaatcccagttactcaggaggctgaggcaggagaatcacttgaacctgggaggcagaggttgaagtgagccgagatcgcaccactgcactccaccctgggcgacagagcaagactccatcttttatttatttatttatttatgtattcatttatttgtctcatgggctgagcgaggggaccccggctggtggagggacagctgcgccctgcaggccgctgcgtccgggcagaccccggcctcttgtcgtgcccccggcccgcgacaacccgggcaggatgggcagcaggacgcggcggggcatccgcggagcccgtcgggaacgctctcttggcctccggtgccgggcagcggtgggtgcggcacccacagtgcccacagcgcccccagccctgggacgtggctccagcccgcccccaggcaggcggcctccttcgccgggagcacgtcgcctgggcaacatggagaaacttcaactcttaaaaaaacaagacagccaccacaacaacaaaaagaacagatataagccggctgtggtgactcgtgcctctgctactccagaggctgaggtgggaggatcgattcaaccaagatacagtgagactgtctctcagagaaaaagtcaaacaaacaaaaaaagaggctgtgtaagaggtgactctggggacagtggaaaaacactaaggttttcaagtggtgttaaaagccactaggccttggggaccattgagcaatctacaaagcacggaagcctagatccctgagctctgcctgccaagtaccaccacagctaacatgggagacctccccgacagagactgaaatttgcctcccgaggaaacaagtgactacagacatctgtcccaggacagtaaacaagaaagcaaggtctcacaaaaacaaaaacagctgaccacagcatacaatcactgagaccgagcctgcgactataggtgaaaaaaaaaaatgctgtccattattcataccatgaaagaccaggggaaagtgggaacgcagtcccctactactgttgtgggaatcaggagaacagagagaccaatgggtggaacaggaggatttattgactgcactgaggcccagcagatgaaaatccaaaggctgagccccgaacaaagacagggcttaactttatagacacttctgaaagggggtcggctagtttgaatggcgcggcgggaatttgatggcatgaaactcgggggcaggcaagagggcttatagaagcagaacaaaggcagctaatcaaactgtcacaggtcttgcaatgcaagtatagctggtgaccttgcagctgcactgaagggaaatcaagaacttaacaaaacttgaataattagaaatgggaagggggaaagagaaggtagtaaaggcatttgttgttttttcctcttatctttgttggggcttactgtgttgagagagtctccggaactcactcctcgcggctctgacttttcagatcgtgttaccgaggatctactagggctctatctatggcaggtcttggagtcagccaagtacagggaacctgtcttttccttttaacttctgccttattactacaagttgtacagcacaccatgcctggttttcatcagcaatgtttcctgaggttacagaaagatttctaatcctgggaggaaacactcccttgaagcaaaagtgttctcccccaaaaaatgcaaggagctatcttctagatagccaggcagataattctcaggttttgccccacagaatctctatctaaaatacagcagtggtcatgcctagtgaaaagtttgagggaactcgcccagtgttgggtttcttcagagccatatatatagatataaccaaatatcctaaaagacactgcccttcatcattccatgctgttagacatttacaggaccatggatggtgatctcctccagacaaaaataaatgctggtgcagaataggtaagtgtattataatttgaggacatcagcttttgggcattttaaaccatgggtcagacatgttagagcaagaggccaggttgatagcaagagggagtgtttttcttttaatttgtcaatagcaaagtgatgtttgccactgtgatttcagagtgaggtggcaatttgttgttgtttggttttgtgggtttttgtttgtttgtttgtttgtttgtttttgagacaaggtctcactgtcacccaggctggagtgcagtggcatgatcagggtttactcctgccttgacctcatgaattcaagcaaacctccttactaatcctcccgagtagctgggattacaggcacgtgaccccacaccctggggtgtgaactgggatttgatgttttcagttggctctctaatggaataggttcccttactcttgtagaatcagattgtcttcatgattatcattcttgtgtgcattatatttctactaccctgctatttttttttctatttttcttttttctttttatttttttctttgtgagacagagtctcgctctgtctcccaggctgtattgcagtagcaggatctcagctcactgcaacctccacctcctgggttcaagcaattcttttgcttcagcctcctgagtagccacctggctaatttttgtatttttagtggagacagggtttcaccatgttggcaggctggtctcaatctcctgacctcaagtgattcacccgcctcagcctcccaaagtgctgggattacaggcatgaactaccacacctggctctcaaaccattttagttaagcaaagacagatttgtctggctttttagtacaatgctgaattatcctccaatctatatttttaggaaggacctcgggaatggcaacttggagatatttggtgaaaatgtgaacctttcatgttctgcttcagtccctttttgaaaatccttccaatttaccttttgcaaccagttagtggccttcccttcttcaccagcatgtgagttaattgataaagatcagaatatttgggctcaaaggtttcaacagttaagtcaaattttctgccaaagcctacaggatcttggagcctgctttagaaacagaagagtgaaatgtatttaagtttagatcagggaagtcctttataatattcttaattcacgttttggtgaagtggtatacacaacggtaggctcccctcttcctgtgggtttgggttttaccttgaaaggggctgtcagaacagaagtttcagggaagggaccagatccctggggactttccttaggtgatggtgatggaagaagaggcaaggcaggacaggaaggctcaggtaagaaagactatgcaggtgcaggggcaggaggagaaggagcagttggaggtgaaagagacaaagcctcctcaatatttctcaaatcagaaaacatgacagtctacctccttcagcttacttcctcaatggaggcaattttctcagttcttttagaaattttagaaatttagacatttctaggtctcattggaattaagtctcctatttaatttgtctggttcaaaaaccaaatttctctctctctctctgtttttttttttttttttttgagacagggtcacccagactggagtgcagtggtgtgatctcggcttactgcactcaccacttgctgcatgacagccaataagtcgagagttgaggtgtaggggcagggaaggtgactttattccagagagccaccaaactgaacagatggtgaagtaacatcctgaagaaccatcttaaattaatactattttccggctccttgtacattagggaagggaggaagaaggaggcgattgaggtgaagaggtctgacaatgacagacatgggctgcagtgagagcccaaggggatggtgaaaattgttggtcctttgtcaggtcacacttctcttataaatcttcagcataacactgttacttgtgtatacaacctctctatcttctcaggagttagtttggggaagggattattatcatctgtgctttaaagttaaactgtaagctaaatccctcccatagatagcttggcctatgtgcagaaataagaaaaagcagttagcctggaagatgtcaccacacggtaggaagggttaggagcaaaatgcagtcagtcatgctaggcctccttttcattgccatatatttaatgtatttgaacacgtaagtttaattttttatactttatttttatttatttatgatttttttgagacagagtctcactctgttgcccccccaggctggagtgcaatggcgtgatcttggctcactgcgacctctgcctcctgagttcaagcaattctcctgcctcagccttctgagtagctgggattacaggagccccccaccatgcccggctaatttttgtatttttagtagagacagggtttcaccatgttggccaggctggtctcaaactcctgacctcgggctcccaaagtgcttggactacaggcatgagccaccatgcccagcctaaccaagattattaaaccattctaatttgtcaaaagagtcacactgatttttaaaaaataatgtaatgggccaggtgcagtggcctatgcctgtaaccccagcgctttgggaagccatagcaggaggatcatgaggtcaggagttcaagacagcctgaccaacatggtgaaaccccgtgtctactaaaaatacaaaaattagccaagtgtggtggtgtgtgcctgtaatcccagctactcaggaggctgagacaggagaattgcttgaacccgggaagcagtggttgcagtgagccgagattgcaccactgcactctagcttaggcgacagagtgagactacatctcaaaataaataaataaataaataaatataataataatgtaatgaactttttcatgtctttatataaaaaatattacattatttaaattgttcaaaagcatcaaagattcctctctgctatcaacttcatttattttattgtaccaaactaccaggaccattaatttaatctacagctaaatctattattttttcatgttagaaattcaacaagaaaatttttccctaatgaaacctcacatttcaagcataaggagcctgggcgagttggctcacacctgtaatcccagcactttgggaggccgagacaggtgtatcacttgaggtcaggagtttgagactagcctggcaaacatgatgaaaccctgtctctactaaacatataaaaattagctgggcgtggtggcgtgtgcctataatcccagctactctggaggctgaggcagggaaatagcttcaacctgggaggcagagcttgcagtgagctgagatggcaccactgcactctagcctgggctacagagcaagactctgtctcaaaaataaataaatagataaataagcataagtagtaaaaaaataacataaatttaaaaataaggcacagggtcttgctctgttatccaggctagagtgcagtggggcaatcatagctgaccaacttggaacttctgggctcaggcaatcctcctggctcagcttgccttgtatttttttagagatgatgtcatgccctgttccccaggctggtctccaactgctggcctaaagcaatccttccgcctcagcctgttgagttgctgggagtacaggtgcaagacatgcagcctagcattgtagtaaaacaattttcaacaaattcttaattttctttccttttttttttttttttgagttgggagtctcattctgtcactcaggctggagggcagtggcacaatcatagttcactgcagcctgagattacagtcatgcattatcatgcccggccaactttaaaaaattagctaatacttaaaaatttgtagagacaggggtttcactgtgttgcccaggctggtctccaactcttaaagtgctgggactgtagctatgagccaccatacctggcttaattttcttattttaattttatataagtgagtattattgttcctaagataattggggcagtgactcctttacaattttagagatctaatttgtctattcacttcactgaaagagtatgccaatttgtttcatgagaaaatatcctatatttgaaaagaaggaaaattccttccaccaaactagggtgcattctaaagaaacgaattgttctaagtaacatcacttaaagtgcaaacagaggcaatggtatctattaacaatgtttatcagtgaaggaaataaactgaaaatatgaacatcattagatcctcggagggccttcattgctgaaaatctgagtaatattgtgatactcttttgagtctggcaggacattctctttccagggcatgtaacagtgggtgaataatttcttttcattcatttccattaagggctgaacttccttaatgttctggagattattaaatttgatttgtatagttgtgaaaagtactcatattgctgattccattgcttatatgtgatcatataaatcttttctctttctgtagtgtggtttaaacttaatccttaaagggcatgtatttgaatttttcagctggttagaaacctgaatataccaatcaaataaaactgctccttacatgctacagatttagttttcttcctgtactaagatgtcttttagatacagtaaattcgttaaagccaagagcccctaggaaatgaagttgggtgggaggggggacatcgagtagtaagatcactcttgtaacagagatgccactcttgcagatattgacaaaaattgggcctataaaatgtttaccaaacattggaaagacaagatctgaacaacttatcattgctgcagtctcaaatatcaggaaatgccattattctcaggacaataaatagacaataaagaagactcacagaccagattagctgtcatgtatcaccaaacagggactggatccttgttaacacgacccaacagagattgtccccagaaattcacttcataacctcaaaaccaaaaacccacactgatggcaaaaaataatgatgcaaagaatgagagagaaagagagagagagagagagagagagagagagagagagacctgtcctatagccatactcagtgggtaaaagccaaagagctcaatttctgctcatgatacttaatagaacatagggaacatgagccaatagctcaatgggttcagatctgcaccaagtgcctgttggacgcaggattctactgtctccaataatatgtctcagatgcactaattttttttctctttttgagacagagtcttactctgttgcccaggctgcggtgcaatggcgcgatctcggctcacagtaacctccacctcccgggttcaagcgattctcctgcctcagcctcccgagtagttgggattacagacacacaccactgcgcccggcaattattattattatcattattattattattgtgcgtgtgtatgtgtttttagtagagacggagttttgccatgttggtcaggctggtcttgaactcctgacctcagctgatcaaaagtaggtgaggtcagaaaacataccctgggagaggctggcacaatgcccagaaccgctatcgctaggcctggggttttcctctgtagtggaatactagtgttcatgtagtgcagggacaaaaccaattagatagttctgggagttaaaaagagatgatttacagtgccatttgagaaggggtattaaggaatttgccagggcactgatgcgtgtcaggtgtaaacctcaggttgagagagagctaagtattttctgtccatgaaggtgataagcgagggcctgaagaaagagggactggggaggacactggcaccagaaataggaaagggcttcttgggggtgggaaggatgggtcacggtgctatctataaagttggctggcagtggatgtaggatgtgggagtgagacatcaaacatgaagcagtcgcttaaagtctaaagaaacactagatatatgaactgcaggagatagtagggaaactggaccggctcctcataaaacttcccgccttctatctccgggaggatcgcagggcatttccgccaagacaggtgagactgcggttctgacctgcgggcctccatgcatatgcgctagggcacctgggggccggcagagccgttcccctacgcaaagtaagagtgttatgtctacaacccaacggggacactgagagccccaaaggccctgctttcttcccagagaacagcgcccatctgcataatttctacctggctctatgaggtgagaacacactccccgctagcacagaaatcctacaaactcctgtgggggctgcgcttggaagcagaggctgtgtaagaggtgacttggggggtagggaaaaacacgaagattttcacacagggtgagaacccaagagactggagaccacggaccaatccctgcaaaaagcagccagggtagaaatggaagagctgagcggacttcacgatagctaatttgtgttacaaagccgatacggctgatgctcgctttttctcctatggcgtgcaggccacatgttacttcttattccccaggcctccactgtaggattaacaactaagacacaaaccaatacgaaaaaagacatgacccttggcgtacggtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagatcttcgggctctgccccgacacagcctcatacgcctcactctttacacacacggtcacttgccccgcgcactcccgagccctttccagccctgacacacagctgggattctcacttccgatccgcggtcctgaacccgctcccagggcacgggaactccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattcgcagactagaatgtttcggattacaaaagaaaccggttctcttcacatccttatccttgtgatgcagcattccgcttgcaattggaagccgtttaatatcagagagaaaccatatttatgaaagtaaagaggctgcttagatgactgcaaaccagccgtccttactggttttatcactggtaatgttataaagacagttgtccagtttcatgaatcttgtaggtttttttttttttgatgttgttttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaatattccaattcttggttaaagaaacccatcaagatgaaaccccagaacccattattctctcttgggtatgcccaagctcccctttcttgagtgtgtactttttgctttgcaataaatctcttctttcactatctgctgactcatctttgactttgttctcacgatggtgtcaagagcctggacaccacggctggggtcgagatcccaccagtgtccagggacctcccccagcccaccagtatcagattctattccattgctcaaatcacaaaacatcgagtggagagttctccttggagatcataaagtaaagattctgtggcatggtggccagttaggccactggaagcatggcaaaatattgaaaatgagggattaggtgacagtgtagtaactgctgaatactaaatacttgatccaggccccattccctggagattgacagggagacacattgtccaggtagtagtggagaaatgttttctgggtatctgaccagcctttgtggaaagaactggcaccatcctgcagatgtaaccgcctgatgggttcttcctgaccaatgtacacaaaaactcaattcatggagaccatggcactgcaggaaacggtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggcgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatgttttccatatgaaactgttccacttcaggtcatcaggcatcagttacagtctcataaggagtgcgcaatctggatcacgcacatgagctgtatcaccactcagctctcactccagcctcaggtatcagcaagacctcaccaaagattactgtttaattgtctctgtgtgtgtttttgtttgtttcaggtaacaactaatgttggaattatgaaaagctcttctctacttttaacaaagcttagtcacaaacagttccccagttgatgagaaaaactaaaacaacagaacaattgaaagtccgaatctgcaagttcatctctgagaaccgaattttacagccactccagatttgtactccaaatggatagtttgattgtagaaatcacttcccttcagtctgccaatgtgataactgcccaagagaaagtgatgcctacattcgtagataatcccctttcccccatcctatatataactggagtcaacagtagctggaggaaaatggcaagaacttggaatcaagattaggttagaataacactgctgtagacagtttatcagctcttcagcatatgtccattttccttgaaggatgagcctttagaaacctctgacaataaagtttattttacatccattcccttgcctatgattttttcatacaaatcacaattataaaactttcttgctccagctaaaagcaagaaactcaatcatgaatgtgttcactaaatatataccacagaatgatagcaaccagtctgaatgcatcacttgattccaaaattaaatgttagccctcagtggtgcaactacatgtatctccaactctggaagccacaggcaacatattcctgtttccttgcagggaaacagatctataagcagggcggcagtctcacacatgtacattcctgggaaacccaaggaaacaatgatagtgacgcagggcaggcaagcccccaaactgaaagagttttgctaatgtcgcgattggctttctatgttatttgaagactgagatctccatgaggaatgaagacaggtaatgcctaaggctgaggcatgacctcactgggtcaccttagctgtgaagtgaggtcagttgtcaccttgcaaaccttttggtaatccaaatcttggaatgatttctttaagaatttagacacttccagtacttttcctgtccttgtggggaaagcttctatccacctggtgaaagtgtctataaatactagcaaatcttgtagttccctgtaaggtggcatctgggttaagtctgtctgccagtcttcaccatggtatgttccttggtgttgtacaggtttaagcagggatcggggtatggggtggcttcctgagtggtaaccctttttatagtttagaacagtcccttcccgaagaatatttaggaaactaatttgaatggaaaatcccgtcccaaatgtgaggaatcatgaaaatgtttaattatttcccatctgtcagcctcaggaatagagtttgttcttttgtagcaaccatccagaggggtctccctggaagccttttactcagtccctttaatttccttaggggtatagtatggtgtcactgacacggatgcagtacctggtagtagcgcagcagcttgaaataccagggtttccttagttgtggccttagctgctctttccaccagggaatttcctctaataataaaagtgtctcccttctggtgtcccctgcagtgagtaattgttatttctttgggagttggacagcatctaaaagttccaagatctgagtaaagtcgtatgggggatcccttggctcttgatagtcccctttccttccctatggctgcatgagcatggagcaccaggaacccatatttagagtcagtcaacacattgactcttgagggttcatcctccccgcaggcaactggagatgtattgtccccagagggtacaatagagaatcttccgtcacaagtcagcaaccagcatatgtgagtgacagcatgtgtcccactcagaaatgagagtgtattagtccgttttcatgctgctgacaaatacataacagagtccaggaccaaaaagaggtttaattggacttacatttccatatgactggggaggcctcagaatcatggcgggaggcaaaaggcacttcttacaaggcagcagcaagagaaaatgaggaagaagccaaagcagaaacccctgagaaacccatcagatagtgagacttactggctatcaggagaatagcacaggaaagacccgcccccatgattcaattacctcctcctaagtccctcccacaacacatgggaattctgggagatacaattcaagttgagatttgggtgagggcacggccaaaccatgtcagaaagggatgaagtgacagcatatcctgatgtgtgtgatggtttcatgagttattatctatttcaaaatttattgcaatgtgtggaaaagaacaaggacttgtactatctgactttaaggtttactataagctatcagacacaaggcatcaagagtgacaaacggataaacagcctgagttagaaaacctgaaattgatccacagctatacggtcaataaatgggttttcagtaaaagcagttcaataaaagaaaataaatcatttcaattaatgaacttctatatggatgtggggagaccaacaatgttattctccctcacgttacacacaaaagtaatttcagccgcattacacaccaaaacttaaaagttaaagatataaagcatttcaaggatactttgtgacttgttggcaggcaaagattagcctaccaacaagcaggacacagaaaaaatacatatataagaaagacatgataaatgagacttcatcaacattagccacaccttctcatcaaaagataccactaagaaagcgaaaaggcaagcaagccacagacagagagaaaatacccacaaaacgtatctgacctccacatcctgcaattataattatagtggtctggtacactgcacccagtttctgctggatggagtattttctgggtgtctctaatgagtaagagagggccccatgggatattccttcagttcccagatgaacagtgggaaagactccacattgaccaacctcgggggcctgaaaacccaggtcctcaaggagggtagagtatacctggaccctgacccagacccctggatgggctgtgccaagagacccagcaagggaagggatttcctcctgcctcaggttctctgttcttctgtggttagaccacctgaacccaactccctccccaagcactagagatgggcttttccaagggctggggatcttgctgtcctgaggacagctgagcaagggggtcgaggaggagcttgggttgtggaggagaggaaaccgggtaagatgcgtgaagcagttggctataccaggcacagagaggacccgctgggacccaagagcctgcatgtgaagccaggccttgggccaccttgtctgtcaagggggtgcctacttccatggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctgatggagcctgaggcaggtgtgggaagatgtggattgtctaactggaggttgggagtccagggtgtagaagcagcttggagtgcaggatttggtggtacgtgtgtggcagtaggcaaaagaaagagacaactggccgggcgcggtggctcacgcctgtaatcccaacactttgggagaccgaggcgggcggatcacgaggtcagatgaagaccacggtaaaacctcgtctctactaaaaatacaaaaaagtagccgggcgtggtggcgggtgcctgtagtcccagctactggggaggcagaggcaggagaatggcgtgaacccgggaggcggagcttgcagtgatctgagatcgcgccactgcactccagccactgcactccagcctgggtgacagagcaagactctgactcaaaaaaaaaaaaagaaaagaaaagaaaagaaaagaaaagaaagagacaactgagccacttgaaataccaagagaattcaaatttagaaaattcccagggaactatgcgtgcaggcactcaccagatccacaaaacagctgctgcataactgcatgttgcaagcaagccctaaattgctgattttgaaacagcctgatgggttcacaaagacaatttctgaatagtcgtaagagcagaggtgcactaaagccactgtgccccgcaggcccggatcccagtaagttctttaaggagtaagtcttacttccatttatggaagatttttggagttgtccttggtcacccccaggaatgttttggttaggagtagaattttagatgtcatcaatttaaaaattaaaactaaaacgctggaactcatagagagataaaattaagagaatacattcactatcctgagtagaaagatttcttatagaacataacaggctttaaaaataaagaaaaaaggccgggcgcggtggctcacgcctgtaatcccagcactttgggaggccgaggcgggtggatcctgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaagaaaaaatatggcaaaatttcatctaattaaatgctttgagaactaaaattaaaatccaaagccactggacagactgcttcttggccaaggagaccccagagaagtcttaaatactgagttcctgcccagtagttggaatctcagacacctctccttatactctctccctttgtggtttagacacaactgaccagcattattgttaaaatagagatcctaagactgacagaacagactccttgcagtaggaagatacggtatgataaacgagacctaaggccacgccaggcaaggtggagtcatgcgcccctcaacttaaagaataaactatgttctaattgccacaggtctttttcttcttcctttttttctctagctaaacaagcactggccttgagataagcaatgctgaagcacttgcagctcacccattaccataaactgactgagccctccctacacaagccataactacagctttgattggacaagagactgatttcagtaacttccccttgataagagagcactggctgtggacgggttctggacggtttacagaggctgtgcacttgactgcctttgtgtccctgcttccccttttgaagcatagggcctaattataatgtatttaaatgttgtctccaccccaaagtgaacatgggttgcatgtaacaggcatgtttactcagcatgcatgcagcaggatcccttcatgaatattcagagctcctcctattccctgttgaatatgtatatgtggcccaccacatcaacataaatccctgttcccccctcccctccctggaaacgtacttttcaggtttcagcagcaagagggtatgcctccctgtctgtcagaatggccaccttgcaggctgtaaccctttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaaaatcacaagcattcttatacaccaataacagacaaacagagagccaaatcattagtgaactcccattcacaattgcttcaaagagaataaaatacctaggaatccaacttacaagggatgtgaaggacctcttcaaggagaactacaaaacactgctcaacaaaataaaagaggatacaaacaaatggaagaacattccacgctcatgggtaggaagaatcactatcgtgaaaatggtcatactgcccaaggtaatttatagattccctgccatccccatcaagctaccaatgactttcttcacagaattggaaaaaactactttaaagttcatatggaaccaaaagagagcccgcatcgccatgtcaatcctaagccaaaagaacaaagctggaggcatcacgctacctgacttcaaatgatactacaaggctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccttatttaataaatggtgctgggaaaactggctagccatatgttgaaagctgaaactggatccctgttctcattgcttgcacctgggagacacaggttgcagtgaactgagattgagccatggcactccagcctgggtgacagaacgagactacatctcaataataataataatagtaataatttactgttctcataaaaattagcggatggggaatggaggcaagccggtgcaaaccatgacaactagtttagattttattgtcaactcatgaaaaactcgttctcattttgtgtttttaaaaaattccactgatacagccgttttctctaccgaaaaagactataaccgcattatttcatcactggaagctacagacagagggcccttgagaggcggcatcttcacctacgggaatgtttcctgctcaattgtgagacaaagagcatgtccaagttttcctataggccaggccgccccctagtttctgcgctgtgggctaaactccagaagctggcgcccttcagggccagaggtttcctgtgctctctggaggctgctaggattaaaggcaaagcaaacgacaggtctattagccacagttgcaggatagaaaacactactgtgactcagattagaacagaggttgtggcaaccacaactacaagtattaaccactacacgaccacaaagtctgctgacaaccattgcacttcttctatttttttaatgtaaaaacactcacactattttatctggtttattctaggacgtccgcagatttttgtgcttttctgtctttcatgtgcttctccctttctctccccattctgctacataatttaaaaaaaatctcttctctcaggatccagccactgcctctacaacaagcctcctgggaggtctctttgtcccattgacatctctgccttctttcgctgcttttttttttttttttttttttgacggagtctcgctctgtcgcccaggtggagtgcagtagcgcgatcttggctcactgcaacctttgcctcctgggttcaagcgattctcctgcctcagcgtcccaagtatagcgtcccaagaatagcaggtgcatgccaccacattcggctaatttttgtatttttagtagagatgggatttttccatgttagccaggctggtcttgaactcttgacctcaagcgatccatccgccttggcctcacaaaatgctgggattacaggcgtgtgccaacgtgcccggccaaatttcaggccaacacctgttgacacacattgccagacacacggaatccctcgcggaacaccgatgggcccacaaaacacgcgggggctgcggtcgctgatgatgtgagcaaattcgattcacggtgtctggggtacagccctgagggttcactggccacctctgcgcaaggaccagtctccgccgctcccctcatctccacgcagattcttgcccacacacctcccctttctttgggccgatgacaactcttggacctctgaggtgactgtcctgcccgcagcttctctccttccaagagtgtcatttcttgatcctctccatagtggctcaacggtaagcccaaggtccagcacgcgaatcaggaaactgatggttctttgggtttgcagggatccttccagtgaataaatgaaagtaacaggtaccagtatcaaaactgcagtgactcaccagagacacttcatgcttgccagcttgctaagctgtttgagtccaacaactgcatggggtcctgggttagtctcctgccgctactttggtgagtgttgttgtcactttaccttgtggtggccaagcccctaaatgcactcttgggttatgcagtataattttcagcgtaaaagacaagtaaagagccatagcgaagtgaaaaacaaccacgtgcagtggccgggaattgaacccgggtctcccgcatgggaggcgagaattctaccactaaaccaccaacgcctctctggaactaccccctggaggataacagaaaagagtaaccacaaagatttagaaactgttctaagcggttttttcaagtgtcgactaaaagctaacaaagacatccaaaccaaatgtgtttttataggaaacttttattagacaacgttataaatatcaaaatagctcatttgtcggatcaaactcttaactctgaaaaaggtctttctacctgcattacaaacccctataataaaacatcagaaattcattcatgtttcttttttctaatcctaaatcttccatcatcaacctcaaactgctgccttagaggttctgagaaggtaacctaactggtagtttaggtaagtaaagttcaaatccagggaggaaataagaagcagaagcagaattagaagaaagacgaaataaaaggacagaaccacggtagagataatgaagaaacaaaggttggtccactaagttagtcttttgtcgttggttttttttggcaaaagagtaatgatcggtctcgtaatcattataatactattatttgtctgcttgaagatgtataaagcatttgaaggaaatgtgatgtgaaaagatgaagaacgcttgccgtcaatgtttcattgtttgggagaatcccatttcctaagttaatatgctttgatgtgttagctatgtaagcagtagactagtttaaggaaatattgacggtcaaatattaacatattagtcttttgatgaagttcaaatattagagagatttctttcctcaattttcaatggagacattcaactgaagagacaaatccagagttttctccacatgttgggtctgggagtcattatgactttttcaaagacaggagctgtgacatggaatcatgcttcttctcaagctgagaagccaagctaggtccaggctgagtcataaacttgagcccaccaaggaaatcatccttcacattgacctcgcagagctttggctgttctctgttctttgcccaacacccaagacacacaccagctctggccaacaaaccttaacatatgatctatatcaaccaaagctacatttattcccaaatctccttctaaaatacaaacctgtactttctactctcaacttctaaatctaccaaggcctcatatgcatctgagtcacagatgctaaaacttaaccggttttctgaggattatttgaggaaggggtatgcatgcaaatgtatatacataattcatgtgatttaggaatatggactctatgacttccagatgcagatttagaacctttttaaaaaatattttgtttttgttgtcttgcaaatcagccagatctgcaacttaccagagtaaagccaaaccaagcgggacccttaggaaatgcgctaagatgtcatccactttcagtgtcagcctgtgaaaattcaggcgacagaagagaataaagagaatcttaaggaatttctggaaccaaagctaatattaagcaggcctcttgctggcagaccagtggaaattgtacctggtcaacaatctgtctagattgaggaggtctaaaatgtagccacaggttcaaatacttttctgtttgtttcccaacctcgattaaactcacaaaatttagggaccaaaaaaacaaacaaacaaacaaaaaaaaaaacaaaccacgacgttcccacccagtctcgaatcagggacttttctcgtgtgaggcgaacatgataaccactacaccacagaaactgcatatgcaccaaaaaaggcaaaatatcatcatgaaaatcttagatcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcctccgagccctgggcgccccgtgcctctcaggagggtggacgccgcccttccagggatgcggaccccgcctcggggccttttccccggcgccggccgtcggggctcttggctcttctcgtcctcccaggaaccgtagaaccctccttgccctccctcccgtaggccgaggggcgtgagctgcgcctgtttcctcacggaccctttggcctcagcgcctcgatgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacttactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacataagccataggaggcatttaacagcaaattctaccctgataaagtatcgcactaaaaattttagtatgggccgggcgtggtggctcatgcctgtaatcccagcactttgggaggctgaggcaggcagatcataggtcaagagttcgtgacaagcctggccaatatggtgaaacccctcctctactaaaaacacacacaaaaattagctgggcatggtggcacatgcctgtaatcccagctacttgggaggctgagggaggagaattgcttgaacctgggaggtagaggttgcagtgagccgagatggcaccactgcactccagcctgggtgacagagtgagactctgtatcaaaacaaaacaaaacaaaaatttaccatgccactgttcttcaactgttatatatatgttaattatatgtccctagataaattttttgggagctgggcctccagctgggatactctctggaggagactcttcaggtcctttttggcctgaagtcctggagagtagaaagccccagtgccatcagacagccacaactcatcctcatcagtgacactatgaggtgaagacccctccagggtgtcaggagctctcagcttccagggtctttccagactagatgaataatcacttgtaaccaagagggactggacccggttcttgaggttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttaccactgtgtgaaaaataggcataggaaaataagacttcgaataaatatatcagcatgttaacatcagtgtattggggcagtggtagtcagaatgagaactaatccacagcattttacctgatgccagacactgttctaaagcattttataagaatttactcatttaattcacattagtatctgatggggtaggtagttcctttattactattttaacatatgaagaaactggggcataggaaagtttacaaattgggatttgaagcaacaagtctggccccaggatcttttctcttaactgccacactacacttcctcaagaatgagagagactgtgtttttcttctcttctggttttctttttttttttttttagtttgtaagcaaacatttatagccatgattccacagatgtggtaagtaaaccaacagccattcctaaataaaatacaagaatttccatcatgcatagtttacaggcttggtaagaagcagtctctttaggggctagatgcttaagaaatattcaacaaacaatgaaatcttggcttttttttttttttttacacaaatgtttggttatttagccacattagtgataaaacatattcatattctaactgcaagtggaataaacattgcaacaaaaatgcaacccaatcaaaatcattagtaataactattactccctcttagcagtaagaaccattattcttggatttcaaacattttattttctgtgcatagcttatagcactgtattataggaatcagagtgtataagcaaaaaaatgaaataaaacttcttgaagaccatttccattatttatgattaaatcaatgaaactatacaatttccacattaaatacaaattagtaaaagaattcctccaagtagtattgcatataagctacaactttaccccaactattttaatcactatgattcgagatttcctaggatttaacagcccaagattgggctgttactacctcagcaagaacaatcaccagtaaatacatgaactggggttatagctgaatttttagaaactctccagacaaaccacgtgttagaggaggtaagtagaaaaactaatgtttgagctgtgctattcctaccaggaactatgtcaaatatgcaaagttcaaacattcttagtaaaataatatgaaaggatctatatatactgtaaatttagcaaaaacacttttatgtacagaagcctaaatatcttaggaggtttagaataccaatgaagagaattgttaattcttcaaggctggtttcttatgaggattaaaaaccagcccttagtctcagatgcattccacctagatgtgttcacgaactccatagagtaagaaatataaaccatgaatatgtactcttaatttccattcttcaacttaatgttctatagtacttcagatttttaaatccagagtttggtgtacacttaggaaattatagtaagagtagattagagaagatttgcttgttttccttttgaagccatgtgaaggtttattaccctgtgtattttcatcactgaaaagttccccggtgactaataaaataaaagtgtcacaagctacatgatggatctcttcttttaatgttgcatacagtttcagtttggctagtgagggctaactagctcagccctagtttcattttattagagttgaccactaaaaactaaataaggaagttaccagtaaagctaattcccaatacaagcaaaaaacaaaaacaaaaaacaaaaacaaaaccattcgcataataaaatatatccttaacacaaaataagggtataacatattctgcagcatgacattttattttatttctcagctgtagctttttcattcagaaattggagaccatcttttcactgagttgttattccttcctcttcccttagcttagggatatgttgaaaaaggcttttcaacaagtattttattttttacaagttgctatgaaattaaaatttatatatatatcttaagtgtttataaagcactcaaaattgtagcttacatgtatatgacttctgaaaataaaaatcacacttctaacataatctttctgctctgcaaaaatattctacatacatgcatatgatcaaaacaatcttttcatgtttggggtatttcttacacatagtaaaagaaaagtcaacaattatatcagtacttcccctgttaagataactgagtgccacctagtgttcaatttctgcaactactaagcttacaaattcaatactgctattaaaacccaggttctgaaaacggcattttggaaatcttttttttttttttttatgtttacggtggcaaaatacgactatgaaaagaacatgatatcaaaatcagtataaaaatagccacaggctacttaaatatgacaaacagacttattttttttcttcaaatgcagacttctgcctccctcaaattgtatcaaaatctcaagggaatatctaggtaactggaatatacacaatgactctatacaatcaagaggccagggcttaatcagattccgtgaggacaaggcaaatgatttcttcaaaacacccattttcttactggaagtggtaggaaaagcagcaatgcatggttttttttttttttttttttgtaattagtagacatggtcttctacccataagctccattacattaaaagaacaaagtgggcttaacatctcacttaagataattcagcattattatcagttttaaaaaaaccaaaaatatcttagaaacaaatcagtctgctttaacaaattgcattcatgctaatgaaattttaatcttctttgtcatgatcaaaatccaaattgtaggacaatcttcagaaaagatggaatgtaaaatgttgagttcaatttagatgtcatcaatatcttcatcatcatctccaatgtcatcaaactgaatttcatcatcatctccaggaccaaatgtatcagtttcattgattttagcatgctctggaagctcgccgtatgcctgcagacttctagcttcgtctgcattgtattttaaaattacatcagctttgttatcctggtagtctcggagaccaaccaaaataatgtccgaggtatttatccaaaccttttttctcaattttcctctgatgtgacataacctctttacaccatcgaaacacattgcttctagccgtccatttcccaacattttgattacctgagcatactcctgaccatcctctttgaataccagttctcttttttcagattcattctcattcttacccctgcgtctatttttacctcctttacctttattcttgggcatggcggtggcggcgacctcgcggcgtctctgacttctttccgggtagcggcgaccgcggcggctgctgctccgaggggcgacacgagggagcgcgcgggaccaagtaggtgctggaggccaggcaacgtgcgcgggagaggctggcgacccagctcttcggagatccgcctgcgtccacgctcggcggcagcaaaatgctcttctggttttcaatgtggtgggtggccctatggttgtagtccttttataatgcaaaacaaaattatttttaacttacggtttgcatgtttccaaaacctcatgtggtctctaagtaggccttagtatttctataataatcagttggctagaactttatattattattattattattattattattattattattagcagtgtgccacaaactaattgtagaaattcaaacttatacgcagcctcattttgggtaagagttctcctattaacctcctgtcctcctcttccccactacttgtcaggtgtggaattggccaacagcacccaaatgtgatagctgactccagggagggaaggtgagccccacaccctgtgctcttaccgggactggtggtttcctcctgttcagcctcattcttgctttggccacaagtctcatagcccaggtcctggaggtccacctggacctgtttactgtcctgcttcagcaagggttcacctgcgtgggaagagacagcaggtgttacagaatgtctgaatttcccacatatgccctcagcctcaatggcacataccctaaccttgtggggcagggagggcagatccacagtgcgagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccattgaagctggcaagtgctttatcagcaggggttcaataaatgttgaatggagctgaactaatttagagtcccaagacacctagacctgcactgtccaataaggtagttagtagccacatatggccactttatactaaattaactaaaattaaataaaaccaaatgtccaagttgcactagccacacttcatgtgctcaataaccacgttatgtctgtatagaacatacagagcttataagacgtacaggctagttctttactagtaagtcatagttacctactaagtataactctgtatttctccagctcgttcgcctgagcaaagacagtggcttctgatagcagcagcttctcctggagatcttgatagcgttgtttgcattgtgacagctgggagcgcaggtgctgggtggaccctggtgggctaaacgctgattgggcccagtgtcacaaggctgggactggttctccaactgtgaaaggggccaagacaaggatcaggacagtccgaggccacccccatgcagtgatgaccacggcccgttgtgaaccccgtggactttactcaagtctgtcacagcacttctcatgccatttggcagtgacttgctttccagatggagctcctggagtgctgggataatgttttcttcatatctgtatccacagcacacagcacagcgccaatcaagtctacagaggagctcttaggaaacgttttctcagtggtcaaaaagagaaggggtggaaccctccactcatctcccctcacattctgtgccatcgattctctcagaatcccctgtattccccattttactgaatcttcagcatggctcctcccctaaacaggatcccaataacccatctgaggtccaggaacagacacctgtgatgagctgtgaccaaaaaaaaaaaaaaaaatggcattgataaggaagggatgtcattacatactacttgtctgggctgcctcataacctgatgcatccctatgttacagcagttaccccctcctattaaaattacctgtttatgtgccatctttccttaccatattaagtatctcaagggcagccattggttttattgccccatgccaatgcctagtgtgttatctgaaaaattaagtactcaagaaatatttatattgtaaaaggctttctaaaggctgaatgtaggctgaatattattactgttgtttgtggtacaaagagacctttctcttggtacctcttgattcacatgggagaacgttttaaagtaaacactgtcatctcgagcccttctccagtggtttttcattccatctaagcctacattgacttggtgggcatccactgtgaaggtagccccaaggtcaaggctctggggtctggggcaaggcctcacagtcacattcccctcctcttggtgttggtgcttcccaggagaaccaaccagttctgtgtttattctgtcgatggtgctggtcagatgcacaaggagctctggagtaagtttactattcccttctttgctactcagcacaagttgttcttgaggaggttgatgatattgtgggcattcttcagttttccctggagctttctgaactcagcctgaagactactctcactcagaccctctttggcaaccacagtctcaaccaccaccttgcccttctccttgtcttcctcaatctcccatccctcagacatttctgctctttcagctctgcattctcaaggcaaagatgggttctgggtctccacagttgccagacttttctccaaagccaccttgaggaactaaaagaaaatcatgctttgaagaagttaggccattaaagagggcccaagagaaacatgagattgcaaaggtagtttttgatgagaacaaaaacaaacaaaaaaagcagatctaaaatgaactccctacccagaacctccttagtcaggcaataagagcaataagatctcaagactaagttttattattattattattattattattattattattattattatttgagacagggtctcgctctgttgccggggtggagcgcagtggtgagatcatggctcactgcagccacgacctcctgggctcacgtaatcctcccacctcagcctcccaagtagctggaaccacaggtgtgtgccactacacccagctaatttttttttttttaatcgagacggagtctcgctctgtcacccaggctggagtgcagtggcacgatctcggctcactgcaacctctgcctcccaggttcaagcgattttcctgcctcagccttctgagtagctgggattataggagcgtgccaccatgcccagctaatttttgtatttttagtagagacggggtttcaccatgttggtcaggctggtcttgaactcctgacctcaggtgatcattctgcctcagcctcccaaagtgctgggattacaggcgtgagccactgagcccggcccacccagctaatttttttttttttgaaatggagtctcactctgttgcccaggctggagtacaaaatggcgtgatcccggctaactgcaacctccgcttcccagattcaagtgattctcctgcctcagcctcccgagtagctgggattacaggcatgtgccatcacacccacctaatttttatatttttagtagagacggggtttcaccatgttggccaggctggtcttgaactcctgacctcaggtgatctacgcgcttcagcctcccaaagtgctgggattacaggtatgatccactgtgtgcagccccgtgcagctaattaaaaaaaattttttttcgtaggcctggtgtgaaggctcatgcctgtaatcccagcactttgggaggctgaggcgggtggatcacctgaggtcaggagttcgagaccagcatgaccaacatggcaaaacccggcctctactaaaaatacaaaaattagccaggcgtggtggcaggcgcctgtaatcccaactacctgggaggctgaggcaggagaatcacttgaacccaggaggtagaggttgcagtgagccaagattgtgccattgcactccagcctgggcaacaagagcaaaactctgtctcaaaaaaaaaaaaaaaaaggccaggcttgatggctcatgcctataatcccacaactttgggaggccgaggcgggtggatcacttcaggtcaggagtttgagaccagtttggccaacatggtgaaacccatctctactaaaaatacaaaattagctgggtgcggtggcacatgcttgtaatcccagctacttgggaggctgaggcaggagaatcacttgaacccaggaggcagaggttgcatgagcccagatcgccactgcactccagactgggtgacaagagtgaaaccccatctcaaaaaaagaaaaaaaaaattttttttttttttcagaatgaggtctcactgcattgcccaggctggtctcaaacttctggactcaagtggtccccctgccttggcctctcaaagtgctgggattacatgtgtaagccaccatgcctggccaaagacttacttttacaggaggagtataaaacatctcattagtaattttcataattgattatgtgtcgaaataatatttttgatattttgtgtcaagtaacactactaaaattaagctcacctatatccttctacattttcactgtggctactagaaaattttaaattacatctgtggctctcattacatttctattggacagcactgggctgggtgagatgactaggggcagaaagtacattctgagggccagacaatcaaggtgattgatactggggttaggttaactgaagggtagaaaaggccaggttaataggaggcagggactgagtaaccgggaacaaagttatcagagcatgagagagagattctgggggtcagccgtctgggatattatagggaggaaggaggctgtgctacaagggccaagagacaggaggatgcactcaagttggcctggatgaagggacgaccctctgcgacttgggtgggggtaagggtggcaggctggggccagccctgcactcaccgcttctgcttcctagaaggagaaacagtgtcacttggtacctccacctcaggggcgcagtcaagacccgctgccaggccagcctctgcctgaccgccggctcacctctcttcttccagcttcttccgcaggaggtcccacctccaggcgggcatgctggccagccgggcctcctcctcctcctgaaacacaaccacaaagcttcagagcctgcaggggctgggagatagggggcaccctcaacctggggacctgaaggagtcagggtcacaggaagtgaccctttggatgcatttctgtgggacaagtggatggaggtgcctggtcacaccccctcagagctggcctcctttctcctagtaacccagacccttgtgtcctacaggaggcaccagagagatcagagctgagtgggacagaagcagagaaaaagtagccgggacccagaggtcctgagcctgattccccacaggggcaggtggccaatggccacaggtccaagatctctgggcagacgcagatgcgggcccccacccagcctcttggctcagggagattcaggctgcccctggctcccctgagaaggaccttcagcccatggttgccctcttcccaacagagtggatacgtgctctacaatcgtggggctgcaatgacatcaggggcaggtgtggtgtccaacataggcagtttacagcaaacagttttatttcctgaatattacagaggagaaagggtctgtacaccgcacacttcacacagaacactgcacacgtggctcccttgacctcagccaaggaggtagctgtgaactccagtggaaaaccagagagcaggccacactgccccagggaggagccgcagcccctcactcagaggggcttcttctgctgcctggctccacacagagctcagcaagaccacggggccagagggggacacctggtttgttctgtgcctgccctgcctatccgaccaacgccccacacaacctgctcacgatgggacctcagaggctgaggcagcctggtcctgggccctccgggctgctcaaggccacagtcctgggttcttcccgctgcttcacgcctctggagggcgtcagacaggcgtccaggcccacgttaagacgctcgagggtgaactgcgaattccgaattccgctgctcagatgtcaaacagctctgcctccttctccttccagaaggagaagctgcggtcgatgtagcggcagatgtcctcgttgctgaattcgcccatctcagacactagttccaaagggtcttcggcgggggcttcggaacccggagagtctgagatccggggaggcgcggcggggaggcgcggcgggccggcgggcgggcgggcggtggcggcggctgcggcacaggggccagggcctcgcgctgccccttgggcgggtcccccttctgaaccggagcggcctcttcggtccgctcctgttctttccccttctcttcctttttcttcgcctgttcttcgggggccggcccagcctccaggccgtttccgaagaacctgtgcctgaggtcctcgaagccgtcgctccagccgcgccggccggcctccacctcctccagcaccacgcggtggaagaggcggatgcgctcccacgggtggctgtccagccggtggaacatctcgtagcacagtaggtggcggaacttgcgatcctcgcggctcaggcccatctccggtagctggaagtagccgagcatgaagaggtcgagcgtgaggctttcgtagcgcgggggtgcgccgccgtctaggggcgacaggaagtgctggggccagtacacgccgtgcgccaggcccgggcttggcggcacgtgccgccgcaggctccgccagtggtgcagcagcttgcccactgcctgccgctgcctcagcagctgccgcagccgttcgttggggctgtgggcctcgcccttgctcaccggcagccggggggcgtccgtggcctccagctccggccagcacgggcggccgtcacgccagggagcagtctgcctaggcgcgcctggtccgcggaaggcccggtccgaggaaggcccagaggcgccagtgctccaggaagaggtaaacgatgcgctccttgcgcaggtcgaggtagtcctggacgccgcgcagttccgtgcagaggggcggccggcgcgccagctgctcgggctcaagtagcgccgcctggcaatcctgtgcctcaggcgggcccagggtgtccaggggctcccagtcggccagcgggccgtgggcggcggcggcgctgggctggccagagccggccgccacgtagtcctcctacaggatgggctcgcggaccggggcgccagcggactgcgggggcttgcggcgcggacagcgcgggggcgccgcgtccagtgcgcgcagctcgtaggtggcgcggtgatgctgcacggagacgccgcactcgaggatctcgcgcgccacagcctcgcggcaccagttgagccagtgcgagcggcccaggcaaagcggccccggcagtcagggcgcctcaggcagcggcgccagcggctggcccgtgtcagcggtcggcagctccgccaggtgcgcaggccggccgcccagcgcggctagcagcgtggccatgctcttgagcagcgtggagatcttgctgcaccaggcgggcaggctggcggcgcggccatgcattcggcgcgggtcgacggtgaagcgcggctccacagggcgacggagatgggcagcagctgctcagctccagttgctccaggcgcgcctccagcttctgcgccttgtgcagcacctgcaggttctcgattgctgctcgatgcggaggatgtcggcctcggtcatgagctcgccaaagggccagaggatggcgttgtgctcgcgggagtacctccagccctcgcgggggtacctccagccctcgcgggggtagcagcacgagctggcggccgtcagctaaggcggggaagacaagagaggggagggaggcgcgtctccctctggcccagctcccgccgtggcgccaggaaccttttgcatgtcctgggtggtgtaatggctccgcggggctgcgtctgcagggagggaccgcgtctggccggcggggggtgacgctggggtgaggcttcggcctgagccgccgctccaggctctgggcagtgtccactttggtcgctggcggggggcacggccggttgctgctcgctgctgcggcggcaagaacaggccagcagacggggtctccatgcctggcttgttcgctcattacaccacccaaggaacttgccaaaggccttgaagctgagaggcgcggtggcccgccccaacccatccgagggcggctattgtgaggcctctcctcccagactcatgaccccttctccagctcccctgtggcccaagccttccgctccctgtggtcaatgttttatgtgcagaatgagaggccactcctctcttaaagaggctgcagctgcagcttccactgagctgcccacccttcccctcccttcgtcgtgctggacagctgggcaccgtaatattctcatttgctcacttttctccacctctgatgtccagttttcccccctgggcctgccatcgcctccacagaggtccctgattcatcttggccctatgggatccactccccacatacaaataggaagcagcctcttccctgcttaacactccccgcacccggctccccagtgctccaggagaaagtccgttctcttctgggcctctggccaggtcttggtaacctggcccccactgaggtctctccagctcagcgacccccttcctccaggacagtcagggccacatccactctcacttccagactgccctgtcccacctgcggctcttcagccccctctctgcctggccacccctcactcgtcttccaagtgttaccttagacatcacctcctccttccctaacacaccccccagcccacgtataaggtggccggttagggctgccccagtcccctgcgttccccattgcagctggctgtgttgcatcagcccaggtacttctctccactgccacccactctctcacactgccccattttgtgtgcttggtgactcgcacacatgtccgcagccaccttagagcaggccttgatatgttcaccatgaatccccagaggctacaagcgtgtggggcacataaatggcactcgggggccaggcgtggtggctcacgcctgtaatcccagcactttgggaggccgaggcgggcagatcacttgaggccaggagttcaagaccagcctggccaacatggtgaaaccccatctctactaagaatacaaaaattagccgggcatggttggcgggcatctgtagtcccagctactcgggaggctgaggcgggagaatcacttgaacccaggaggtggaggttgcagtgagtcaagatcgcaccactgtactccagcctcagtgacagagtgagaccctgtctcaaaaaaataaaaaataataaaaataaatggcattcggggaatagtttttggatgaatggaaagcaactcatcctgccagctggtgctgatcagctcaccttacagagaaggaaactgaggctggatgaggctcagtatcggcagctggaaggcggcagcgcagcaatggagaccaggtccctaagactgagaccaaagctctcttggctactcagtgtggtccttggaccagtgtcatcagcagcctcacccaggagctggctagaaatgcagaacctcagccctgcccagacctcctgaatccgaacaggccttttaaccagatcccaggtgctgggcaggtgaaggagagtctgagaaaggctgctgtctcactccaaggacaagctgctgggggtgtgtgtggagactgggacaagccccaaacggggtcgtgccaccctgatttccctaaagaagatggccgggcacagtggctcatgcctgtaatcccagccctggccaacatggtgaaaccccgtctctaataaaaatacaaaaaaattagctgggcgtggtggcatgcgcctgtaatcccagctacctgagaggctgaggcaggagaatcatttgaacccaggagacaaaggttgcagtgagccgagatcgcgccactgcactccagcctgggcgacagagcaagcctctgtctcacgaaaaagaaaaaaagaaaaagaaagaaagaaagaaaataggaggtcccgaggttggtgttgggggtggcgtgggggatgggctgtgcatccagatgcagaccccagggctccctgggcaccccgccccacccactttccacctctgctcctcctcctcctccatcttcagctgcatcttgcccaccatcacctggcgcttccactcgggcttgggacggccctgctcatcgtgcgtggggatgagcgcctccacgtccagctgcacccccggcgcaggagtagtgggcggcaccggaaccaagcttccgttgagcagcggctgaaaccccgcagctggcggtgtggggctccggactggtaacagtgcaggtgacacagacggcagcggccaatcgggctgcagggagaagcggtggggctgagcgcctggtggcctagggccagggaagccgggtcgcaggctcctgctgggcccgcctacctggaaggccggctgcctgctgcctgagaacactgtggtcagccccttgctctgtggcgtcggcttcaggctcttgcctgccttaatctcagccagtagctccgagttgtcgcccatcgggaacatcacgttgaaagacttggtgcctatgcagaggcaggagatgaggcactggccagggtggggctgcatccctgccacccctcacccgcccctctgcagcccccttcccaactccagattggatgggtgcccatcctcggggccagcgggcagctctccagatcccaggtcctgcaggcagctttcagggcccccagaggcaggcccttggttccccgactgtggcaaccccaccatcctcccccaccctactcacgggatggagggcccctgcctggagacccctgggagttcatggtggctcttgggcatatattcctgcccagccactgactgcccagccccaaaacactacctggaatcagccaccggacctttgtcccaggtttcctggctcagcccggctgggtggagcctccctctggccctctccctacatcagcaaagcctcagtgacccttgagctgagtcaattggggcctccatggacatgcagagtccagaccccagagtgccagtaccacctgctcccctccctcgccaccacacccacagacagacgcacaagcagacacattggttgcaagccgggagcacatttatggcaaagcacggctcagctctaggggaaagcagagcccttactaaggccacaggaggcacccaggaagaagggcagcaggtaatatgcaaacacccagggcagagggtgcattttctggcttagccggaggaggcgaatggagatttggagagataggtctcttgagtcccgatgaaggggtcaggtctgggagggaggaataaaatgggccgacagctcttggattcccaggctggggatcccagagtgcagtcaccgggaggagaagagtaggagaaagggaaaatcggtgtggcttactcatttatttaggcaaaaccatcagccaggcgcagaatgcttgggtgcatatgtgggtatgagggtaggtatgaggtgcaaggccccacccatgcatcgaggttctctcgcctgccagcccctgcccctgccctttcctcaaggctgggcccctcctcccgtgcttttcctgcctcttccccccaccccgcgcctcagcctcagccaggagccgcgcacgcagctactcactcttcctgtgcctcaggactctcacttctagggaccaagaggagagaagtgacagcggagttaggagggaaagggggccaggatgagactgggatagcaggggacagggagcgggccagggagagcaggaggggggaagtggagaagagaggaggagcatttctgcccatctgaccctggctcaggctgctctggggccccatgagggtggtccatcgagttcctggtttggctggtgcccctgagggctgggcagggcagggccaccagtggctctagcccccagcaagggcctccaccttggcactgggttggggtagggcacccagccctggctgtgctgggtgggggtgtctggggaagcccagagtatatttttctctgcccttagcttcagccctgctgcagactgtggagggaaggagaaggaggctcggcaggtgctggacatgcttccatgggctctggtctgcaggggctggggctccataggaaccatagggggacaagctctgctctgcactcctagtcagggagatgaagctttgaggggtgccactaagcatgatctctgccctgagtggctgggtgatgaaggcaccccagccaggctgggatgggagcaccacatctaggcaccctgtcctgggccttctaggtgtcctggcagggggacactgtcccaccctacagaaaagaagcccaggaatcctgcgccagtctagctcttaaaaaggatgcctagggaagtcaccggggagggagggggaaacatggtgggtcacagctttgcccccatagccaggctctggctggcccagggcccctggcaggaactggctaggaagagttcctggcatatctaagaaggcttcaggtctgtgctgcttggaaagacaagagaaagacgtggagagaggaagagaggctcaggatagacaggggcagggggaagggtggccagctgcggggcctctctgaagctggttcgacttcaagtgtccctccagtaccagctcatcagaaacaccagcaccagctcatgggaaacaccagcgccagagctggaaggccctttctagcccgtgggaggcaggcccagagaggggaggggacttgtccaggccacacagctagagggtgggaggcaggcccagactggggaagggacttgccccaggctgtgcagcccggtcctgctttggcaggacctcaagcaacccagagccctctcttagggtcaagtactcaatgcggtaggggtggccggaagaccatgtagaagaggaaggacccgggcagtgacagctggggagggggtggtgtctagatttccctcccctttcagggctagcgccgccccccacccctcaacctgcccctactcactgccggtgggcgaggaggagcggcgctgcccgcagccagggccagcgccctcgaggggcagaggcgggaccggcggcggcgaactcgcggcctcgggcaggggcggcggcggcggcggcggcggcagctgctgctccctggacgccttggggtccgcggcgcagccgttaggcacgtggttcccagggagttccgcctgcggggatgaaggtgggggctcacctcccagcttagggagaggctgaggggtctgggtcacatctggccgggggcgcgtgcagagccgcggtcaggtgtggcagagcagttggggcccacgtagcatccgcgacggctgcgccgcctgcgggggagcggaggggccttcgagcgagccgcgggcggcagggccgaggcgcgggcagccggcgggcgcgggctggcgggcacgcacctcctcgcggtgcgccatgcccgggcgtgcgaccagcgtctcgccggggcagcggcccagctgccggtagtagtcccccgtgctgggctgcttgctgaaagcgcggggcttgcggctggagtcctgcctccgtagcccgtcgtggccgtcgcaggagctcggctgcgggaagacagtgaccggtggggctcgggcaagtgcccggtaggcgccccccacgcctccccacccagctcttcacctcctgggaactcgcggccagcggccgtcggggggtgcagcagccgacttcctagaccccctgttctcacggtgggcagcgggcgaggttcatgggggcctcggtggaagggcaggctccgcccgccttacagggaggggttctgggcaccggccaaggggcacagggtcccccactgaggccagaaggggcgggcccaggggcgggccggcccagccccgacgccagggggagctagagaaggggcacctcccagcttagccttcactaggccctcggccgcactccgctctcggctgtcagaaggactgcgggtccccagggctccgcggagccctgtctttcgggggtcccgggccggagggagccccctccagagcctgtgctctccgaggctccggcttgccccggaccccgcttgtccgtctaggggctgctccaacctgccacggtgctggtggtcctgctgtgcacctggcggcgggggcggcaggacccgacacctgctttacgtgatacttcctctcaggttacagacgcccgcgcacggccagcctatgggctccgacggcctgacatcacccggggcccgccaatcccaggccgaaccccccccagccgtcgcggatgccacgggggcgccaactactctgccacacctggccgcggctctgcacccgccccgggccagatgtgaccccgccccctgcgcctctccctaagctgggagctgagcccccaccttcatccccgcccgagaggagagagggctgaccgtgggcagagggggcctctcatatttggctgccggctccgggtcgcgtccccaccgtttccctcctgcatctggaaaccatcgccatccacgaaagcgacaccgacacccgcgctcaagcctcggatttcaggggccgtaaggcggggtcgggtgacagcgcggcttcccgccccgtcgcagctgcccccaactaggcccagctcagtgagggagagtgaggcggccgggccaaagactgagtgaccgggtgggggctgtcccctgccccactctccagcccatgcgtccctgcggtggcctcagacccttcaccccgcccgacctggctcacgttgcaggaaacgcgacaccgcaggattcgttttctgggccagcccgccggctccgcgccccctgcagcccggaggctccgacgccacgaccctgctcccacctgcggtcaggcacccgcgcgggaggcgccgcggcgacacaaagagccctttgtagagcttcccggcccgggccctggcgtctgcggcccagcacgcacacagccgggagggacgcacacagccgggagggggctcgcacagccaggaggtgacctcacagacctggcacttgggctcagcggtggagagggggcactggctgggccacctgtcctgtggatttgggcggggcccacagtctgcgccgggagctcaacgattccagggcccctgcagccctacccgcccggccccctctgcctcccagagatgaaaggggaaagccactgtgggagcttggtctaaggtggcgtgaagagggcagctactggagctggcctgcaggtttggtgtccctcccatgcctcccttgcccactggccttgtgacctgagtcaccttgtatgaattggccctggggtggctttgccttgggcttaagagagaactgcaaggtcccaggctccagcaggaccccagggagctgccacaccacatctggccacctgtgacctcaggctgtcccctcacctcttagaccatccttgctctgttcctgtggccagaacgccagtgttccccagggcaccctgccgaggatacccgcaattgctcagaccagacctctgccccaatccctgctccagagcctcagccaggcgcctgcaggccccagacatccctaggcacctcacacttcacctacccaccctgccctcatcctctccacacaggctcgcttccctccagggctcccagctcaggcctggccctttcccccaggagctcaagccctaaactggaaccagccacagcttcacttcctcccagcccctactgccggtgggcgcccagccctgctagtgcctgctcaccttcctccctccctccttccagcccttacctctacagccatgccactggcaccttccacctggcagccacctcccttgggtgacactctccgactgagcctggggctgtgggggtgggggggcatgcttggggaggggcagtctccatgcattctctgtcaactccatgacaacccggccactcctgtgcaagaggtggcacaggcccagttcctggtgaggaacagctgtctggacctgcgtccttcaccccccagctcccatggagggcagtgacctgctcttactctcctcccagtccagtgtccagccctgacccctcgtgggactcgccaggagctttgactcttgaatatgccatggacccagggacccccaccctgtgcccactagtgaggccaggcctttggcctgactggcccccatcagcccagtacccctgctgggaggcaggcagtgggtgagggctcactacctccttcttgagggcctctgtctccacgtggcggagtttgttcttggtctgcatgtagatgtcagctgcctgtggtcccacaggaggcttgggagatgggtagctaggtgggggtgggggcagttgggtgcctgggggcgggggtggcggggggaagctgggtgggggtggtgggggtatgggcttcccaatcgtgccccaaggcaggcccagctctgggttcagcatgtccatgtagctctgtatgtctgcagctctagtgctggaaagccctggggaggcagaaggaagggccagatttggaagcatgcagacagcctttcccccaagaatgagactctccaccacctggaaacaacttgccgagggccaaggtgggctccgggcaccacttggtacacctgttgtggcccctggcgttgctgggcttcctctccctggccctgccctgccccagcccagcacttattgggggaagaccaggcactccggtttggaggggaagcactggaggctttggtgtgtctagagggcagggtcacctggaaggggagggtctactccttgggagtacagatggccacatccaatctttgcagggcaccctgccaggtctggaggccaccatctggtggcgtgaagcaggcattgcaagtggatggacgcccatgctcagggcacggtcagggtgtgtgtacacacaagcctgcagtctgccgaggcgattgtgaatttgtgtatgtttgagtgtgtacgcatttgtgcacatgcttctttgtattgatgaatgtgtgtgcattgctctgtggacatggtgtgtgtgtgtgtgcatatctgtagtatggaaatagagcattgtgtgcttgtgtgtaaggtgggtgtgtgcagatattagcatggctctgtatgtgtgttcatatctgtatgctgtgtgtacacatgtacaagtgtgtgcttttgtgtgtgagtagctaagaataatgaatggtgggtggcacacgtggattttgtgggtggggagagtacatgtggatgtacatgtatgtctgtgatgagcacacacaagtatgagtgacatctgtctctcaccagaaagggtgtcgcctccccatgtttaaaagcaagtgataagagtagtctccgatattggctgtggcaggctggcccaaggccaaccctcacagcccagcagtctggcttcagtctgctctccctccccctcttcctcctgggcacactcaccacgtggagggtgctggcccttgatgctggagtggctggaggagcaggagtcgtagttggagagggtgctggtgggcgagctgaggtcaaagttcagaggctggaccgacaccgtggtgttgggtgaggacatgcctgaatccggctgcttcgcctccagctccacggatggatcccgggagagcacgcagtgctccatgctctgaaggggaggcagggaggccatgaaggcaactgcaccccaagatgcgttgctctccaggccagggtcctactcagccatgcctttgccgtgggatcttggccaagccacacccctctctggggtctcttccccatcgctagagggtctttcaggttcctccgggttaagattcaagcccagccccgccaggcagaggacccaggttcctgggaaactccctcccctggctcctccctgattaggagggtggagagatcgacgaggagggggccttgagctgcaccccagggggagaactgccaggagatcggccttctccctcacagatcggcacaggctccatggggaagggcacagcacaggcccatccctagtgacctggctggcaagccagctctccttgccagacctgggacctggagcagactcccaacaccagcccggcctgtctcctgatggggcccttggggtaagggtagggcctggatggccagctgagcagtgatgggcagccagagctcaggctgccaggcctgccattcccccgccctgcccggtctgtgcgtctgaccacaggcctgtcccctcccggtgcagagggggctgtggtaggggccctgcttacattgcccatgctgcccctgctgccggcaagcccgcttgctccgctgcctcctgcccaggcctgctcctccttgccccgtgccccctccctacctaagaagtgtcacaggcaccctgggagagagaggcaggcctggcaccaggtaacggctcagcggccgcgctcattggccccgtaattaggggctctgctggagtgtttgccttttctgggccagcgtcttctgtggcttgggtctgtccctgcctcagctgggcctgcttgagtgaggggaccagggcacacacaccccacccattccaggggaccaggccctgttacctaccgcaggagtcaggggagccataggaggtggcatgggcagcacccaaaggtgctctttacctgggcaacagcagtgggtgctgagggcaccaagccctgacccctgtaggcagcagataagaggctgggccacagcaggtgtactgcgcctggcctgagccacccagctctgcagtctgggactgtggcttcaaactttccctccccgacttactagctatttcaggcgagtcacctgtgctttttgtgcctatgtttctttatctgcaaatgggggtaacagcactacttgctctgctgagctccaggacatggcgcccagtaaatgccatactgtcaaatttttttttttttttttttagacggagttttgttcttgttgcccaggctggagtacagtggcgcggtcttggctcagtgcaacctccacctcctgagttcaagcaattctcctgcctcagcctcccaagtagttggaattaaaggcacccgccaccacacccagctaatttttgtatatttagtagagatggggtttcatcatgttgaccaggctggtctcgaaccctgacttcaggtgatccacccgcctcagcttctcaaagtgcaggcatgagccaccacacccggcctgtcaacttttttattttattttattttatttttagacggagtcttgctctgtcaccaggctggagtgcagtggcgcggtcttggcttactgcaacctccgcctcctgggttcaagcgattctcctgcctcagcctcccgagtagctgggactacaggcgtgtgctaccacacctgactaatttttttttttttttgtagttttagtagatacggggtttcaccatgttggccaggatggtcttgatctactgacctcgtgatctgcccgcctcggcctcccaaagtgctgggattacaggcatgagccaccgcgcctggcctgagccactgcacccagccaactatttttttaatgtactgtgaagagtaactgagattacacctttaaggcactcggcagggtacctgcctaagtcagaatccaatgaatagtgtttgctgtcctatgaccactagcagctgcatccagacaggccctcaggtgccctgggctctggtgccaccccccatggtccctcgacagagtcacaggctctcttaactgatggggacccaccactgatgcagaaatgtccttccctgtgtccatcccggcttatataccctagtgacagagtgctgactacctgctgggccattcattctcttccagagactctttctcggggggaagttcaccctcaggcccacctgcagcctctggcctctgggccttgctgtgttctgcagcccccagagccaggaccatccccctgtgctggcagggacgacagatggacagacggtgctcagggcacagaccatctgccttcttccctccgggcctcatttcacagccactccatggccaggctgccccatggagttggtccgcatccttttggggttggctgtgaggcccactctcttccctgcctattgcctcaaagcaggcattgtaccagatggtgcagagccctcacttggagacatccacagctgagttcaagtcccagtaggtcacttcgtggctgtctcaccataaaaacataatttaaaaagagtagcatgggtttccagttatgacccagccatgaagtcagctaatatatggtgcaggggcagagaggtggctcctggtcaggccatcaaggtaggttctccactctaccacttactggtgatgcgatcctggtgccccgcagactccctttacccatatgtggaacgggacacttacactctcttctgcagagggtggctgtgagttatacccaagctaatgtctatgggtaggtgaatgagcctgcctgttcccaatggggcctgtcttgtgatttctccagccttaccccttggggtgaccctgttcttccctgtcctctttccgttaacctttgtgcctctactccctcagtccccagcaggcagtggttctgggctgacaggtcgtgtggggtagcgggcttcacgtctctgaacctcagcttcctccttggtaaaaggggtgacgacacccaccactggggtggaggggcgagaagagagaatgcaacaggagcagcgcagggatcgtaccaggttctccaccgtgcgcaggcagtgggtgcagtggctgtggccgttgaagtccgacaggtcagcggccgcgtacccgtcgcggtcgcggacttccagctccgcgccgttcactaccaggatctggcagcactgtgggggcacgcagtgaggacccggccgcggccacgagctgggacccccgcgcccgggcagggccgtgcggagagcgcggtgccagcagagggcgcgcgcccccaccccgggcccgcgctgacctctagctccccgttctcggcggcgtcgtacagcgcggtcccgccccacaggtcagccgagatctccccgccgtgcagcagcagccagctgagcaccttgctgtggccgcggctcgccgcgaagtgcgtggcggtggcgccgtctttgtcctgctccgacaggctcacgtcggtgcagctcacctgggcgggaggggcggggagagagggccgggggatgggggccaggcccctgcaggccccgcccacggtcctccgccccactcctgatggccccgctccctccactccccgccctgccggctccgccccgtctcccctccgcaccgcccgggcccggagctcaccaaccacacgatgaccgggctgtggcccatctgcgccgcggcgtgcagtggggtcatgccgtcgtgggcgcgcgcgtgcgggtccgcgccgcattcctgcaccaggtactgcgtcacctccaggtggccctcctggcacgccaggtacaggggcgtggcaccgttcttggtttgggcattcactcccctgcggagacacagcgcccaccgtgggctttcagcgcctcaccccctccgaggcctccttacccgcccccctcccctcccggggagccctggacggcagggagagtgggcgggagagggccctgtcaccggcccgctgccgcccggggggctccgcctggactgagtcctgagccaccctccctcagaggcccctgagggcgtcccacccagcactgccctgccctcagtcccacttttttttttttttttttttttttgagaagaagtctagctctgtcgcccaggctggagtgcagtggctggatcttggctcactgcaatctctgcctcccgggttcaagcgattcttctgcttcagcctcctgagtagctgggattacaggcatgcgccaccacgccccgctaatcttttgtatttttagtagagacggggtttcaccatgttgaccaggctggtctcgaacttctgaccttgtgatccgcccgcctcggcctcccaaagtgctgggattacagagccaccgcgcccagcctcagtcccactttttaaccgaggtctacaaagatgtggtgagctggcctttcctcccctctcgcccactgtcaccatgagtccccacaactgctgtgtctgacctctatccctttcatcgtgtgccccctccatctggaatgtccttccatcctcctccctcttgaagactcagtacccatccctcctccatgagggccaccctgatttatttcccccttgctggcctccgccccacactgcccagggccactatgagcatgacctgtcatgcttggttgaccataactgattttgacctttgcctcccccagaagactgagttcccagcgggcagggtggtaagggttgccagacaaaatgcagttcacacagttcaaccggaatttcggatgaacggataatgctttagtattctatatcccaaatattgcatgggacatacttatactaaaatacaacttttttatctgagattcaaagctagtcaaacatcccgggttttgttgttgctgtttttgttaatctggcagccctcgggatgtccactatgtactgaatgcttctgctgtgctagctctgggctacggcactggcaagcaggttcttctttttttatttttatttttgagacggagtctttctctgtcatccaggctggaatgcaatggcgcaatctcagctcactgcaccctctgcctcctgggttcaagccattctcctgcctgagcctcccaaacagctgggactacaggcatgtgccaccacgcctggctaattttcgtatttttagcagaaacccagttttgccatcttggccaggctggtctcaaactcctgagctcaagtgatccgcctgtctcggcctcccaaagtgctgggattacaggtgtgagccactgcgcccggccatcaactattactgtgaccatcaactgagattacaccggtaaggcacctagcaggggacctgccagaatcagaattcagtcaatggtgcagctacagctggggaggctcacaggtggggctgggactctgtgccatcacccatagtcccacaacagaggcacagactcagctctctcctcggtcacacagttggtaagtggcacttgaacacccatctgtctgtgcatgcagggcctggctggcaatatgggcatgcagggagtgaagagatggaatgtgtctcaggggctcctcctagggcctagttttcggctgtcactgtcccttatccttgctctgccagcccagagggggcctacctagggaacagcagggctgtcctggctgctgggctgttgggtgtgaacagcccagggtgcagttgccaccaaaggacactaggtggagccacaacctacccccagacccaggagaagttccaggttgggggccacgacctattgggttccagttcaccttttgtgcctaggaggccaattcctcacaggacttgacatcctgcccatctacctcccccagtctttcaccccgtagatcaaccacatgctccaccctgcattcatccctcgttcacccatccaactgcccatccacttgttgcctgcccatcaacgtgcaccaggctacccccctttgcccacccaccctcttgttcccaacacgactcagcccctcttctgacccctgtcacgtgtgccctctccctccctctcacacacatcctgagcccctcccagctggcatctccctgtccctaaagccctggttctctgtccacttccctgactcctgagaccccaaggctgactctgactgagacccctgactctgcagcccccatggacccccactcactgatttctcctccctccccactccctagacacagggctgccatttgctggggctgatgctgagccgggcacttcatgatggtgcggggagcaggcaccatgcctggtgatccagagggggtcccgtcaacacagatgagggagacagaagacccagctacgtatctatcttcagaaacatgctggctcgtggctgccagcctccacaccccagcgccagcgtcacccccacacacactcacatactgctgcatcagaacaggctgttgaatatttcatgaccgacgctcagcggcctaaattattcaccccgtaaccaaggcacagtgagtgccggggtctttgggatcaggggctggtgggggcccactgggttctttctgcagaggcccacggcggtgtacacagcgggtggggggccagacctgcagtgagctctgctctctcagcactccctacttggcagagatccatgacccaggggtgcccagccagccagagaaggtctgagaagctggcatcaagcaggatctgagcagcagggggaagtggtacccacggcctcctgcagggccgctggctggcactcccagcccaagttcctggcacggaatgagccctcagtaagtgctggagctcatcaccattctcattagtattccaccatctgcactcatgcgccccattatggagtcagagcctccagcttggaataccccagaacatgaggcagatatgctgttgggctgggtgggaaggggtcctggctcaacatccccttccaccttggcctgaggacaagaagaacaatgggcactctcacagtcactggggagtattacaaagatatggatgagcataaggaccaaaatgaaattcccatcacacacctggaatccaagcacctcgggaggccaaagcaggaggactgcctgagcctaggagttcgagaccagcctgggcaacatagagagacctccgtctctacaaacaatacaaaaatgagccaggtgtgttggtgcacacctgtagtcccagccactcaggaggctgaggagggaggatcacttgagtccaagaagttgaggctgcagggaactatgatcataccgctgcactccagcctgggtgtcagagcaagagcctatctctaaaataaataaataaatgagaaaataaacaaaattcccatcactagagagaggaattaataaaagtaataatagtaaataataataatagtgatagcagccaccatttactgaatgattactctgtctcaagcactgtgatgagtacaacacacacgttctctcagctggtctttgtaacaaccccacaggacaggtgttagcattgttcttctggtacagatgaggaaactgaggcacagagagctaagatcactctgtgagaaagaggcagagccccgatttgaggctgtgtctgatgcagagcctgcttctgactccaaatgtgccacgtctacaccccttctgctcttggtcggtctgtccctctgcctccctccctccctcccactgcacagaccactgcccttccccacagacctcactgctgggaactcaggaacactctttgacagctgctggggcacagccccgcaggaggacctggctcgagtcccgtgcctttgagctgtgccacagtcttgcttcttgtctctttgtgttcccaaacccatccatgaaatgggggcaacagttgtcatcctgacctcgtgcagagtgcctgagaagtgcctgcagagccctgagcacaggcctggtgcctggcgcacagccattgctgaactttaggatccttccctgtgcctgggaggaccagccaccaggggggtctatggctggcctggcctgtccgggtcctgccaagtacgggccaggctgggcatcatttctgctgtggggaacactacctagaggggagaggatgggtcttgggggagacctctgactcccagacccttgccagctctagccctgaccacagtgacagctgcagaaaagtgctcccagaccaagcccttgccctttgccccggctttgacccaaaccctctttgtaggtcagaggcgccctggcgatgatcgtataaatcatgatttgttttctttctcctgggaacaaagatgctatggatgaactgtaactattcatcaagtcacctctgattacacaaaagaaacatgggtcccccgtgtgggctgtgggaatctctggcggagactggtgccagctgactgccagcaccgccgcagggagtgagctgcccatggagccagagtcgggctgcagaatgattcccgcagcccgccccactgccagtcacgcctccccagagggaggccaggaagaggctgtccctccgaggatcagtctggttgtggcccgtgactgctttcaattgaaattcacggagcctttggtggatctacggctctcggtgtcctccagtcaaacttcccggcctatgttaaaagattcccaagtaggcctggcccagggaagaaatgcagccccgatttgagaaaggttctacaccccagcccatcagctagcatggaatagttccagaagcctacagttgcctgcaactctcccagcctcccaggtcttcctcctggcccgtaattaggccaaatttgaccccccctgaggcctctacacctccccacatcactgccagttccaccatggcagggctgcgaggccgaccctcttttcattaggttctcagctctcctcccctcaaagatgcctggcttccctgacccctcaacttaaagaaccatccccatcgcttcctaccaaactcctcatttcactatatagcacttgccactcctgaattatcttgttctcctattcctcagacccatacatgcgtggatagaagaatgtgtggctgacgtgatgacaggccgggcagttgagtgcacccacttgctgtttgttgaatgaataaatatgagaagggacatccaggccaggagtaggggatgtctcttcactcatggccgcagcctggtagagcaggttagatccacttgccagataggctcggaaatgcccagaggggagttttgtctagggtcacatgcaatgagctgtaggcagagtggacaagtccctgggattccatgccccactcattcagcagatgtttactggagtcaggctctgggcatacagagccgggaagacaaagcccctggccttattagtcacggacagacgggatgaaaacacacatctgtctgtgtgatgcagggcccagccagaaatccgggcatgcagggagtgaagagatggaatgtgtctcaggggcttctcctaggggttagcttccggctgtcacgcaggatgcacacagaacgcaaagccaggcaaccatagggcggctgggaggccaggtgcagtggctcatgcctgtaatcccagcactttgggaggccgaggtgggcggatcacctgagttcaggagttcgagaccagcctggccaacatggtgaaaccccatctctactaataatacaaaaattagccaggtgtggtgccatatgcacctataatcctggctactcaggaggctaaggcaggagaatcacctgaacctgggaggtggaggttacagagagctgtgccactgcactcaagcctgggcaatagagcaagagtcgagtctcaaggaaaagggcagcagggaacaaggtcagcgggaaagtgagtgggcatcatgggcgcgggtgacaatttcagcgaggctcagggttggccttgctgaggtgaggtctgggcaaagacttgcaggaaggcagggagcaggcggggatctctgatccctgcagagggatcagcctctgtgaaggcaggggtgctggcctgttggaggggaccacagcccggaggagggacagcctctgggccattgtaaggaagtgagcagcattccctgtcagtggccagaagcctgtgacgggaggtgctcttttttttttgtgaaacggagtcttgctctgttgcccaggctggaatgcagtggcacaatctcagctcactgtaaccgctgcctcccaggttcaagtgattcttatgcctcagcctcccaagcagctgggactacaggcgggagccaccacacccggctaactatttttccccctgagatggagtcttgctctgtcgcccaggcttgagtgcagtggcgcaatcttggttcactgcaacctccgccttccgggttcaagcaattctcctgcctcagcctcctgagtagcgggattacagacacccaccaccatgcccagctaatttttgtattttttagtagagacggggtttcaccgtattggccaagctggtctcaagttcctgaccttgtgatccgcccgcctcagcttcccaaagtgctgggattacaggcatgaaccactgcaccagaccaggacttgcattgtcttttcttttcttttctttttcttttttgagacggagtcttgctctgtcgcccaggctggagtacagtggctcgatcttggctcactgcaagctccgcctcccgggttccagcaattctcctgcctcagcctcccgagttgctgggactacaggcacgtgccaccacacccggctaatttttgtattttttagtagagacggggtttctccatgttggccaggctggtctcgaactcctgacctcgtgttccgcccgcctcagcctcccaaagtgctgggattacaggtgtgagccaccacacccagcaggacttgtgttttcaaaggctgcgggtggacatggacgggtgaaggccagggcctttcaggcttactgaggacttccccttttccgttctgtagtgcacagcctcacagagccttgggcccagctgagcccaaggggttcaggtagcccccacgtgaggcagaaagggggtttctcagaagccctgggatgccccagcagcgtgctgcttacagagccccagggtccaaggctcagctctcccccttagaagggtagggcaggagcactagccccggttagatgacagctgggaccaggagctgctggtggagacacgagatggtctcctgctgtgaggggcttccccggactccaccaggcccttcctttcccagagcctccacgtgggtcagggagtcaaggacggcagccacctcctcagtgtggacacaggccccgcccccacgccctgcagccaggtgaactgacagacaccaggggtagatctggggctgctgataaaaaggaatgagcccccacggcctgtggcagaatcagggaccaccccaggcagagcctccagccttctaagggggagagttgagccctgggccctggggctctctaagctgagagttgctaggggcttcccaacaaactccctttctgtcccaggtgggggctgcctgaacccctgggccgtgggagcagccagactccgtgaagctttgcacaaaggaagggaaaaggggaagtctgcagtggacttgaaaggccctgagtgattaggacctggaccaggagtgggagagagacccagagaggaggtacagcctgctcaaggccacacagcaagccagtgatgaccacagctggtgaatcagcctctctaaaacaccatttctgtacctgtcagctccaccaggcagggacgcttgtctggttcaccagcatatcactggcatttagaatattgcctggcacatagaagatgctcaataaacattagttgaatgagtccatctgtaaaatgggctgattacatagctactgctcggggtggttgtgtgactcagatgacactgggtggtgccagacccctagaagatactcagcaccaggttctttttttctttcctttcttttctttccttcctttctttcattcgttccttttttttttttttttttttttggacagagtcttgctctgttgcccaggctggaatgcaatagcatgatctgggctcactgcaacctccgcctccctggttcaagcgattctcctgcctcagcctccctagtagctgggattacaagcatgtgccacctgtacaggcatagcccagccacacacccagctaatttttgtatttttggtagagacggggtttcaccatgttggtcaggctggtcttgaactcttgacctcaggtgatccacctgcctcagcctcccaaagtgctgggattacaggcgtgagccaccatacccagccccaggtactttccaatcccattccagtctagtctggtcaggggtaggggaggctttgggggaaggaggcacctgctgaagttgataacatctctgggctaactggttttccagcttgctgtgactggcagcacccacgagcccaggggaagagactggagcctcctcactccccagcctggaagctcaagcctcagggtcccagctgatccccagctccccgacccacacagccctgtccagctgctcaggccctgggacagccagaagcaggtgtgaggggggcagagtgagctcctgggccccaggaccctcctgggagggtggccactggccttggggccacctgctcttcgcccctcctcactctgccctgaatgggggtctggaccccttgttcccctccatcagccactggagctcctgctgggagggccaaccctcccaactcaatctccctgagacccagagcctgggacttgcccagcccagctcctgccagccccgtacctcccaactgagaggtcctttttctttttcttttttttccccacctggagatggagtttcactcttgttgcccaggttgtagtgcaatggcgcgatcttggctcactgcaacctccgtctgccgggttcaagcgattctcctgcctcagcctcctgagtggctgggattacaggcacgcgccaccacacccggctaattttgtatgagagatcccttttctacaagggctcagagggagggtcccacgtggcagcagccccgaggtcactgtgacaagtcctctgcttctgggaagacttggccccatgaacgggatagacagggaggtgtgggggatgtgcaggacattcctgcaatctcaagcactttctattataacaccccaaggtgtagccctggaattagctgagcctccccgaggctgtccagccttccagctcctctgcagcgtgtcacttccatgtctcatggccacccacagcccctccctgggcaggatcgagtttcccaccagcaggtccgggagcccttcctccctcagcactcacccacgcgccagcgagagagctgagccttgtgaataattcacagcaattcacagcaggccccagaggctcgcaagatcatgaagctgggccacctgggtgccctgattgggccctgtggcctggggcagctcaagcctctgccctacccagctcccagccttcatatccacagcctcggtgagcaggaatccctacccgcaagataggaggttaagtgggtaccccagcccccaaccccaattcccagctgctcttcctgcataagcccagcctggcaaccacagaaagacaccttcttatcagtcgagtcacatgctgctgtggggaacggagcccaagccctctgtccacctccctgagattcatggtgactcctggggggctggcagctcatcagtccaggccatctggccactgggtcggcaccagcgcccaatcacacacagcacctggcatggcctgggagggggtcagggttccccagccccggagccctggagggcgttccacagcacagccagtcttcctaacacctgggatccagcccacggagggatcgtggcttctcagtgaggaaggcttaggggccggcggtccccaccagcacttgcataaggcgggctcagcgtcttccagttcacacttgggccatattggtcccgccatcaggggcacctgcccctctcaagacctgtccttctcctctgcttgaagtgagggggtgggacaggtgcatcagaatcaccgccatgagggtggggacatgtcccaggtgtggctcccaggccccaacctggagagtctaactcaggaatctgggacagcctccaagaggtgttgacaggagccagttggaaccctctactcaagggtccctgggtccctcctagtctaaatcccactgactttgacatgatccaaaccctagtttgtttggaagtagtgaattcataccaaagcagccaccaagaaggcctggcagggctggttgtgaagcaccccttcctccgggtgctgcctgttgggtctcccactaaccaaaccagggagccccttcttagcaaggatggaaccaggcccagctcccttgtcctgggctgaggggaccactggagcccggcctggtgggtcctagggccaccctacatccacgccagtgtgcctgggcccaagaggctgcagctgtggctaccttgccacatggccatatggccagaactggcctccagcttgctccctggtggccaggggccctgcaggcacacccagaaactgaccagtggtggggacaggccagaccctctcacctcgtagctgctctcgtcctgaggctgggtccacattcacatttccatctcaggctcccacttagactaacgagggtcacccatcagagtaacccactccccgctcagacccctgtggcatctggcaccctaccctctcagacagggcctgggcagcttttcccaggatccctgcctccccaggcgcacctaagacctgagtctcttcctccctccccaagactcacacatgccacctgctctgttcgaccccccaccccacccgggggagctcccagaccactccccaggaggtttgggatccccatgcttcccttgatagtgggaatgggctgaggggccacaggagataacaagttgctttctggatggcctccagccaggggctctggggtcaggaggtggggtgggggttggggaggggcctttctcccttaactgcttggtaactaatggggttccctttctgcctgtttgactagggcctaggaggcgctcctgcccttgctgcccccaactccattctgaacagtcttgcaaatgagcacagcctgagccagagagagcccctgcggcagaagcagcccaaggggaacaggtgaccttggcctgtgtgcccagcctcccaggtccagctgcgtgcggccgggcagctgaggatgttgggagcacctgcttgcagggctctgggggcagccccagaaggggttttccaggaggggaagatttcatgttgagtgggagccatttctctggcctggccctctggccccaggatggctactggagggatcattgccctggagtgccagagaagtgtggaaaatcccaggcatcccccaaagccctggcccggcccacccagaggaccccttaagaggagtgatcttactcagggtagtgcctgacgagaagcctcagggaggggaagtctcctttggctgcagcgtagtggataggcagggcgcccatgtctgtggccgcggtgggatccccaccgccatgatgcaagagccagttcaccaccttggggtggccaaagcgggcagtcagatgcaagactgtgggaccagaattgtctttgtcctgtgggaggagagcgggttcaagtcctaaagcctgttgctgccccgcccctggcttgggccgctcccagactcccacaggcctggaaggtagctctgtgctctctgtcttccctggaagaattggccaggcctcactcagcagtggtttttttgggtcaagcggatcctgggtttgaatcctgcttctgtccttgggcaactaattggccctctctgaaccgtacgtagccaataggcagcaccgtgcagggttttcagaggctgcaggtcctgactgcgagctgcctacacgacaggcacctggttgtcatggcaggagactggctccaggcccagggccacagccctgactcccaggggctcagggaatgcctgaaggagtgacacagggttactgggctgagcagggccaggaagggtggctgtggggctgtaccaagctagcatcaggattggggggcagcccctgcatccaacacttgccccctctctctccacccttcctaggtgtcacgtgggaacagagacctccaccttggtgcgcctccagcaacccaacctcagtgccttagtcaggcaataagggccctggggactggtttgggtaggaaggacacaccaaatgagcaggaggaatttccccatagaggcgaagagaatccagagatggtgagggagaaaagcacataagaaattaaaaacaaatgcaaacaaacaaggttgaaacagggctggagggtgtgaatgtggtgattcttctcttcctgaggagacagggtcctgcgagttttgtcacaagtcaggaagctccatcagctctgcaacacctgagtcctggatggcgggagatgatggcttaagatatctgggcgcaaagcctgaggccctgcctgtaactccgactccctcaagggcagctgagagggaggactcagggcactggggaaagtcagcagacccagtcacagaattagaataaggtggagctacgcagggaagacaacaccaactatttcctttttcttattttattttattttatttatttattttttttgagatggagtctcgctctgtcgcccaggctggagtgaagtggtgcgatctcggctcactgcaagctccacctcctgggttcacgcctttctcctgcctcagcctcccgagtggctgggactacaggcacctgccaccgcgcctggataatttttttatttttgtatttttagtagagacggggtttcaccatgttagccaggatggtctcgatctcctgacctcatgatctgcccacctcagcctcccaaagtgctgagatcacaggcgtgagccaccgtgccctgccaacaccaactatttcattggcagtagaagaatcacactctgcagctactgagaggtggaggtgaagccaccctgccgagcagccaacctcactttttggttattatccttgtgccgatgctgccggacaaactctctctacaaatctcagcatgtggaagaaacagaggcaggaacaattgcccagcacctttctatttctcgaggacactcttgaagttattcatcaatgttttaattaaagcagatcttatcgcttttcctcaaatgggaacttgttcacttttagactttgttattgttcattttgggcttatctttggtcttttcctgtgctcttaaaagggtgcaaatcaaaatctgagttatgataatccacttatcatatgactaattacttcagtacaaggagttcctgcctgtctgtccaatatgaatcttactacgtcccaatgtcacattggcttcttttccttctcggtggcagcatttggagcttttacttaacttagggtcaatttcgacctctgaattttccacccctcccccacagctgttgctgggtcatgctgttttcttttatctctataaatattgtgacttgtaattgtcacttataaattcattctggctatactgaatcattcccccattatccaagtcatccaaatattcgatgtgcatttccacaaatcatgtagtggccccctgattggggatgatttgtagaattaattatatgctttagatctccattcaggtcttcaggtcaccaatacattaagcagagcagggccctgaacagcttatatggatcaacgattgacagagctgtcggggttgctgcaaagccactgactttttgctgttccccgtaacaaagtatgttcaaatctaggtcacaggtttgtggtagggtcgattcacagtatacatgtgcaacggcgttcagtagcatagcagttgaggttgtgaagacatgtgcacccaggtcaaagaagaaagatccttagacaaagccgctcaattcccaggcacccaatcttccttgggctttgtgaacctgagatttgacaggctcttgggaatgtctgtctctaagactctgttggcaggcttaatcaggctggtggccatctccatatgtgcccccccagcatttgtgacaaaataagggaagggggacccaataaagctacttctgaaagcttatgatcccacccctcatttaaactatgtgatgttgtcattctatataaactctttccaagtaacttaactaaaacacactttgccattagtcttgagtgtgggcacagcattattcttttctaggccttaagggttccttctgcttaaaaataatgtctaactttcatgaagtttacccatgattaaagtgccttctgaatatatattatcttgttctattggtttcaatatacctattttctttaaaaagaaaaaaatgatgaaccatgagtgttaacaccagaaaaaccttaaggtacatctgatctaatttcccactttaaagtgagaaaatcaaacagtgcctaggggtttgatttttccccaggctaattcgggttttcatatttccatctcaaagtggactttctttggctaactttaagttttaaacgtaaaggcctgaaaagtaactcaggatctagctttttcattagttttgatcgtgtatgaaagcaaatatttctttcccccaaatgaaaccccagggcttccagtatttgtagtgatagtgtgaatccattaggtctatttttaattatatctctcttattggttatttttttcacatttcctaactcatttgtgatattgcttccatataattcaactttttgtgcgctgggttcccatttgccccacaaaggcctatgtgcaaatctgatatcctgtttgaatgacattgttttgtttttaccttattgcttcctatctttcacaacaatgttgtcagttctcaacattaaggcattaaaaattagcttttctcaaatgctcagcatcattaatcattagggaaatgcaaattaaaaccataatgaatatcatctcacacctgttagagtggcatttgtcaaaaaggtgaatgatgtgttagacataatgcagagaaaagggaacacacacattgtgaataggtatgtaaattagtacagctggtgtggaaaacagtatggagtttcctcaaaaaactaaaaatagaatctaccctatgatccaggaaccctatttctgggtacatatccaagagaagcttcagagagtgctttgttgggttttctggaacccggcagggctcaggtgtgtggggatgcgctctgtgagcctgtgtttcctccgccgtgagggctcctcccgctcctgtaggaaaaggcagtgcccattttgtcttgtccatgtgggactccaaagggtccagacgcgacagaaaggcggcgaatcctctcagagtgggcaggggaggagatgatagaatatggggaggagatagaatatgggaatggggcagtagaggggtgggatttcatgaaatttcctgattcaaggctatcatgaagtaggcctctttgggagctcggccctccagtcgctggtgagggtaacatcccaccagtctctggtgaggtccagtcgcctccgccgactgcattgaaagccaaaagcagaactaggccagcaccgcggcctggcgtccagtgacccagcggtctgcatattccccagggtggaagcactcggacttcaggtttgaaggcaatgcggtcaccactgcaataagaaaagcaactagggaaaatggcaccttcttctccaaacttttgagacactcttgctctgtcgtccaggctggagtgcagtggcacgatctcggctcactgcgacctctgcctcccgggttcaagcgattctcctgcctcggcctcccaagaagctaatttttggcatagagagagagaggggggaagggggggggagagagattgattttaatgtcttcaagcaaaaagagactctttctgcctgttggccatctgctgccaggtgaacgtgaaaatccatcgagacgctttctgtgaaaaccgcctttatctctttgtccctcttaggttaaaatccgcactccaaaaccttattgaacagaaaaattacaaaaagcacatataagacgtttcagttttgtaaagggtaaaatgaaactgcccttcaggaagaatcagaagaccgacgagggagagaggagcgatcgtgaaatctaagtgggctgcccccgggtcttccagggttttgtactcggtggcttggcctgagttgatgtgcccatattttcaaacagccaagtgccctgagacacagcctttgctacggtacctgctgaaatctggaagtgtgattaactattacttaaattgagtggggcagactaagagacagcagcagtgaaggatgccctttgggagaaagacgtcgaggcgctgaggccaaagggtccgtgaggaaagagcccgcagctcgcgcccctcggcctgcggaagggagggcaaggagggtcctacggttcctgggaggacgcgaagagccaagagctctgacagctggcgccggggaaaaggccccgaggcggggtccgcatccctggaagggcggcgtccacactcctgcgaggcacggggcgcccggggctcggaagctcaaagcccgccggcttctgcagcttctggagcttctgggagccaagagtgtcagccggaaggatcccgcacacggcgcttagttctggaactggatacccgggggaggatgcgggatcccgaagcccgggtgtgggtccccgtggtcttcgtgttgggggtaggtgcggaacgctaagcctgggcctactgggagccatagtcttcttgatggctggtgcttattgggcttttttcagtcgaatttcaaaatgcagttgaatttcttactttggaaacgataatagaaatggctgacctcagattttcatgattatgttttgccttttccagtgtatgtgcagtttctgtagtatagtggttatcatgtttgcctcacatgtgaaagacccttggctcgagactggagggaaacatggttttttggtttttctttttgtccctaaatttagtgagtttaatcgaggttgggaaacaaacagaaaagtagttgaacctgtggctacactttagacctcctcaatctagacagattgttgaccaggctacagtttccactggtctgccagcaagaggcctgcttaatgttagctttggttccagaaattccttaagattctcttcattctcttctgtcgcctgaattttcataggctgacactgaaagtggatgacatcttaatgcatttcctaagtgtcccgctgggcttcgctttactctgataagttgcagatctggctgatttgcgagacaaaaacaaaatatttttttaaaagattctaaatctgcatctggaacttgtagagtcaataatctgaaaccacacgaattatctacatacaaaagattttgaatgcataccccttccccaaataatcctcagaaaaccggttaagttttagcatctatgactctgagatgcatatgaggcctttgtaaatttagaagttgagagtagaaagtacaggtttgtattttagaaggagatttgggaataaatatagctctggtggatatagatcatatgttaaggtttgttggccagagctggtgtgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatgtggggaaaactctggatttgtctcttcagttgaatgtctccgttgaaaattgaggaaagaaatctctctactatttgaacttcatcaaaagactaatatgttaatattttgaccgtcaatatttccttaaactagtctactcctttcatagctaatacatcaaagcatattaacttaggaaatgggattctcccaaacaaggaaacattgacggcaagggttcttaatcttttcacaccacatttccttcaaatgctttatacatcttcaagcagacaaataatagtattataatgattacgagaccgatcattactcttttgccaaaaaaaccagcgacaaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggta

(The sequence listing continues in the following parts.)

What is claimed is:

1. A method of hybridizing a nucleic acid probe or synthesizing a nucleic acid product, comprising:
   (a) hybridizing a nucleic acid probe to a polynucleic acid by nucleic acid hybridization or microarray analysis, wherein the polynucleic acid is from a sample from a human female subject with endometriosis, or
   synthesizing a nucleic acid product from a polynucleic acid by PCR or sequencing, wherein the polynucleic acid is from a sample from a human female subject with endometriosis; and
   (b) detecting a genetic variation in the polynucleic acid by the nucleic acid hybridization, microarray analysis, PCR or sequencing, wherein the genetic variation is:
   a CNV with a sequence of SEQ ID NO:1, a CNV sub-region (SRN) with a sequence of SRN1-SRN3, or the complete complements thereof, wherein the genetic variation is of a TGFBR3 gene.

2. The method of claim 1, wherein the genetic variation results in a loss of any one of the CNV or SRN.

3. The method of claim 1, wherein the sample is from blood, saliva, urine, serum, tears, skin, tissue, or hair.

4. The method of claim 1, wherein the sample comprises a purified nucleic acid or an amplified nucleic acid.

5. The method of claim 1, wherein the microarray analysis is Comparative Genomic Hybridization (CGH) array analysis.

6. The method of claim 1, wherein the microarray analysis is SNP microarray analysis.

7. The method of claim 1, wherein the sequencing method is a high-throughput sequencing method.

8. The method of claim 1, wherein the nucleic acid product synthesized from the polynucleic acid is cDNA.

9. The method of claim 1, wherein the detecting comprises detecting a first genetic variation, wherein the first genetic variation is the CNV of the sequence of SEQ ID NO:1 or SRN1-SRN3, or the complete complements thereof, wherein the first genetic variation and a second genetic variation are in a panel comprising two or more genetic variations.

10. The method of claim 9, wherein the second genetic variation is a CNV with a sequence of any one of SEQ ID NOs: 2-47, a CNV sub-region (SRN) with a sequence of any one of SRN4-SRN172, or a complete complement thereof.

11. The method of claim 1, wherein the human female subject is asymptomatic or is infertile.

12. The method of claim 1, wherein a whole genome or whole exome of the human female subject is analyzed.

13. The method of claim 1, wherein the method further comprises generating a report indicating the human female subject has endometriosis.

14. The method of claim 10, wherein the second genetic variation is a CNV with a sequence of any one of SEQ ID NO:18, 19, 22, 26, 30, or 32, a CNV sub-region (SRN) with a sequence of any one of SRN38, SRN39, SRN46, SRN50, SRN54, or SRN56 or a complete complement thereof.

15. The method of claim 1, wherein the method further comprises administering to the human female subject that has endometriosis an amount of an agent effective to treat the endometriosis.

16. The method of claim 1, wherein the TGFBR3 gene encodes any one of SEQ ID NOs:48-51.

17. The method of claim 9, wherein detecting comprises detecting the first genetic variation and the second genetic variation.

18. The method of claim 9, wherein the panel comprises 5 or more genetic variations.

19. The method of claim 9, wherein the panel comprises 10 or more genetic variations.

* * * * *